United States Patent 7,745,391 (HUMAN THROMBOSPONDIN POLYPEPTIDE) - sequence listing, part 46

SEQ ID NO: 118065 - DNA, 297 bp, Homo sapiens
acacacacacgcgctccatcagtcccacgcctgcttgtccgtcaagtctcagtctagccctcacctcctcctttgggaagccagcccagagcccctgacctgcctcatccctccctccccagagaaccaggaggcagttaggggacaggccttggcaatcaagcgccagattcaaatcctccctacttagaatctctgaacctcagttttcttcatctgtaaaatggagataataataacagaccattaaaaacccaccctcaggtagtaagtgaaatccgaaggttcaattgtata

SEQ ID NO: 118066 - DNA, 628 bp, Homo sapiens
ctctcacacctaatggattataggcagtcataacttcagcaagttggtttgaaggtgggttccacatataaatcacatttcagcaagtatttttgcttctacctgaaaaacaccctcaatttaacagtgataaaaacaagatttgtgatctgaaagaacactgtccaacatataacaagcacaataaccttttggtatatgtgctgctgaagtgagcacatgggcgtgataacctttttagcgctcaaataagggctgcaaatacaacccaaccctctgtaaggggaggagagtaggcagaatttgagactcacacacatctcactctttcagggcaaattctgatgcactttagatttccccttgaattacacaaggcattccattttaaccgaaattttttctgtatcatcaaatactaagggaggccaggcaaggtggctcacgcctgtaatcccagcattttgggaggccgaggcaggtggatcacaaggtcaggagttcgaaaccaggctgaccaacatggtgaaaccccatctctaccaaaagtacaaaaattagctgggcaggcacctgtagtcccagctactcaggaggctgaggcagaagaatagcttgaacccagggg

SEQ ID NO: 118067 - DNA, 414 bp, Homo sapiens
atatgttatctaaaataaacaaactttaaatataaagacacaaatagattaaaagtaaaaggtaaaaatacacacacacacacacacaaagtagatctcaaaccagagaatattttcagggacaaagaaggtcattccataacgataaacgagttaattaatcaagagtatgcaatcctaaacatttatctcctaataatagaacttcaaaattcatcaagaactcacagaacttagaaacctgaacattgaaaattagacaaataccaattatattgggagatttcaatacccctcctcagtaattgatagaaagagtagaatcagcaaggatacaatagacctgaacaactctaccaaccaacttgacctaattaacatttgtttttcttttttcaaacagagtttcgctct

SEQ ID NO: 118068 - DNA, 105 bp, Homo sapiens
gcacgagaatgcgaggagacagtgaaccaggagcagagaagctgggagagtagagacaaagcgtcagtagactgaagctgagattcaagagctcggtaagatgga

SEQ ID NO: 118069 - DNA, 800 bp, Homo sapiens
ggaacagtattgaaactctgggaattatctgagatgtttttggctttctgtgacaacagtggggaactcttccagtcagaacagggtgttaatcaaggcattgctaataatgagagcctctgttcctggtctcatttctccctgtgatctgggaaggctgccattttggtccagtaactccaatggagtcccttccaggaagtccttgactggctgagccctgtctcatggttcaatacataaatacgtagaaacctaggaactttccctttcgctttcttaagttcctccctatggtctcaggaactggccctttgagggtacatcaggctgaactgagagcttttgtggttggagtagttgcctgtagtcttgaggatctaagtggcaaaggcctttgagaaattcctggagactgtcctgaaaggatacagaaagccagagccctggcacagtggatttgttttataaatccatgaagtctcttaacaaagaaagactcagcagagtaaaaatgaatttggtgtcactgcagagatgaaaagtaaaggaaagtttgtgtcttggtgtcgtgtgtttgtgtgactttggtatccccaccaactcccccatttccaagagtgaaacactggttacattgggatcatagccttttgaaaacctccatttggttgctttctaagaaccactcagataccagagtctgggtcagtgaccccaatcttgccaccattgtctcttgccaaaaatgtgagcagacagatcaaatgatatattcacactccctgggtgagtgtggg

SEQ ID NO: 118070 - DNA, 174 bp, Homo sapiens
ctaagtaaggaaccacatttttctaccctgtaatcttttttactctgtaaactaattactttccatgctagaatgctcacacagcactggctacgtaatttgtagggcccaggtaaagtgaaaatacagggcccgttacgcaaataaatattacaaatttcatgatggcaacag

SEQ ID NO: 118071 - DNA, 190 bp, Homo sapiens
caagaactccagtgtctaattctggcaaattcctgttttagcatgaccttagatgactagtctaattggttcagcatcttcctttgttaatgtgatgatcattattttgccctgctttgtatgttgcagtaaataaagtgctgtgtaaatgctaattattagtgattatcaactgaattatttaatctag

SEQ ID NO: 118072 - DNA, 444 bp, Homo sapiens
gggctgggattgggttgggattggaggctgtgggtttggaggcatcttcgagggcactgcccgtctctgcccgagtgatgctctgaccacagatgaattcatcgttcactgtaaaaatcaaatacgtggcccttgcgtgtttttttttcctcttttgacaagacaattgatgtgccatctccagcgtatctgcttgggtcggaagacttgctttagcctcctctagaacaaccagcgtgtctttgggtttattgcagtctacaggatctctatgttatttaaggactagagaggtgagcgatgaaaaagggaaagatataatgggaaccatttttttaaacaactttattgagatgtgatttacatactgtaaaatttacacatttcaagggttctatgcaataatttttagtaaacttactgagctgtgcaaccaacaccata

SEQ ID NO: 118073 - DNA, 213 bp, Homo sapiens
tgcatgttctttatgtgttagtaagtgatcttttgctctttttcatagaacatctttgtattgatgacatgtcaattcctttgtattactcattagggaattagttcagtttcctgaaagaatctttctccctggggaaagagggtcaataaacaggtaggttcaaagcaatgttccagtggttgttttcacaacacaaatattcttcttttt

SEQ ID NO: 118074 - DNA, 204 bp, Homo sapiens
agcaataccagacagcaaggacacctgagcgtgtgttaaaaatacaggttcctgggaccaactcctacgtgtctgagtgcctcggcgaaacctggagatgtgtatttttaaaggcccccgaggattcggatgcacggtgaggttggagaagagctagcccaggggtctctacaaatgaagggagccctggaggctgagtcccct

SEQ ID NO: 118075 - DNA, 829 bp, Homo sapiens
aagctgctccaggtagtcccagaaacaagtggaggtggtgggagatgccacgtggctgggctgagatcctgagtcagcaggcaggtgcagggagacagaaaattaaaatgtgacttttatgttgatgtaaccttctttagagccacaggctggggcttaggcacatttggtaatagaagacatcgcgcttccatccacaagcaaggaaaatacacaaaaatacacaaaactctcaggaatatcttctattattatctcacacatgaaaaaagatcttcggaggttttagaaagttatctgagagtccctctccctctcccgctccctctccccacggtctccctctccctctctttccatggtctccctctgatgccgagccgaagctggactgtactgctgccatctctgctcactgcaacctccctgcctgattctcctgcctcagcctgccgagtgcctgcgattgcaggcgtgcgccgccacgcctgactggttttcgtattttttttggtggagacggggtttcgctgtgttggccgggctggtttccagctcctaaccgcgagtgatctgccagcctcggcctcccgaggtgccgggattgcagacggagtctcgttcactcagtgctcaatggtgcccaggctggagtgcggtggcgtgatctcggctcgctacaacctccacctcccagccgcctaccttggccgcccaaagtgccgagattgcagcctctgcccggccgccaccccgtctgggaagtgaggagcgtctctgcctggccgcccatcgtctgggatgtgaggagcccctctgcccggctgcc

SEQ ID NO: 118076 - DNA, 309 bp, Homo sapiens
aaaatcagtactttgggagccaggcagttgaagagtaaagaaagtgagtggatcacagtcaggggttagacaatagaggctggtggagaccatggataactagagatttggctttaggagattgttgtcatgttgtacccactgttgtcagatcatttagatttcaagagaagctgaaaatttgaattttcatgttaacgtgtcctaatttttaaatgttgatgactaattcaaggttttcaaaatagtgagatctaagcaaaatacatctgctgaccagatgtggctctaggcttttagtgtgtaacc

SEQ ID NO: 118077 - DNA, 313 bp, Homo sapiens
agcaatggatttccttttaaatggagaggaggatgtcggagagataccatgaaacgaattctcgaaactccaggcagcaataccgatgaaagcgcattcttccaaaacagagctcctcattcagggccacatctgagcctgggggcccaatgctcagagcgtgcctggctttctggggaaaagcgccaggaacatgaacgagctacgaagagctggagcgggcgctgcgggagcagcgtgtggggaacggctcgggagtcgctgctggtaaccccggcccagccgcccgcagctgggctcgcagccggctcgc

SEQ ID NO: 118078 - DNA, 417 bp, Homo sapiens
tgtgtgataaagatatttcttcatttagtcacttcatctacctgaatacctgtgtaaataatgcacatgcaggctaccagatgtgctgccagatacctactaaataccattaataaagcttccagatttccagctctagctttcaactgctaggcctctgaaccagaatcagtggtcatttcctaggaattctatgcccctttctatcctatccttttcccatacagtacctagtcatacctcctcaaagtcggaaactttagattggacctaggtaggtaaaggtaagagctgggagtctgaagcactcacaatcaagggaactgcacttggcatagaaattgagagcaaagagaagacagacatttattgtttcactcaactatgggactgggactggtagggttaataaaagct

SEQ ID NO: 118079 - DNA, 354 bp, Homo sapiens
cctcatttagccacatcttcatggacatattttatcactggtcatttttattatagttattctagtgtgtgttaagtggcttctcattgtggttttaatttgcatttcactaatgactaatgattctgataatcttttcatctgtttatgcccattcacatattttctttggtgaaatgtgtactcaaatcttttgcctgttatcttatttattaacaaattattaattataaattgataaattatagttgtcttatttattgggtacaaagtgatgttatgatttatgaattcaatgtggaataattagatcatggtaattcacacaccaatcacctaaaatcattatttttt

SEQ ID NO: 118080 - DNA, 642 bp, Homo sapiens
cgattctagtttgttcaagtacttagtactgtcacttttaaaacttggggattctagaggtctctactcttttacttatgtaatatttttcctggagatctttgtattgctttgttgtagcattagagatagctttcttgcttagaaagttaactctactgacctcaagtgatctgcccaccttggcctctcaaagtgctgagattataggcatgagccaccacacccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgacctcaggtgatccacccaccgcggcctcccaaagtgctgggattacaggtgtgagccactgcacccagccacatttattttttatatgaataaatggatggagacaatcactatgaaatgcagtggtcaagagaagattggggcttgagccaaatctt

SEQ ID NO: 118081 - DNA, 88 bp, Homo sapiens
ttcttctcccagaatatggaggcaccaaagtagttctagatgacaaggattatttcctatttagagatggtgacattcttggaaagta

SEQ ID NO: 118082 - DNA, 124 bp, Homo sapiens
accacttcagctggccccatccttccctctctacgatcctcctctctcacctataaatgttaacatcctctactctggccatcttatacagggttgttaggcgaattaagcaacacagtacgtg

SEQ ID NO: 118083 - DNA, 112 bp, Homo sapiens
acttgggtggatcttggagagatatggagaggccgggggagggagcagctgctcatgggggagaagctttaggtgtaagtcagcaatctgttctcagcatctggaaattgcc

SEQ ID NO: 118084 - DNA, 300 bp, Homo sapiens
gaaactccgtctcaagaaaaaaaaccaaagaaaaaacggacaaaagggaagataatcccagtggataaaattataaacccatagattcaggtaacttaaatagccccaagctgaagaaaactacaccaaagcccatcataatcaaatcatggaaaaccggagataaagagaaaatcctgaaagaagctattgaaaaaaattatacattaaatagagaaggacaatgataaaaattccagcagagactcatcaggaacaatgcatgccagaaaacaatgaaacaacatttttagtactgga

SEQ ID NO: 118085 - DNA, 299 bp, Homo sapiens
ctcccaaagggctgggattacaggtgtgagccaccacacctggcccccttcatatattttaaagccattaaagcaagctgtgatggacaataagattggtttcttttgctcacatccatgtgaacttatttaattgtgtgtctgtggtagtgaaactttgaaccacaaaagacagggactactttaagccttcgcttttgcagattgatacgtgtatctcgtccttttgcagttacttgtcattatctgcctaagaatagtatttctaagaagttgtttctgtgtatcttctggggaag

SEQ ID NO: 118086 - DNA, 461 bp, Homo sapiens
tggcggaagcaatggctgccattgagggtctaacagtggccaggtcccagcggcagatgaaaggcgttccacccagatgtcagggaagaaccctggagtagaacacatctcagcacacctccagtgagtgagcagaagctgcagtccctgtcccgggctttgcagagtggggagaaggtgaggtgggctcagggtccctaatcaaagcccagcccatgtgcaagaaacgggaaagaacctgccttgtgacatcaaaggctgacatcaaaggctgcagggtcgaccacactgaagacccccactctgctctcttgtgggtcactgcagctgcctggaattaggggtgtctcaccacacctagctccccctccagaatgagcaatcactgggagagggtacacagtacactgtgctcacctgcctgactttttttttttttttttgagatggagtctcgctct

SEQ ID NO: 118087 - DNA, 690 bp, Homo sapiens
agcaggggaacagtgcggtcagccacaggcaggatctgcaaaacaagaacaacaggaataacagaccatcaaatcaataagggccttagcgacactcatcttgaacctctcaatgtaaagagggggaatttgaaacccggagagggagagggaccctgtctcaagtgcggtggtgagacagcagagagctgaaccagaatccagtgtgacatcaataccaggacccaggagttccactgcccacttcaggaacctctaccataagcaccctgcattcctatctactttgcaagcttggacccactggctgcattcacacaagcccttttttcccttcttccttcctgctccctacctctgtcccagtggacacttggcagcccctcagaggcccactgggggtcaggagggaatgttgaacatctggccagagcccaggccagccctgtgggttcacaatagggaacctgctaatgtgcaggaccctagagcagcggccctgtgattggctggcaaggccaggcatcaggccatcccagcacccggggcctcgtgaccccaaatcccagctattaatagatgagaacccttcagcaacccctgcccctacccagcctcccctccctcttggctgaaaataaaagggctccttgaaatggtacagaggcccagatatccagctcagctgct

SEQ ID NO: 118088 - DNA, 544 bp, Homo sapiens
tcattatgtgaacaaactaataaataatttccaaattatcttgtatcccataaaaatataatgagggaattattttacttttaagtacattccttgtagtcttctaaatttgctttgaaatagaaaaacacaccttatttttgttaaatgtataaaatatcaaatgactgataatattgttgaattggttaaattttaaaatattcatgaataataataattcttcaggcaaggaatatctctgaaagaatatacgttttaaagatgggtttttcagaaagaatagctaatggatgctgggcttaacacctaggtgatgtgatgatctgtgtaacaaactgctatggtacatgtttacctatttaactaacctgcacatcctgcacatgtacccctgaactaaaaataaaagttggaaaaacaaaaaaagaaaagaaaaaaattctttttttttgtttaagtataatgcatactgattgtagctagtgtagttaaaaattctgcatctggaaatataaacaacaaaattatcccaagtcttttg

SEQ ID NO: 118089 - DNA, 586 bp, Homo sapiens
ataaggaggttttttaagggcagaatgatatattcacttcactatttttggaaaatgattccgaggatagtgtgaaggatggattaggagatgaagctggaaataggaccatcagctaggaagctcatgtgctgtcagtgaaagataatgaaggcctcattaagacaggtgctgaggaagtaacagggcattctgaggggccattgaccactcacagggagaagaattcataattgtctatgaagaataggggaaaattaaggatgggatcaaagaagaactgacggctctagccatggtgacttgggagatgataggttctgggttccctggagaaactggagcttctggaaagtctcatgctttcatttcatgaccgtgcccagctacaatgcatgagtagtattttccaactcctctcaatattacaaggcataatttttttattgtcaagccacagatctgtttgataaaagtaaaccattcaaaagaaagattaggccaggcacggtggtttacacctgtaatcccagaactttaagaggctgaggtgggaggatcacttgagaccagaagttcaagacta

SEQ ID NO: 118090 - DNA, 151 bp, Homo sapiens
gaattttaaacagatacatcttaaaggttagagattaataaaaataattttttacttctttgttacagacacttaaaaaatgatgatgaagcatataatgactatcgttatagttacggatcctggccttttttttttttttccttttttt

SEQ ID NO: 118091 - DNA, 426 bp, Homo sapiens
acagggaaaatgatgccaggccccattttccccagtctgccacagagcctgaggtcaaaaacaaaaagaaaccaattatctgagcccaccaaaagtgcatgtcacatgaagtcattatggaaaagagcacaggcagaggctctatgacccagtaaattcaaagcagggctcgagatggctcactcctcaaagaacacatgacagcaaacagacaaacatttacccggggcaaaaggcccatctgtgctcctagacccatgccctataaggagatcccccaccttcttcttgccatcagaaccagatataccacctgatgggtgcactttacaccacagcatgaggggaagagtggcctgaagcccaaagaactggcatggaccacactcctccccagccacaccaaaaaggtaccatctcctgaca

SEQ ID NO: 118092 - DNA, 609 bp, Homo sapiens
taagggaagtaatagagaaagaaaaatattcctggaggtaaatcttcagtttggattaatgtgaacatgaagaaacctgtagaaaccttcatttctcaagacaaagctcaaattcaaggttgtgaggaatgcagtcactgcttttgttaggggcagttgtgacagtgattgcagaaactgagactgcaaagcccgtattatataaagaatgtgcaagtgccatagaagacactgcaaggattgggtgctggagcagtgctggacctgccatcatcaccagagtgcagcagagagaatctcctctcttgccatcactaacccagcacttgactttgtcccactcctaaaagatcttggaaggaattaaaggtgcttggtggtttctcattccagcataaccttacttggcctgaccatgaaccatgcattagtctttggacagggcaattcaaatcacagaccacataacaaaagaattttgtggccatcagaactgtctccttaaacacaccatgggtgcactgtgtcctcagcttggtgaaaggtagatgtcacacacgagaaggtggtggagccaggcatgtgatggagcctcgaagagtgggaggt

SEQ ID NO: 118093 - DNA, 425 bp, Homo sapiens
gtggtctggatacatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcc

SEQ ID NO: 118094 - DNA, 725 bp, Homo sapiens
agcggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaa

SEQ ID NO: 118095 - DNA, 474 bp, Homo sapiens
ggcgcctgccaccacgcccagctaatttttttttatttttagtagagacggggtttcactgtgttagccaggatggtctcgatctcctgacctcgtgatccacccgcctcggcctcccaaagtgctgggattacaggcgtgagccactgcgcccggccatgtgttttcatttcacttaggtaactatccaggaatggaattaatggatcctgtggtcagtgtgtttgtagaaggaactaccaacagttattagcacatatgagaggtttttttgtttgttttgttttctttttgagacggattctccctctgttgcccaggctgcagttcagtggcgcgatctgggctcactgcaaccttcgcctcctgggttcaagtgattctcctccctcagcatcccaagtagctgggactacaggcacgtgccaccacacccagctaatttttgcatttttagtagaggcagggtttcat

SEQ ID NO: 118096 - DNA, 493 bp, Homo sapiens
ctttataggacacacattgacattataggatcttcttctgacacttacctgtttaaaaaaggggtcatgaaattaatagggcaaaaggttagttaataaaatctcagcaatatagtcataagggctgctttctcttgctgagcagtgaccattgccatgaatgaggctagctttacacaccgtatctcatgaatccttatagtcatccttctttgtcagtgttgactatcctcatgttacagcggaagaaactaggatttggagaagttaaaacacttttctgaagttatccagttgacaaagaatgaggctgtggcttagcccagtctatctgattacacagataatatctaaggaataaaactttgaaaaaaactcaccaaacttttttttttttttttttgagatggagtctcgctctgttgtccaggctggagtgcagtggcgtgatctcggctcactgcaacgtccacctcctgggttcacaccattc

SEQ ID NO: 118097 - DNA, 232 bp, Homo sapiens
taatttttttgtatttttagtagagatggggtttcaccgtgttagccaggatggtctcgatctcttgacctcgtgatctgcttgccttggcctcccaaagtgctgggattaacaggtgcgagccaccgtgcccggctgtcactttgctttttaatgaaaaaagctggtgtccaaataaaccatccgcagggagactattctcccagataaaagcgtcctagagacctcccgc

SEQ ID NO: 118098 - DNA, 402 bp, Homo sapiens
accatcttaccacacaggctgcttttagtttcttgagttatccatcttccttctatcttatagggctcaacctaaatattactcagggaagccttccttgagagtctttctttttgcactcattggtttggggcttctttatattatactgttaattgaattctgagtcgtgtttatctcaactgagattaggtaatttattttgagaacagtaaatgtttatcatctgtcattctttttttcatgcccacattcagttatttgtaagtgctgaatgtataagtgttcatctacagataaggatcagttcttttttccccaactagaaatgttactccagttgataataacagctcaaacggaaatataaggcagaggtgagagagtcacttgaggccacga

SEQ ID NO: 118099 - DNA, 320 bp, Homo sapiens
tgcttatgttatgcatcaaaaacttggctagaatattctggaaaaagttcccttggatttttttttctttaatattaaaacagatttgaatttctaatacatattatttcgagttaggccagagttactttaaaatggcaattgaataaattgcagtttttaattctaaattaagtgccccagaaagagattaaagtagggtgggggaaaataaggtttggtggtgaagtggaggttgcaggcagctagcttgatgttaggtacaagactgtctacaagacagatttaagaatggttttgatggcacgtgagcatatgct

SEQ ID NO: 118100 - DNA, 809 bp, Homo sapiens
aaccaaactttttttaagtttatctaattttttagttctttgcttttttgatatattttatatgtaagtatgtatttatctgttgtatagattttcattccctctgcctgcttttcttagactgtttctgtcttccttgaagatatggaagaaatattcatagattaaatgtactgacacataagccttctcatatgtgattactatatttgttgacctgttcccgcacccccgcattgtttaaatgataaacttctaagtcctcttcttcctcaaatggctatgaggtttgctattttgtgtgtgtgtgtgaattttgcattatttttgcttacttcaaaactgtaactttcagaatatacataatgtgattgtatcttttggtctataactggattttaaatttatatttcaacctacaacagtgccacaatattttcattactgtaatattaaacagttgacatgtcagactcataattaataagtattataaacaacttgcctgcttattaactgatatttattctcctaaaaaattcggtatttctaacaaaattaaaactttcttttacatcacaaattgtaatttttaaaaactcatagattatttttggaaaaattaacacttttgtaacatatttcctaaaaacaaaacattttacatctgaccgtatattcaagtattaatatatgtccctcattaatcttttgaaaatttaatatacattttgtataataattgttaattgtatatcttgatactttatgtatcccccgccccccgccctgaacacttagtaagtttt

SEQ ID NO: 118101 - DNA, 936 bp, Homo sapiens
attgccttctgactgcttctagctaaagaggggcaatgttggccgggcgtggtggctcacgcctgtaatcccagcactttgggaggctgaggtgggcagatcacgagacaagcctgctatccttgttcctgttgcggtgggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaagcctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaac

SEQ ID NO: 118102 - DNA, 150 bp, Homo sapiens
gcctgagccctgtctattactctcatcgccacctccctgacaagcgcctatagcactcgaataattcttctcaccctaacaggtcagcctcgcttcccagccctcactaacattaacgaaaacaaccccaccctactaaaccccattaaa

SEQ ID NO: 118103 - DNA, 429 bp, Homo sapiens
gcttaaaatgctccaatgcttcccattttgactcaattcaagtcttatatgattgggctcctgactacttcaccaacttcacctctacccacattgccactcactgatgtgactgctgtactggtcttactgtctctagtacattgtcaagctgtggtcaactcaagtacccttgcattggctattccttttgcctaaaatactctccccttggatctttatatgtctttgacttttttcattattcatatttgagctcaaatgtcacttcttcagaaagatcactttaatagtgaagaagccagttctctatcacacaaccctgctttatgttttcacagtactttccacaatctgaagttactatatttatctttgttttcattagctttttgcctgcttctcctcacccagaatgtgtgtttcatg

SEQ ID NO: 118104 - DNA, 295 bp, Homo sapiens
aacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatac

SEQ ID NO: 118105 - DNA, 478 bp, Homo sapiens
atgtggttcctgctacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttcaagaagcaggaactggccagttcctgcttcttgaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggaatggaggaactggtttcaagaagc

SEQ ID NO: 118106 - DNA, 361 bp, Homo sapiens
ggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttat

SEQ ID NO: 118107 - DNA, 264 bp, Homo sapiens
tttttgccggaccttcctctcctcccacctcacaattagcaaggaaaaaaggaaaaagacaaaaatgatacactcatcatctctccacgcagaagcaagcacgctaatatactgatcattctcccaaactttcccctgtggggatcttttctcccctaagcaattaagatcaaactagtaacaacaatctcattaaaatgctcttccttgactgggcctggtggctcacacttgtaatcccaagacttggggaggctgaggtag

SEQ ID NO: 118108 - DNA, 236 bp, Homo sapiens
gaatatttgacaatgaacatatttccataaatcccagtactgttagatatgcttgcaatggattcacatgcagagcatgttctgctaatgatttaaactcttttgtaagaaggtgagtttccttggatgatcaaccaccccactgtgttccttgtatgttctatatccagggaccaaatagagtcatgcatgaaaaatactctcaaggtcaggttctctccctgcaaacgtgtatt

SEQ ID NO: 118109 - DNA, 241 bp, Homo sapiens
gagacggagtctcactctgttgcccaggctggagtgcagtgatgcaatctcagctcactgcaagctccgccctccaggttcacgccattctcctgcctcagccttgatctatgtagagtccttttatcagagtgctatagacatcttcaacctcagtttacatagtgttttgaaaactaactaggggaatgaggaggtggtagtcggtgaataatgaaggaacaaaccaattcatgtagca

SEQ ID NO: 118110 - DNA, 343 bp, Homo sapiens
acctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaat

SEQ ID NO: 118111 - DNA, 224 bp, Homo sapiens
atactgtgcagcagttaaaaagaatcaggagatggaaccatgtcttcagtatattgaaaaatgaaaaaaatgagtgacatgatcccaacttaatataaaagtacttacatttacatatgtttgtctgcataagcagagaaaagaatttgatggttgtcaactgggtggggtagggatgatctgagatgggggtggtctcaaatggggacatactgacaatgaac

SEQ ID NO: 118112 - DNA, 474 bp, Homo sapiens
cctcagccttcgcgtgagtcactttgtggctgtgcccggtgctgacgtgcacgtggccgcgctctgcccgcctcctgtctgcactgctcgccccctttgggccctggcctcattggtctccctgcactcacagttggttgcttttcgtgactgattttgggttgggaaatcagataagtaactgttcattcgtagcccctcctgaacactcctgggaattaacaaccctgaccttaatacttggcctctccccagccactgccttcagggcagctgatgtcccccagtgggttttgccagacccaaagtgatgatcgcatatctgtccctcaagtaagaggcgggcttctccccagcagtggcgatgtcaccagaagctgccctgcgtcaccagagttggcttaatgcgaaatgtttccccgtcaggtgcctttttccagcaaggggctccaggtgctatccaggaagtcagag

SEQ ID NO: 118113 - DNA, 430 bp, Homo sapiens
ttcttggggcctctcatgagtagtcttccagggactacaaggagtctacaagcagacatgcaggatgtagagaagcaaaccagagaagacctgaggtcaagaagacagatgttgcctgcacagtgggtgaaaggaaactgctcaggttgtgacatattataatctcctcagagcccaggccttgacagatttatagtaaaagtgcaagaggaggctctaactggactaaagggattgcctccagccctggtcctatgaagtaggctccagacatgcggagcagtggatgaaaactagagttgacccaacagggagggagaattgtaagccagtaggagccatgagagtgccgtcgatttcctagagctctgcatgaaggagctgcgcagagtatgcccacttcttgctagggtcaccaacttgctcagat

SEQ ID NO: 118114 - DNA, 512 bp, Homo sapiens
atcttctgaggtcaggagtttgagaccagcctggccaacatggtgagacccgtctctactaaatatacaaaaattagccaggcatggtagtgcgtgcctgtaatcccagctatttgggaggctgaggcaggagaatggcttgaacccaggaggcagaggtttgcagtgagcagagatcatgtgagactctgtctgaaaaaaaataataataatgtggatagagatcattaataaagaaatagcagagttaaatggcaaagaaaaggtagtggaatggcaaagtgccacatgttccttccaccttgcatatataaatgaataaaattaacacatcatttaaatctgctttgtacattgaaaatcagtgtactgataaaatagtagaaaatgtaagccacatgcatctttttcctttcagcttgatgtgactgtgccttgttactctgagatacagattagagcttcatttgtaagacctgaaattatatttagagattattttttctgagtta

SEQ ID NO: 118115 - DNA, 421 bp, Homo sapiens
taaccgattccctctccctctatagactgtaagctccatgagagcaggcggcctgtccattttgctcaccactgtgtccatggcatatagtacgtgctcagtaagcgtttggtacacacatgtttgcaaggcaggaaagctggtagaacatctcagccttcagaccccatgtcctccactctacctggacaagccaaagccccctcacatctgcagagagctcagcctgggaggcagggtactgggtgcaggttcagctcagtcagggggctctggacagtctgctcccatccagaaaatgagggcgtggggttcaatggtcccagtggctcttttggtcctgactaacaggctccaaccccagactagaagccaatgggtggaccccaaaccccatgttttggggtaaactgtgcctcct

SEQ ID NO: 118116 - DNA, 576 bp, Homo sapiens
ctactaaaattacaaaattaactgggtgtggtggcatgcacctgtagtcccagctactcgggaggctgaggcaggagaatcacttgaacttggaaggaggaggttgcagtgagccgggattgcaccactgcactccggtctgggcaacagaacgaaactctgtctcaaaaaacataaaaagaaagtagttggctcttcttgccctggaagagtgtctgtatccaagcccagcacagccagtttcctcctttgagctgtgtgtggtggagctcccaaactcctcccacttccaggtgctttccttgccctctgtgttggtgatcttctcttcatgtacgtgtccagagctgaactccctgttttcgatggcctctggccaacatagaacacaccggggtgctgctcccctagaagtgttttaattgagataaaatgcctatagagagataggcacacatcttgaaagtacaatttcacaggttttatgacatgtctgcccttgaactcaacatttcaatcaaggtacagacatttcctctcgtgttaagtcatacaaaaaaaatttaacaaaaaaaa

SEQ ID NO: 118117 - DNA, 252 bp, Homo sapiens
aggctatggatatagaaacatgaaacaagttcttgccttcctgttgcttatagatttgggaaaagagagatggttaataaaaggtgaggatttggtttttagaaagcaattaagatctttgaaggaaatgaaataacaaccaacctgtgagattaatagggaagctatggttgtgttggataccttagctttggagggtagggacctccaatattgtcattgatcatttatttccattatctaacatatctt

SEQ ID NO: 118118 - DNA, 541 bp, Homo sapiens
tttttttggagttattgattttaaagcttttttcttttccttttccttttttttaacctgcttcacttttttttctccttcttttaatcactatcattctcaaaatgtttgtttaaaatggaagtgtatatgtagctattgccttatatttagtgctcatccacattaaggtctaaagtagtatactttgaacttgaggtataagtttaggctaattgtatggaatgtgagactattttgaaaggggggcagtaactttactgttggaatcagctgagtgatcccaaagtacaattttaaaattgtttagtaacagaacagattctttctagaccagaaataaatgctattactggcatcccaagacaaccactaacccaatttaaatgaagggaattcatttcttactgacctccatttaaaatgttgacccattatcccaaatgccagttttactggtatgaatgatatataatcaaaaggtcacccatcttatttcacttataaaggttactagatacaatagaaatagaaaatattt

SEQ ID NO: 118119 - DNA, 250 bp, Homo sapiens
agccgggaggcgggcgttgtgcgcggccgcgggcggagcggaggggcgcgaggggcggagcggagcgcgggaggaggcgggggaggagaggccaccgggaccgcgagcggcagctggggagggggccgcggagcccgagcgggagcaaaacagctgatctggttttcctttaaagcgagagaaaatggaagtcgggtagcggcgactgcggcgctgcgggctggcggagcggagcggcgcggcgcggcag

SEQ ID NO: 118120 - DNA, 509 bp, Homo sapiens
tccgcctcggcctcccaaaatactggggttataggcatgaaccactatgccaggccaagatctagtgactttggatacggaccaccacggaacagttcctcttccatgtgggtgtgggggcatgaagggctgttttcaggaggatcaaagtcacctctaccccagcatgggaagtcccagaaacttgagttccaggtaaggtagtgcagaaaaaagcaggctcatgagccagtgctgtctctctctgtgcaagggggaaagagcccctctgaggcctccacacacagtcagcaggacacaggacacagaggtcagcctgttgtggccactgtgaaatgtcccgttggagttgacaggagcctgctctgacctcagtcctcctcctccaaacaggtgaccctgtaatgctctggttaaaaagcaagccagctggactgtgttatcttttagtgtgggaaaaatgctcttaggccgggcgtggtggctcacacctgtaatcccagtacttt

SEQ ID NO: 118121 - DNA, 558 bp, Homo sapiens
aaggatatatgagttgttttaaaatgttggctgttataaagctgctataaacaattatgtgcaggtttttgtgcagacataagtcttcagttctttgggataaatgcctaggagtacaattgccagatcatgtggtagttttattaagaaactgaaaaacttttccagagtagctgtaccattttacattccctccagcaatgtgtgaatgatctagtttctctgcatcctcaccagcatttgatattgtcactattttttattttagccactcttttaagtgtgtggtgatagctcattgtggttttaacttgcgttgtttaacatcattagctaatgatgctaaacattgtttcatgtatttgtcatgtgtatattcagtgaaatgtctacatcttttgatttttttttttttttttaatttgtgacgagtcttgctctgtcacccaggctgaagtgcagtgtcatgatctcggctcactgcaacctccacctcccgggtttaagtgattcttccgccttagccacccgagtagctaggattacaggtacccacca

SEQ ID NO: 118122 - DNA, 740 bp, Homo sapiens
tagtagagacagagttttaccaagtgatccgcccatcttagcctctcaaagtgctgggattacaggcgtgagccaccgtgcccagccaagttgtttatttaaaatgtgatttcaggcccaactccagacctgccgagtcagggcctgggactctgcctggggtagttttatttatttatttcaaaaatatcatttaattgtaagaaatagagatgggggtctcactgtgttgaccaggctggtctcaaactcctggccttgagcagtcttcccatcttggcctcccaagatgggaattaacacgggatcacaggcatgatccaccacgtctggcctgccctgggtaatgtaaagcctgcggtcggtcacacagacctggtcctgttccagaccagtgaccgtaggtgaacgccgaacctctctgagcctcagtggcctcatgtgagagtctctcctttgttggttgttgaggggattaggtgagataccattcagcgccttgccaaaacaggcccctctaacaggctgttgttaagtactaagcccttcatcagcatagggaggaaagcttcttaaaaatacaaaactgtagaattttgaacttggaatggaatgtggagatctcgtacaggggttttaatcttggtctgcaaaagccctgcgatgtaggctgaaggtgtgtgagcagagggtcgccagagcccctcatggtgtgaaactcaagaaaggtgcaggagatg

SEQ ID NO: 118123 - DNA, 381 bp, Homo sapiens
ccagacaagacacttccgtccaggtgctgggcagagccccactgccaccccctgcagcatcctcagcatcttgcagacccccgagcagctgccagcagagctcagttcttcctcctcgccagccttcccctcctccctggggctccctccagaaggaggcagggagggagggtaggaaggcgcaggtggaggaagatgaggaagggactccggcagccagctcctccccggcaccacaaggaggaaaggggaaagaggagcagacgctgggcagcaccttgacctctgagagggttcctgttaaaaaagaaggcggtgaaccatcattctgagcaaactgtcgcaaggacagaaaaccaaacaccgcacgttctcactcat

SEQ ID NO: 118124 - DNA, 407 bp, Homo sapiens
gcacgaggatatttgttgtggcattatttataaagcaaaggattaggggaaaacctcaaaatccatcaatagactgaatctgacagaagagaaacccagaaaaaagttgatgtgtgccttggaactctcaaagagccagccgggcgcagtagtccacacctgtaatcccagaattttggaaggctgggtggatcacctgaggtcgggagtttgagaccagcctggccaacatagtgaaacccctctactaaaaataaaaaaattagccaggcgtcgtggcacacccctgtaatcctggctactcaggagtctgaaacaggaaaatcgcttgaaccggggagatagaagttgcagtgagatcatgccactgccctccagtctgggtgacagagtgagactccgtcaca

SEQ ID NO: 118125 - DNA, 785 bp, Homo sapiens
gggaaaaacgatctgggaagtaaagaaagaatcaaggagcaaagatttagcaagcctgtggaccctgacaactccaataagagaacactagggaattttgtgatttaaaatatattattgcttaaaactacagtagtgttcaaggaaactttaaatagaaaattactcttcttgagatgattctgtcttccaaagagaacaaatcacaaggatgttaaaaggaacattttatgtgacaagtttggggtaggtactatgtaaatagaagagaaagtcactcaaggtacatttgaatgtagggcagagattattccatagcattccacaggccagaaacagaaagtgtcttctagttttcttgccctttatagtaataggggtcatgggatagaaattctcagaaaatctccaaatctcatttttgccaattgtttcaacatcttttccttcccagcattttagcagagctgccaaacaggtgattaattaaatacatatgtgcatgcttgtacctcgtgtagaaggtctaatgagtaaatttatttgatatgacatagactgaacagtagaaggaaggattaatgacagtcagatcaacaaacaaaagtacaaatggtatctgggctatgaaaagataaagcaatatttgcccaaacaagaagatctagatatccctaaattacctcctatattattaggaagtaaagaccaaatctacaactttgatctggaaattgtatagtagctgatatgaacagggatcataggagagtgtggtctcatag

SEQ ID NO: 118126 - DNA, 510 bp, Homo sapiens
gactgagaagaacagtcagagagccattgaaacaggcccaggaggggggcatgtccttcccttcaccctgcactgcaacccagagccatggtggcagggccagattaaggctttagaggccctagaagaggaacagaatgtgatgctcccgtctgtatgtaatgcaaaagaaaaacaacaataagccattgaaggccaggtgcggtggctcacgcctgtaatcccagcactttgggtggccgaggtgggtggatcacctgaggtcaggagttcgagaccagcctggccaacatggtgaaaccctgtctctactaaaaatacaaaaattagctgggcccagtggcacacacctgtcatcccagccactcgggaggctgaggcaggagaatcacttgaacccgggaggcagaggttgtagtgagccgagatcgcaacactgcactccagcctaggcaacagagccagactcggtctcaaaataaaataaaaataaaaaataaaaaaaagcca

SEQ ID NO: 118127 - DNA, 367 bp, Homo sapiens
ccccaggttctcacgctagtgcctactcggcagtgttggcccagtggcagcctgcacacgtgtgcacccacacacaccctggcatgttctcaccctgcccattttcatgccactcccaggggcatgtgaatacccgctggtgcccacacctctatccgaaccatgggcccttgcactctcacctgaacagacagacacacacacgcatatattctccaacagccattcagccatccactgagtcatgccccagggcaccaatcagtcccactgatgcctatacccacagcagccatgatgtcatcatgagcagtcacactcccagcccaggtacctacagcctcacacattaaaaagtctcactgtc

SEQ ID NO: 118128 - DNA, 347 bp, Homo sapiens
gtctgacttagaaggagagacagcagaggcttcttccttggaatagagaaagctaaaggtcctaaaagtctaggtggacaggtaagttttaggatcaaatgtgatgaaactggaacttctctgtgggctgcccatccctgaggaagcccaatcctgttatccatacctcccaagccccagagaactccacaactgtaaacatccttgaaaaggataaagactcctaataatcagacaggatggtcacaatgggcatcatttattcagtgtctactgagaggtactgaatgtggcactttgtattcacagtgtcgtttaattctcattacagaattaaatctagaaat

SEQ ID NO: 118129 - DNA, 376 bp, Homo sapiens
taagacagagtcttgctctgtcgcccaggctggagtgcagtggcccgatctcggctcactgcaagctccgcctcccgggttcacgccattctcctgcctcagttggttgttcttccaggctcctttcctatgtccttctcttctactggactcctcaaacttgcagggccttggagctcagtcccaggccagtctcttgcttcaaataccatctatacgccaggcacagtggctcatgcctggaatcccagcactttgggaggtcaaggtgggcagatcacctgaagtcaggagttcaagatcagcctcaccaacatggggaaaccccaactctactaaacataaaaaattagctgggcatggtggtgcatgtctg

SEQ ID NO: 118130 - DNA, 489 bp, Homo sapiens
acggctgcttctttgtcacatggtactccacctccacctccatgcaacattagttgcaactgatcattcctctttctgcttaattttagaaaaacatttgttcagatttcagattttgtccttcccaatgctgaaaattacactccagcctttcaatcactttcttagcttagctactgtgataccacaccctgatagttttccttttgcctcagttggttgttcttccaggctcctttcctatgtccttctcttctactggactcctcaaacttgcagggccttggagctcagtcccaggccagtctcttgcttcaaataccatctatacgccaggcacagtggctcatgcctggaatcccagcactttgggaggtcaaggtgggcagatcacctgaagtcaggagttcaagatcagcctcaccaacatggggaaaccccaactctactaaacataaaaaattagctgggcatggtggtgcatgtctg

SEQ ID NO: 118131 - DNA, 514 bp, Homo sapiens
tgtaatatgcttccccctgaacagatctctccctcccccctctccacccccaaaatgcttaaaagggccctggggctgtggaagacctggcatccaaggcatgccatgggggagtttcacccggatggagactggctctccccgcatcctgcccagcagtgcaactgaacctgagatggggctgcaggatgacaccagcacttcaggaaccgcgttgcaggtgtcacaccttggattcaccatagctggctgaaactagcagcagcagtgactcccgactatgaccagtggattaaccaacaagaccctgattgccccacccgaatagacctacggcgaatcccaaccaccagtaagaaggacaactgccctgctctgaccacactggaggctggtcagtctacacatggctgaagcttgaagatcttgcaagctctgctctagtcacatcctggaagctgactagtctacacacagccgaagctaagaggaccatctctagataagtaaatgt

SEQ ID NO: 118132 - DNA, 665 bp, Homo sapiens
cagcgttaagacgactgcctaactttggccacatgcgttgttttttgggttccgtttcgtatcagggcatgctggctaaaagatgggagccagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagc

SEQ ID NO: 118133 - DNA, 398 bp, Homo sapiens
catactggaccttcttcaacattaacccgagcgctaccaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagc

SEQ ID NO: 118134 - DNA, 581 bp, Homo sapiens
acagtctttttctctaagaagcccaagggtgcatgatgaataaaatgtaaatttgagaaggcagtgtttttattagtgaaaagggcaatgagccatgtagttggagcagtgacctgcatggtggccaacgctggtgcaggaagcaggagcaggcactacagagtctagttattttacagcacaagaaaaaacaggcacggaaagtttcactggtctcccagcagatattcacagaagtgtacattgtcttgtgtatgttagaactaaggtcaaatctttgatacgtttcagaaattgacaagtctcaaaagtcttgaagattttatgcaaataaatgacaatgcacgttttttacattttatagcagtattgaatattctcggagtaatggagcatttgtttttattaaaattaaaaattgctaaatagtttgcaacagacttggtatatttgtatttgcatagcaacaatttatgtttatacatacatatatattttttaactacctggaagggatttagatacatttgtttgctgacattttgagctcttgaaatttatttgctcatttgcccttggtg

SEQ ID NO: 118135 - DNA, 532 bp, Homo sapiens
gccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagggaggtatgcttgcaggagaaaagtatcaagacg

SEQ ID NO: 118136 - DNA, 611 bp, Homo sapiens
agcggggttcggtggcgcgagaggcggggagtcgccgtggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagaagtccctggaaggtctccagtggaggaccgccagtcagaaagccaggcagacacggggcccatgaattcatccttacctgacgggcctgtcttgctggccggtcacaaccatggggtctatcacggtggcagccacagtgcccgggccaaaggcgacaaggcctgggtgcagcaagcaccgtggaccccagtggaaagcacaggctcgtccaagggaccccaacgaaccaagcgcgatggccgggtcctggtcaagaacccgagga

SEQ ID NO: 118137 - DNA, 804 bp, Homo sapiens
gaacatcatgggtagaaactggaaagctactctcttcatcagtagaatgctaactcgtcatgtagtgccactaaatgtaatattaaattaacttcttagaaaacctcttaatttttttgttagaacagagcttagttactgttgggggaaaggcttatggggtgcctgtataaactggccataaaaatatgggacaataaattgtgcaaagccacaagaggcctcttgtgggaggaggaaagccttatcaccattatgttcccatgctctcagcaagacttgctctcttatccataaacactgtgttcaaggagaaagacactcctttgaagcactggaatgtggccagacatgcaggctcctagttaagctcgctcccaccagctactctccgataagttaaagatatgctgtctaagcacaaaggagattcatttaaactgccactgctgtagattacgtgtatgacgcactgccttcctttcagcactgcctgcctttcaccgtttcgtcctgaatgtctgcttcttagatctaagtgattgtactcagtaaatagtgtggagaccagaactctgagccttttgcagcctccattttgcaattggccccctggcccccactctttatgcactcttaacctctctcttctcattccttcgtcgccaccagactttgggtaccctacgggtggtgttgaggctggtccccaacagttaccacccttagttggttctacatgtctgtaccttcaggcagttccactctcaggaaacgagagtaatagataattgagcagatttc

SEQ ID NO: 118138 - DNA, 455 bp, Homo sapiens
agcacgagaattgctttaacccgggaggtggaggttgcagtgactgagatcgggccactgcactccagcctgggcaacagagagagactccatctcaaaaaaaaaaaaaagaaagtggggtcagtgagcagccctagctgaaactaaatcagaaaaaactgcattgaaataacaacaaaacatttcgctttgaaaataattttaggcttagagaaaagttgcaaacattatagtaaaaaatcccgtagagcctttaccagacgcaccaagtgttcacacagtctttcctttgttctctccccaccttctttgttacttttctgaactgtttttgaaagtaaactacaggctgggcatggtggctcatgcctgtaatcccaggactttgggaggctgaggccgacggatcacttgaggtcaggacttcgagaccagcctggcccgcatgataaaac

SEQ ID NO: 118139 - DNA, 587 bp, Homo sapiens
tctctcagtcattacttgactttcatgaatcagaatataccacagcaaactgaatccctatgaaaccagtacaggactaacctgctttcttgttcttaccggaaaaggcaggggacacactcaccctccctttgggctccacgttcggatagtgtcttccccagctgcaccaccttattaaatcttaggttcaggtcagacagggagggagactcccagcctgcctgctgtctctcaatttcggttcttgagcagctgcctcccaaggtgttacaaatccagcagccacttgttcctgctcattcattctcgttcctctccaccccccacacaaaatctggcaaccaggcaggaacacagttccagctctgagtcactgccccactgtggccaaggggagcagtggctagaggtaatcaaccaggcaagcacttcatgtctctagaatccaattcttccgttctttgagaccgtggggttggctgcccttctagaatcaggacataaagaaacacccctatctacagctctggagtcagaacaaattgctcattcaggtttgccctacagacaaggtagagccgaaa

SEQ ID NO: 118140 - DNA, 383 bp, Homo sapiens
cctattttaaattaggtttgtcttttattattgagatttggaatttttaaaatatcaacacaagttatttgccagatatatgtatttttaatatatttctctatatgtcttatccccattttcttaatgatgtctttcataaatagaattttcatttttataaaattcaatttataattttttatggtttctctttattaatcccatttaagaaatctttgtgccatgattatgaagatgcactctaatgttttttcccagaagctctgtaggtttagcttttacctttctgggtttgttttgttttgttttttgagatggagtcccactcgtgtcacccaggctggagtacaatggtgcaatctcggttcactgcaacctcc

SEQ ID NO: 118141 - DNA, 216 bp, Homo sapiens
gatggttgtagaatgctgattttcaactccagtaccccctttacatttatcacctggccctaagcattctattgtaagcaaattgcctcccttctttcttatttgtctgtatagactcattaattccaattttttaaaatgacttataattcattactgtactcattgtcccagatttggccagtagaagccccttcaagatgactccttcaaggt

SEQ ID NO: 118142 - DNA, 341 bp, Homo sapiens
cctctccctcccccgggtcactcttttgcattgtgttgggggctggtgctactgtggtgctctttatgtcgatggttactgcttttccaccacggccgttgggtagcagatgctcagtggcagcccctctgagggactcacatgggtatcttgtagtaggccctttagaaagaagcctctggccagacacggtggctcacgcctgtaatcccagcactttgggaggccgaggcgggtggatcacctgaagtcaggagttcgaggccagcctggccaacatggtgaaacactgtctctactaaaaatacaaaaattagctgggtatgatggtgggtgcccgt

SEQ ID NO: 118143 - DNA, 144 bp, Homo sapiens
agcagaccaggtggtacggtggtgggcctccctctttggaattggatgttagcactgtctgtcattctagggactgagaagtcaacctgggaatgataagaagctagggaaaacttttctcctccgtatgggagaccttgatct

SEQ ID NO: 118144 - DNA, 738 bp, Homo sapiens
ccccagccagcaccaacttgtgagcccatgtttggaagtacagttaaaccttcagatggctaccgcccaaggtgatgtatgactaccactacttgagagacacgatgctgaacgcttccaaattccagaccaagggaactatgaaaaataagtgttgtttcaagccactaaattttgaagcaatatgttacatagtattaggtaactaaaataattataagccacaatcacaaatcaatattatctataattatatgtacatactgtatgtatcttcatcaaatacaaataaaattaggtatttgattttcatcttaatttttaaataacttctattttgtgcttcataatgtatataaaacagcacaaaaattcatatatctatataagcataggtatcaaaaattttttttaactaatatggataaaggataaaacaattctagaaacaaattactctgctcagataaacaggatttcttggattcccacaagtgaagatccagcattgtctctgaggcagtgatctgaattctgacctcactgcttcctaactgtatggccttgggcaaattaattaacttctctaagcttcagtttccctcatgtgaagatgagaataaaaagagtatcctaataaacagggcttttgggaggattaaatgagataatcaatgtaaaatccttagtacagtgtgtggcatacagcaaggttcaattataatgaagaaaataata

SEQ ID NO: 118145 - DNA, 617 bp, Homo sapiens
ttactatacataatttttttttaaacctcacccataaggggaaggttcccccttttatccatgcaggtattccacccagcagcttacaagccccatttcacaaaatccttaccaaattctgggaatgcataattactgttactagggctcagacctgactgaactaagtcctgattgtttcagacaacaaaaattctatttgatctttccaagaccccgggtatttgcgaattctcacttatcatatagtagtgggaatttacggcttggcagaaacatgtccacacataatgaatctttctccctggggacaaggtccacagagtttccatcagactcctgggagacctatgatcttaaaaagctcaggaacctctgttccagttcaaggccctccaattatagagtggggttcagaggcccaggaaggaatcctggcttgccccagaggacatggtgtgtctgtggcagtgctaagctggttccctcttcatcacccaaagatgccacaggtccaggcatttctggtgatcatgactcacacgctccccatgactttagcctacagaatttcctcagcagtacgtgcatttctcctgccaagctgaggccaggga

SEQ ID NO: 118146 - DNA, 692 bp, Homo sapiens
atcctagtgaccagatatccctgtattctgggtatacagcgacttaaagtgtttggtattttacgcaggaagggtctcctatatagaaagtgactccttaaatagtccttgatttttgtcccctttgcctcctgacagactcaaaattgaagtccaggtttgctcaaatgaacaaatgccttaaggacagaactagcaccccactttcccttagttttgatttcttctattagctcttttgatgctttcaggatacttattttatctagcacgctcggttgtcctcaagcaaaaggaatgctatcaataagccttcctaccacgtattgaaaattaaagtccttcctttttacactttaagaccttctaataagaaatgatggctagattttatatttcttgcgcctattaatatttttcctttatattgttgataaaaccaattatcttgaaagatttcctaatactgaacccatgcaggacgggttcaatattatgttattcttttaatacatcactaggtatattaaaataggttattccaacaggttattcttttttcttttttttaattaaaaaattgttctcataccttcttgctgaaaacagcttattcttttaatacaccactagctatggtttattatttaaaactttttcatctgtattcatgagggaaactagtcaacagc

SEQ ID NO: 118147 - DNA, 313 bp, Homo sapiens
tttttttttttgcctaatactcatttgcaaggtagctttctgccaacagcatctttccaatgctggaaaattggacttctgctttgagcacatttaaaaagagacgttttgtattttctttttgttttatttagatgtgctaaacatacataactgcaaaaaatgggacaatgaaattaggaaacataggtttacttattacttactagaaaacgcccaccccaaggttagttaaggcaggcaatcacttgcccgctatgatctagacttgtgatactcagtttgatagtcaagtgtggagctacttaagtta

SEQ ID NO: 118148 - DNA, 797 bp, Homo sapiens
aagtaaattaaaataaatgcacacaagaaaatatgtgtttttcagagaaatgcaaataaaatgatatatgtcaaaaattaaaatgcatgtatatttaaggggaagacaatggtagtggagacaggaataaattgatgtcaaaataaagagaaggcatttgcttgtgtcagcaataatgctccatttaatgtgataataatgtgatgagtatggatgaactcaactctctgtacttgaggtttcaaataaaaataagaatacctttattaaggggaattctctaaatggggtagttgagagatgtttctgactaggctggtttgaatcagaaatgctgtttccataaaggggcagacttgatgcatcccaagaattgacttatctaaagtcagataagtaacatctcctacagccagtaacaaccttcttatctggcaaatagatgtaaatatcaacatgattgtcatcctggcaggtattgctgagggccatgcagtttgcatcgttgtacatagatatcaaatgcttgtccaaagtaattttttcagcattctatggggagtaacaccttacatttgtacactttatattattcaaagcactttatttacaatcccctttgattctcctaaagttggctgagtcagatattattatacacttcacagataaagactgtgaaacacagcatagctcagtgattgtcccaatgtcacacaagttagtagatctggtctaaaacccatgtctctggaggaactgttatgtttcttttctctctcctcatgagaatatac

SEQ ID NO: 118149 - DNA, 275 bp, Homo sapiens
aaattccagctccaagtaattttgggctagaggcataatttcccacaacaaacatgggaaacctactttcatatgagagtgactaggctaaagcaaaactaaactggaaaatatacaggaaaggtagagctatttgccaggctactttctagcctccgtatatatctgttatttcttgagtccaaatctagttctccattcttaatctctcccagatgaaatcttcagggacttgcagaaagtgtgcaaatatgcatcctgctcatttttataag

SEQ ID NO: 118150 - DNA, 246 bp, Homo sapiens
caccactcctaatgccacccaaccctgccatgggccttctctttggaacatctacagactgcatctcttttccgccctagtgacctaatgtggatgcaacttgagtttgtgagggaaattctcaaacttgcttgtgatgatcaatctgccatgctgccttttgccaaacagagaattcagtatactataaagaacaaaaactacattaaaagatagccaaactcccaggaatatttattttctttt

SEQ ID NO: 118151 - DNA, 181 bp, Homo sapiens
cagctgctttcgctggagtggtcgggtgggggcaggggtaggtgctgtatccatagggtgcagacagagccaggcatgaaaggtgaagccaggccctggccatcgctgtacagggggtaccatgatgcccgccatgctgggcgtgaggtcaaagtagcgcagagcacgtgcaggaccctgg

SEQ ID NO: 118152 - DNA, 690 bp, Homo sapiens
aagcaattctcctccctcagcttcccaagtagctgggattataggcctgggccaccatgcccagctaattttttttgtatttttagtagaggtggggttttgccacgttggccagcctggtctcgcactcctgacctcaaatgatccacccacctcgacctcccaaagtgctgggattataggcatgagccactgcgcccagccaaaactccccattttaaacatcagatctcatgagacttattcactatcatgagaacagcatgggaaagacctgcccccatgattcaattacctcccaccaggtccctcccacaacacatgggaattcaagatgagatttgggtggggacacagccaaaccatatcatgggtgaatcttgaatacattacgttgagtgaaagtagacagtctcaaaggctacgtactctaaaattacatttgtatgatattctggaaaaggcaaaacttatagtgacagaaaacaaataaatggttgaaaagaggttggagaagagatgaagtacaccaaggagcttccagggatgatagaaatagaaatatcgtgattgtagtggtagttacccaactggggttggctgtcagtgctcatggaattgtactgaaaagggtgacttttgctgaatgcaaattatacccaataagcctgaccttaaaaagcaagctag

SEQ ID NO: 118153 - DNA, 359 bp, Homo sapiens
tccctgaagtatcagtttttgtaaaatctcccaatcaatttcttatcagattatattaaatacctatcatctagagtactccagaagccaaataaatattaaaaacaaaaacaaaaacaaaaaactgagatagggccaggcatagtggctgacagtaatcccagcattttgggaggctgaggtcgaagaataacttgaggccaggagttcacaaccagcctgggctatatatagcaagatgctgtctctctaccaattctaccaatatttttaaaaaaactaggtgtggtggtggcacctgtactcctagttactcaggagactgaggtgggaggactgattgcttgaggccagcagtt

SEQ ID NO: 118154 - DNA, 527 bp, Homo sapiens
ccaagattacacaactatactccagcctggatgacagagacccccatctcaaaaaaaaaaaaaaaaaaaaaaggtatctggcagctggtctgaagataggcatctcaattgttcacggccagttacagattgaactactctttcccccttctcactactgcacttgactagtcttttttttttcccccacaaagaatggggcttcagatagaactgaaaaataaaagtgtctggtggtaggcaatccagagctggcatggtggctctgcaattaacaaggacttatgcttctttttgcttcaccatcctagcgtgcagcttccatcctcatggtcatctcatggtctaatatggcttctagagcttaattcatctcatctacattccagatagcagacagaaggaaggaaagatgattagggggagagagagcagcacagaaggacgctttctagttaactctttaaagggccttcttggaagtccaggacaatacttccaacacttctgtttatgttctcttggcc

SEQ ID NO: 118155 - DNA, 573 bp, Homo sapiens
ataatagtaaccaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatct

SEQ ID NO: 118156 - DNA, 854 bp, Homo sapiens
aaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggca

SEQ ID NO: 118157 - DNA, 490 bp, Homo sapiens
  misc_feature (38)..(38): n is a, c, g, or t
gcctactactactactactactaaagacgcggccggtncgacaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggca

SEQ ID NO: 118158 - DNA, 474 bp, Homo sapiens
aaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacag

SEQ ID NO: 118159 - DNA, 399 bp, Homo sapiens
ggtcgtcgcgcatgcgcgggggtgggcaaggcagtggtcagcgacccgcagtccatctgactcctgcttcccgggtgttgctcgtgacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcaggtaagcaagctgtccctctccacctctgcttcctggcactgtcagccaccctccacctcagcaggctttgctctctgagaataaccagcagtaccaggacaggagttgggcctgcaggcaggaccctttgttaccatctcatggcagatgcacacagtcggccttc

SEQ ID NO: 118160 - DNA, 136 bp, Homo sapiens
ctactactgctcgaattcaagcttctaacgatgtacggggacatgtggatgtacatatgtctgtatatatgtatatattttgaactttctaaaaaaaaatctggaaatagaaacaagtaaacccctgtgtgtggca

SEQ ID NO: 118161 - DNA, 832 bp, Homo sapiens
cggcgccacagctctctctgagctgggtgttgtcagccacatgttgtacctgataaaaccagaggtgaggccttgctttgggtcacaaccaagtactgcagagtttggatttgagcgtaagtccctcagagactaaagataccactaggccttacaattttatgaataattttggtttcatactagagtaaaggaaacaagggaagtaatttgaagaagcttttaccgaacaggttgtgtgttctttgtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggca

SEQ ID NO: 118162 - DNA, 884 bp, Homo sapiens
aaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcagaaatgtgtcagatatttcctaggtctgag

SEQ ID NO: 118163 - DNA, 758 bp, Homo sapiens
aaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggca

SEQ ID NO: 118164 - DNA, 434 bp, Homo sapiens
ctccccaccccttctgtctgccatccatcccaggtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctg

SEQ ID NO: 118165 - DNA, 218 bp, Homo sapiens
accctggtttccagagatcactgccggccacagggctgcatgatcactgcccgatgattgatggcttggaaacagtgttattttctctggctctgatgggactcactggggtgaacatcccccctggggacgtcttctcacatctggttctgaggctgagagacactgggccagtgcagaggggatgcctgccctgccctgccagctctgaggctgag

SEQ ID NO: 118166 - DNA, 299 bp, Homo sapiens
tttataacacaaaaaagaaggggggccttcaattccaaacagctgctttacttggagaaatactgacctaagatgtgattacgcttcagagataccaacgggcactgctgtgttcagtagaaagaaatgtaaatgaaggctcacttgattgtggcatttagagggaacccttggtacctggaaatgtgaatctggaatcttacctgtgtcatcaaagtagtgatggattcactactcctcaaccactctcctcatgattggaacaaaagcaaacaaaaaagaaatctctctataaaatg

SEQ ID NO: 118167 - DNA, 174 bp, Homo sapiens
agtctgcagcctacacagaggacaaacctgccccaagggcctccctataaacagcagtagtcaaggttaagtgggggaagttctgagaccagaagccataagaggctttctagctaagtgattatgaacagaaaagtaacaaaaaatggaaaggccaggaaatgtgggaaggag

SEQ ID NO: 118168 - DNA, 302 bp, Homo sapiens
ggaagtgttgaagtctacagctattgtgaaggatttgtctgtttctccttgaagttctagcaatcttcacgtattttgaggctctgcatctatgtattttgaggctccttcctaaagtccataaacctttaggaaggattgttttatcctcttaattatttaacccctttatctatatctatatctgttaagaggtggaactgaaatggccttttaatgatctggcccttccttcattacaacctactttgggcagggaaagtcccattcagtctctggagtgcctggttaaatctcttgaa

SEQ ID NO: 118169 - DNA, 392 bp, Homo sapiens
actccaaggtctctgagtggacgaccactgcgccttcagacttgccagggtacagcactcagatccggattccctcaccccaggacctctcctcccacagccatccccatcacgcggatggcaactccattctcctgtctgctgcagccaaacacaccctcctctcacaccccacaccaggtccaccaggaaagtccagtggggcccacccccaaggcacatccagattctgagtgcttctcacagcctccctgaagtgaggtaagccatggccatctggcccgtgggaccacataacaactggcctacaagctcctctctctgatcccagctgccacagcgtgcccctgcaacccaagacaggccttctccccctgcatgaaactgtgtac

SEQ ID NO: 118170 - DNA, 215 bp, Homo sapiens
ctggcctctggtgatccgcccacctcggcctcccaaagtgctgggattacaggcgtgagccaccacacccggctgaaaaagttttttctaaaatatttttggaattttgtttttcaggattttaacattggggatgatggcatttgggattatggtcagctcccatcttggacttctggcctctagaattgtgagaaaataaatatctgtgattt

SEQ ID NO: 118171 - DNA, 767 bp, Homo sapiens
acgcgcatgcgtagcactcgtgcggccgtgccttggaatagcacgtcctgcggcctcagccgcctcttccgccatcctccgtaggctgcattctgccctagtgagcgccggtttttgagccttgctcttccctcgctaccgacgtcgaatcattatgcggtcaacaaccgcaggtgggttatgtgtcatagcccgcctccgctggagggaaaaggcctggtgcgagaaatgcccaagggaaagcctgtctagggtatcgagtgctggccgagggccctgcacccggactgggactgcgccgggccccgctttccctcaggccctccacccccagcggcccggcggcatttgtgaacagccatctgggactcccacgcctaggcttttcggcttcacagaccttccactccctcaggggtccagccacagcggctcattcctgccccaggggcccttgcactggctctttcgagacctcagcaggtcttcccttctgatttgcacttacgagacgcgttcagattcactgcttcaaaggacttcagaaagtagttgtcagatcttaacaatcttgaacaactgttcacacccatacactttctgcatagcgctcaccacgacccggcgtttctagtttctcatttaccttccacataaattacatgagaacctaatcttaacttgttcacaggtgtatcctgaacacctgagacaaggaacagatgtacagtaaatacttgatgagttaatgaatggcccacatagaa

SEQ ID NO: 118172 - DNA, 664 bp, Homo sapiens
ctactactactaaattcgcggccgcgtcgacgatgggatattgacattgagcgggcatcgtgccttcccctggtggcctccgaagctcatgcaagtttgcaggaagagacattcagagtgaaatacggcctgaaaagccactccaagttgtattatttatgaaacacaacactcaacacaagaagaaacccaatacagcacatcattctgcctgctccgtggcttctgcttctcaagcgacttaaaatgattgtctcactttgtctcccaggctggagtgcagtggcgtgatctcggctcactgcaacccccacctccctggttcaagtaattctcctgcctcagccccccgagtagctgagattacaggatcctctctctgggagccctcatctacctccagctgcaatcatcaccacaggagtgagagagagacttggacctgagctggaccctccagccctccttcgctgaactaccttccaaccttatgttcctactgatgtttaccaggttattcaataaatattgtatgttctgtggcagtggccaccagtcattttcaaatacctgttttcccttcttccttaccaaaaacacccatggtttttagctggacacctggttgcccaaaataaacactgcatttgcagcctcccttgca

SEQ ID NO: 118173 - DNA, 152 bp, Homo sapiens
cttgaggagcacccccgccagccactggtttgagcaacaagcaccctgcaccaacagcatcatgtccatccctgctagggctgctcactctccagcagctttcagctcgcactcccccaccccctggtgctggcgagtcttcccgggaacca

SEQ ID NO: 118174 - DNA, 436 bp, Homo sapiens
taacagaaaatgttgatgctatacaaatgtattttaccttaagaaaaaggagcatatatcaaataattttataaagatacccatacaaaataaagtttgaatcaaaaaatgtatataaacctgctctaaaaatgtctacacaagtgttacaaaaaaaaaaagttgattgaggaaacattccagaacattggtctaaacaaagattttatggagaagacctcaaaaaaattacagggaaccagagcaaaaatagacaaatgggattacatcaagctaaaaatcttctgtataacaacaacaacaacaacaacaacaacaaaaatcaacaaagtgaaaagaccacttacagaatgggagaaaatatttgtaaactatccatctgagaaggcattaataaccagaatatgtaagaagctcaaacaactcaatagcaaac

SEQ ID NO: 118175 - DNA, 151 bp, Homo sapiens
ttgctgtgctgctgggaaatagaaaacatgaaacaaagtgaggtgaggtagtgagatgatcaattggtagccctacttgggaagaatcattcttagaaatgctgcagctctttcaagctctcttatgagttggccagccccagagacccaa

SEQ ID NO: 118176 - DNA, 459 bp, Homo sapiens
cttgaacaggtttaggagacagtaggtctcacctcatgtttataatcttaaagaggcattgcagtcactgaaaatctgagatcagtgaatcatcgccaaattactgagaagtaatagttgcaacaactattacagctttttgcaaaacaacaataccacaaccaccaccaacaaaatcagtaccagaagagtctgctaactccagcatcttatcaatactgctgtggtcatttcagcatggtctaaatgctattgtcatcttggtgtagagtctcaaagaaggaggtttttagggactggggccactgcatcaaagagacagtgttgacattgggctgatgaaaagggctgcaggagcaggttcttactggacaacaaagaaattctcatagtgtggatttgtcacagacatggcactcagggagaagagacagagagacagagagtttatatatgtca

SEQ ID NO: 118177 - DNA, 1026 bp, Homo sapiens
attggctttgtcccttaagcttaggtggttgctcttttcctgatgagtctactttatcctaaagttagtaaacttgctttgccactggccctttcaaactaggggtgataaaaatcactctaaccaaaggttactgcagtctcttgtgttctttctcatcccttcaacagctttgcaaagagtctccaaatcctctctgcattatccttattaaattgcactatcagtttctttatatgaccccaacaaatacatgaatctcctagttagggaaactgatagactaagagtacttttctttcatgttcaaagctagaaggtaagtattttctaataatgtgaagcagttgaaatgacaatttgggttagagctgtgctgtggactacagctatttgaaagtacagttttatttttatgacagtttgctctctgctgtctgggatatttacattttcctttcctatggagaaggtcagagtatgattgattcaacattaaaaataactttaggttgtttaaagtgaggatgttctaaatgataatatttgtgaagtcctctattttgatatttttcacttaagatcagtgatttagaaatcaagtgaaaatcttgttaccatttgaatgaacatactgatattaataaaatgataagtattttacatgatcatccaagttagattttgacagaatgcctagggtcttggagtaaccagcttttggcagttcctggctctctttttcatattcaaatttgtaaagaaagcagagaagagtaaatgtgtgtgggtgtcttcctcctggaagtaggcacaaactgcatggaaaaccaaccaaaaaatggtaacagaaaaatatgataataatttatttaaaaataaaattcttagactttgtcataactggaagactatctagaattgtgaatgaagtaaggaccccaaataaagacgcatttctaattctcatatttctggcccatgcgggtggatgagcgggtacggccgattcgatcgcaggggggc

SEQ ID NO: 118178 - DNA, 295 bp, Homo sapiens
gggagtcttctgttttttcttctctttacttttctgcattgacatatatttttactatgcttttaatacccttcccttcccctattaatcctgaagcttcatctcatgagatttttcctgtttcggactgctgagctgttaactaagagcaactgtaatttcttctgaagttctaactcccttctactggatttttgaacaacttgaggacagagtgatgctataatctttatacttttagcatgtggacagtaatagtagtatatatagcaggaaatcaaatagctaattgaat

SEQ ID NO: 118179 - DNA, 205 bp, Homo sapiens
attacaggtgtgagccactgcactcagcctcagtcattgtttcattcattcatcacacatctgagtactgcagtgtgccaggatgacagtgaggtaggaacacagaccagcacggaggtgggacagagcttcctggagaagggcttttcaaggttgaataggagtttgcaatgaggaaaaaaagtcacatgatctttcttttttt

SEQ ID NO: 118180 - DNA, 642 bp, Homo sapiens
tgtctgccactgcaatggcatctttcctcttggcaattgtataacagcattcttaccttcaggcttttcattcctgtggctctttctgtagctctggtgttggacatttggtcattatttgtcaataagaaacacattcatgttatcaggataacaccaaaggcaaataataatgtcctaatcatagaaaccatgttaaggccatagttcattttttaaaaaatcattagaatggaattattttttaaaagtgttttctttctggattacatttttttccggtggtagaatttattctttaatatcatttggcaaaatcaatggttttggcagccattggactggttcagttcttaaggcaacaggtcccttgcttgaagcagtcacttgagagaaagtgaggatttgctcttgggaggaagacctgagtaagttcaaggagcaaatttagtgactaccaggaaagaaaactgtcaggttcttcatacttccaggaggcagtaccagcatagaatcatgcaaaccaacgaagagcacaatatactcaccctactcctcgatcccaaaccagagtcttgaggattcacaggaacttctgctaagacccaggaagtgccatcgatctgtaatgattcttgccta

SEQ ID NO: 118181 - DNA, 664 bp, Homo sapiens
agtgcaaaagtaaagagaactgatttgtgagaagagagactggaagtagggaaacctgttgcaagactagcagaggtgcaggtgacagacaaatagccacaatttagactagagttcaagctagtggagaggcattgggaagcagggacggcttgagaaaaagcctttagaaaaaggctttagaaaaaaaatttgctaatgtcatcagcatgctcttctgtagtcctctggaatcctgggggagggggagatggaaagggaaaaggagagagagccctgtttggttcatgtttttattcagctgtgtcaactgtggcataggagcaaggttttgtctctagcccaactcaaatggattatatttttatcaaggcttaaccacatcttctatattattaataatattaaaaggccaggcacggtggctcacacctgtaatcctagcactttgggaggccaaggcgggctgattgcctgagcacaggagttttgagaccagactgggcaacatggtgaaaccctgtctctactaaaatacaaaaaattagctgggtgtggtggtgcatgcctgtaatcccagctgctcaggaggctgaggtaggagaattgcttgaacccaggaggtggaggttgcagtgagctgaggttgcaccactgcactcca

SEQ ID NO: 118182 - DNA, 6268 bp, Homo sapiens
  misc_feature (6243)..(6243): n is a, c, g, or t
agagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcattaaaaaaaaaaaaacaaaactgttactgagtttcaagagcccctccttggccatgagggagaactatctgctgtttattcagttctgcctttgccagggatggtactagggactcagctcatttaatccttccagcaacctacaagggcaagcaccttcagcagatgaggaaaacttaggttcgaagaagttaaggaatgtctgatgttacccagataggaatggtagaatagagatttgaacccaggtctacttttatctttttacatttttattgaattttattttttactctactttgagattgaggaataaattaagacagggctcatcctcagtcagagaagatggtggtgggcaaagaataaggaagggagaggcattgagagcattaatttgtttgttcacttggtaagcatttagaatgcctgctaggtggcacaatatgtgccacagtctggcttcccttaaggggatactgttttatagtctgaccagggaacagttttctgaagttttaagcatgcaaaagaaatgagactgtttatttccagacgagcccaagattcttatttctttttatctttaaattcaagttcaaatcttttttttttttttgagatggaatctcgctctgtgacctaggctggaatgcaatggtgcgatctcggctcactgtaacttcctgccttccaggttcaagcaattctcctgcctcagcctcccaagtagctgggattacaggcgccccaccatgcctggctaatttttttgtatttttagtacagatggggttttaccatgttggctaggctggtctcaaacccctgacctcaggtgatccacccgcctcggcctcccaaagttctgggattacaggcatgagccaccgtgcccggcctcaagttcaaatcttgaattagaagacatttgattattggaaaactgatacctttcaaattactcattttacagacaaaacgctgctttttctgttttgggagcttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccaggatgaaggctgttggaactataatcaaatcacgtagctctctaggaagcttggtgtgttggcctgttaaaaattggctactgttgaattttctaaaaaaggatttttactcctatatacttcagtagttacaggaggtatagtacttattaaaataccatatatggtgaacagtgtctatgatgtatttataaagacttttggatcactagagaataataaatgtagggtaacatgtaatacttttaagatggattccaataaaaagaagtatagttgctgttttattttaagattgacttttaacatgtgccttttgaggttgccttagctggcacagttatgggaaagattgatattgtactttatatgtttgtttctgtggttggatgatactcttgtctgccttttctttttaggagaccagcataaacactttggggactgagaggataagccatatcattagtgaccctcggcagaaagatttctggttaccatcagctgggaaaagagaacgaaatcaggtaagatcatttttctttgtcatctttattttatcatttggtttccttttctttagaaagaataaagcgttggcttctgattttcctcacatttctgcttgtgcacatgaggtaaggtttcctctttcttgttattttgattttcttggagaaccgttttctaagagtatccaacacttactggtaaaaactgcagctaattcctctttgtaggttcaactgtgatcattagtttcttgtagcatatatttcataggaatcctgtttttattttagttttgaactttgcagtaagaaagcagaatgaatctgatttgcatatggtttagttcaacatcagaatcctgcattgagaagtactatgttgaagcctaaacgtatggagcagaaggtagagctgctttgggtgaagtggggtcaaagccttagagcagtggtccccaaccttatgtcaccaggaaccatttttgtagaagacagtttttccatggacccgggttgggggcgtggtgaggggggtggttttgggatgattcaaatgcattacatttattgtgtactttatttctgttgttattacattgtaatatataatgaaataattatacaactggtcataatgtagcttgtgctcctgcaactacacagtcccacctgggggtgatgggaaacaatgacagatcatcaggcattaggctttcataaggtgtgcacaacctaggtccctctcatgctcggttcacagtagggtttgcactcctataagaatctaatgtggctgttgatctgacaggaggtagagctcaggcggtaatgcccacgatggggagcagctgcttgctgacagctcacctcctgctgtgcggccccggggttggggacccctgccttagagcctctccttcttagtcttttccctggctaccccctgaggggccccttggcatatttaggcccatgtggagggctcacaatttaaaaattaactcacagtggttatcgatatgtttctttatgtgtgaagctttgtgatttttttggaggattgcattatcttggtgattagttgtaaaatagatgaacactgacaggtgaaaagttgtaggcttcctgtttgttgtgggtttttttgttttttttttttaacaacttagtagcttactgagttgatatacacgatccacattttagacttggaatcttcattatgaatttgctgtttcaaaatgaactagagtggtagaagacataactggtgtatatgtatgagatgattttagatggcatatagatgcccaatttttaagttatgtattatagtgtacattggaaaagatgtaattatggtatcaagcctgttatttcacggaaatatagtaaggacaaagctgagcaaaaataattgatatgaggaaaaataataagtaaacagtagtacaggttgtaggcagataaggaaagtcatgaaggtggtatgtgagagactgcagtttggggaacactaagctagagcactaatcatgtttgcatcagaggatccaaaggcagaaggggacctgtggcagtcacctgatccagatccgttatttgcaaatgacgaactggagatctgtaagattcaaactatttgcccaaagtgatacagctaatagaaccaagattggaacctctgtggcagatagaacagttgcttagtttgtattctcataaaacaagtttgaagttatcattccgggttcttccagtctttgtatgtcagagggtattaagttctaaactttttagagaggactgttatgttgtgggaaaagtccaaagaaagctagcaaacataaagtgagggatctcctttgatcctcacagccaccttttgaagtcaaatagatgttttgcagatgagaaactgaaattatactctgaaagcaatatttcatttagccctcataataaccctgtaaaataggtagggcaggcctggcacagtggctcatgcttgtaatcccagcactttgggaggctgaggcaggtggatcacctgaggtcaggggttcgagaccagcctggccaacatggngaaaccctgtctctactaaaaatac

SEQ ID NO: 118183 - DNA, 2470 bp, Homo sapiens
agagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 118184 - DNA, 523 bp, Homo sapiens
cttcccccatgatctccttgcagcctgcccacactggccttagggtgactttctggagaggcaagcatcttcatgtgagacctgccaaagggtgtataccttctcaaaagaccctgcagtttcttctccaatgtggacaacgctgagcatatgatctttcggtgtctatctgcactttctttgacctctggtcattgttggtgaaagctaaggagcaagtaggagttctcaagatgaaatggatgaatcacccgaagggataccatttgagttctgggagagctgcctgccgacttcacaaagacgtattcctctcattaatgactgttagtgtagcatcatgcaatgctcctgagaaactgcagaaatagtaatgaccatgtgatggccaaggctgattggaagatgctcctggggagagatgaagtttggatttacagcatcagcatgaaggagttgcaagcattggtgttgtaaaccgcactggcacctgacactaaatgtgggaaagggatggggttcc

SEQ ID NO: 118185 - DNA, 2455 bp, Homo sapiens
agagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 118186 - DNA, 3093 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatcttactggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgccttt

SEQ ID NO: 118187 - DNA, 6620 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatcttactggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcattaaaaaaaaaaaaacaaaactgttactgagtttcaagagcccctccttggccatgagggagaactatctgctgtttattcagttctgcctttgccagggatggtactagggactcagctcatttaatccttccagcaacctacaagggcaagcaccttcagcagatgaggaaaacttaggttcgaagaagttaaggaatgtctgatgttacccagataggaatggtagaatagagatttgaacccaggtctacttttatctttttacatttttattgaattttattttttactctactttgagattgaggaataaattaagacagggctcatcctcagtcagagaagatggtggtgggcaaagaataaggaagggagaggcattgagagcattaatttgtttgttcacttggtaagcatttagaatgcctgctaggtggcacaatatgtgccacagtctggcttcccttaaggggatactgttttatagtctgaccagggaacagttttctgaagttttaagcatgcaaaagaaatgagactgtttatttccagacgagcccaagattcttatttctttttatctttaaattcaagttcaaatcttttttttttttttgagatggaatctcgctctgtgacctaggctggaatgcaatggtgcgatctcggctcactgtaacttcctgccttccaggttcaagcaattctcctgcctcagcctcccaagtagctgggattacaggcgccccaccatgcctggctaatttttttgtatttttagtacagatggggttttaccatgttggctaggctggtctcaaacccctgacctcaggtgatccacccgcctcggcctcccaaagttctgggattacaggcatgagccaccgtgcccggcctcaagttcaaatcttgaattagaagacatttgattattggaaaactgatacctttcaaattactcattttacagacaaaacgctgctttttctgttttgggagcttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccaggatgaaggctgttggaactataatcaaatcacgtagctctctaggaagcttggtgtgttggcctgttaaaaattggctactgttgaattttctaaaaaaggatttttactcctatatacttcagtagttacaggaggtatagtacttattaaaataccatatatggtgaacagtgtctatgatgtatttataaagacttttggatcactagagaataataaatgtagggtaacatgtaatacttttaagatggattccaataaaaagaagtatagttgctgttttattttaagattgacttttaacatgtgccttttgaggttgccttagctggcacagttatgggaaagattgatattgtactttatatgtttgtttctgtggttggatgatactcttgtctgccttttctttttaggagaccagcataaacactttggggactgagaggataagccatatcattagtgaccctcggcagaaagatttctggttaccatcagctgggaaaagagaacgaaatcaggtaagatcatttttctttgtcatctttattttatcatttggtttccttttctttagaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttatacatggcgtgtttatgatggctcagctgcatgtggagttatatatacagtcgtgcctgaagttggatgctactttgtcaaaatgagaaataagtgatggcctggagctgctggagagaagccacgctttctagaaaatattatcaggagtgtctgtcattcattcaggggcctagctgacagaagggctcttttttttataccaatgagtgcgtttactctgaaatacatagaagctcttggtgaagtgctccctgctctggtcacattgtagagggactcccactcatgcatctgcttattttctgtcttaaataggtgctgaatggggcagcacctccttcccccaaagtgcgattgcccctgtttcccatacgaagtgtaatgacgggttgcttttaaaattatagtccttatc

SEQ ID NO: 118188 - DNA, 6318 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatcttactggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcattaaaaaaaaaaaaacaaaactgttactgagtttcaagagcccctccttggccatgagggagaactatctgctgtttattcagttctgcctttgccagggatggtactagggactcagctcatttaatccttccagcaacctacaagggcaagcaccttcagcagatgaggaaaacttaggttcgaagaagttaaggaatgtctgatgttacccagataggaatggtagaatagagatttgaacccaggtctacttttatctttttacatttttattgaattttattttttactctactttgagattgaggaataaattaagacagggctcatcctcagtcagagaagatggtggtgggcaaagaataaggaagggagaggcattgagagcattaatttgtttgttcacttggtaagcatttagaatgcctgctaggtggcacaatatgtgccacagtctggcttcccttaaggggatactgttttatagtctgaccagggaacagttttctgaagttttaagcatgcaaaagaaatgagactgtttatttccagacgagcccaagattcttatttctttttatctttaaattcaagttcaaatcttttttttttttttgagatggaatctcgctctgtgacctaggctggaatgcaatggtgcgatctcggctcactgtaacttcctgccttccaggttcaagcaattctcctgcctcagcctcccaagtagctgggattacaggcgccccaccatgcctggctaatttttttgtatttttagtacagatggggttttaccatgttggctaggctggtctcaaacccctgacctcaggtgatccacccgcctcggcctcccaaagttctgggattacaggcatgagccaccgtgcccggcctcaagttcaaatcttgaattagaagacatttgattattggaaaactgatacctttcaaattactcattttacagacaaaacgctgctttttctgttttgggagcttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccaggatgaaggctgttggaactataatcaaatcacgtagctctctaggaagcttggtgtgttggcctgttaaaaattggctactgttgaattttctaaaaaaggatttttactcctatatacttcagtagttacaggaggtatagtacttattaaaataccatatatggtgaacagtgtctatgatgtatttataaagacttttggatcactagagaataataaatgtagggtaacatgtaatacttttaagatggattccaataaaaagaagtatagttgctgttttattttaagattgacttttaacatgtgccttttgaggttgccttagctggcacagttatgggaaagattgatattgtactttatatgtttgtttctgtggttggatgatactcttgtctgccttttctttttaggagaccagcataaacactttggggactgagaggataagccatatcattagtgaccctcggcagaaagatttctggttaccatcagctgggaaaagagaacgaaatcaggtaagatcatttttctttgtcatctttattttatcatttggtttccttttctttagaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcaggtggtagaaggacagcccccctgccctgagacaacactcggaggcctgtattccagcgagagtgccctgacaagacagctctggccacccttgcctggctcctccaccttcccgtcagtttcgtgagttctccagccttttcccagctggtcattgttggtgaaagctaaggagcaagtaggagttctcaagatgaaatggatgacccatgagaccggtatggttatcattcccattttatacaagaagaaaagaaggctgagagagtttaagtcacttgctaccacatgagtaggttgcggcagagctgggacaggctcatcatagcattgatttcattgtgtcatgaatgcctgttttcttttctctttccccaattcagctgttaactggttgatggcatacaccacaatttttgttgactttaaaaatattgtaaagtatagcacatatacattattaaaagaaaaactgcagctgcagctgggctagattaaatttaaaggagtttaattgagcaatgaatgatttgtgattcgggtagcccccagaatcacagcagattcagagagactccggggacgcctcctggtcagaacaaatttatagatcaaaataagggaagtgacatacagaaatcagaagtgaggtacagaaacagctggattggttacaggttggcatttgccttatttgaacacagtttgaacgctcagcagtgtatgagtggttgaagtatggcggctgggattggccaagactcagctattgttacaggtgcatactcctaagttaggttttcaatcctgtctacctattaagttaggtcgcagttcatccacaaggactgaaatatagaagtatggagtccttctcagaccatttttagttcactttaacgacataaaactgcacaaaacatacagtataaagtgcaacggattattatacaacaaaacacctgtgtattcattgcccagacattgccagcattccagaaaatcctcccagaccccctgtcaattcttagccctcttcttcccttccaggaacagctcccatgaactctagccctacagttagttctatctattgcttagatttgtgagatttatccatgtgtgacatgtagctgtaatttgtgtattttcattttggtatatgatatagtttggttgtgtgtccctgcccaaatctcatattgaaatgtaatccacaa

SEQ ID NO: 118189 - DNA, 2995 bp, Homo sapiens
  misc_feature (2970)..(2970): n is a, c, g, or t
agagagggaagccccggcggtgagagtcggcccaaaaagcggcggccgttggaggtggctgcggcagctgatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttttgaactttgcagtaagaaagcagaatgaatctgatttgcatatggtttagttcaacatcagaatcctgcattgagaagtactatgttgaagcctaaacgtatggagcagaaggtagagctgctttgggtgaagtggggtcaaagccttagagcagtggtccccaaccttatgtcaccaggaaccatttttgtagaagacagtttttccatggacccgggttgggggcgtggtgaggggggtggttttgggatgattcaaatgcattacatttattgtgtactttatttctgttgttattacattgtaatatataatgaaataattatacaactggtcataatgtagcttgtgctcctgcaactacacagtcccacctgggggtgatgggaaacaatgacagatcatcaggcattaggctttcataaggtgtgcacaacctaggtccctctcatgctcggttcacagtagggtttgcactcctataagaatctaatgtggctgttgatctgacaggaggtagagctcaggcggtaatgcccacgatggggagcagctgcttgctgacagctcacctcctgctgtgcggccccggggttggggacccctgccttagagcctctccttcttagtcttttccctggctaccccctgaggggccccttggcatatttaggcccatgtggagggctcacaatttaaaaattaactcacagtggttatcgatatgtttctttatgtgtgaagctttgtgatttttttggaggattgcattatcttggtgattagttgtaaaatagatgaacactgacaggtgaaaagttgtaggcttcctgtttgttgtgggtttttttgttttttttttttaacaacttagtagcttactgagttgatatacacgatccacattttagacttggaatcttcattatgaatttgctgtttcaaaatgaactagagtggtagaagacataactggtgtatatgtatgagatgattttagatggcatatagatgcccaatttttaagttatgtattatagtgtacattggaaaagatgtaattatggtatcaagcctgttatttcacggaaatatagtaaggacaaagctgagcaaaaataattgatatgaggaaaaataataagtaaacagtagtacaggttgtaggcagataaggaaagtcatgaaggtggtatgtgagagactgcagtttggggaacactaagctagagcactaatcatgtttgcatcagaggatccaaaggcagaaggggacctgtggcagtcacctgatccagatccgttatttgcaaatgacgaactggagatctgtaagattcaaactatttgcccaaagtgatacagctaatagaaccaagattggaacctctgtggcagatagaacagttgcttagtttgtattctcataaaacaagtttgaagttatcattccgggttcttccagtctttgtatgtcagagggtattaagttctaaactttttagagaggactgttatgttgtgggaaaagtccaaagaaagctagcaaacataaagtgagggatctcctttgatcctcacagccaccttttgaagtcaaatagatgttttgcagatgagaaactgaaattatactctgaaagcaatatttcatttagccctcataataaccctgtaaaataggtagggcaggcctggcacagtggctcatgcttgtaatcccagcactttgggaggctgaggcaggtggatcacctgaggtcaggggttcgagaccagcctggccaacatggngaaaccctgtctctactaaaaatac

SEQ ID NO: 118190 - DNA, 1821 bp, Homo sapiens
tgtttggtataacaagagttggatagtcaaaggggaaaagtaatcaaatgtaggttaccctttaggatcaggtccgtttcatgtaagccttactaaaatagtcttattcattcctgcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagttcacatggatgcagtggagccaaccacaccagcatcacaagcccccaaatcacccagctctgagtggttggtgaggacctctgcagcagagaaagccacagacgcaactactgctacattttttaaaatgccacaagaaaagagccctggatacagctagagagcaggacttcaccctccaggagctgactgggtgttgctgaagcaaatgttggactttgtgttagatagtcttgcatatcttaatcgacattcccagtcctttcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttatacatggcgtgtttatgatggctcagctgcatgtggagttatatatacagtcgtgcctgaagttggatgctactttgtcaaaatgagaaataagtgatggcctggagctgctggagagaagccacgctttctagaaaatattatcaggagtgtctgtcattcattcaggggcctagctgacagaagggctcttttttttataccaatgagtgcgtttactctgaaatacatagaagctcttggtgaagtgctccctgctctggtcacattgtagagggactcccactcatgcatctgcttattttctgtcttaaataggtgctgaatggggcagcacctccttcccccaaagtgcgattgcccctgtttcccatacgaagtgtaatgacgggttgcttttaaaattatagtccttatc

SEQ ID NO: 118191 - DNA, 377 bp, Homo sapiens
aaggtgttcaccagcacactgctctgccaggtaattgtcttttagtagcggttatttgcttctggacaatactatattcctttctattacccctcaaattatagagtatgcttgtgtacagtatccaatttgatcctgacaatcttttgaggtaaatagatgttttacagatgtagaaactgaggcagagcagtgaagtatctttcctgtggtccaaggctagtatgtgattaagtctcaactttgacctaagtcttctggctcatatttcattttatttctgctgctaaaagccccatcttcaaacaacattattaatgttccttgccatgagcctgcaataccctgcataatctgacttctccctacatgtacag

SEQ ID NO: 118192 - DNA, 6230 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatcttactggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcattaaaaaaaaaaaaacaaaactgttactgagtttcaagagcccctccttggccatgagggagaactatctgctgtttattcagttctgcctttgccagggatggtactagggactcagctcatttaatccttccagcaacctacaagggcaagcaccttcagcagatgaggaaaacttaggttcgaagaagttaaggaatgtctgatgttacccagataggaatggtagaatagagatttgaacccaggtctacttttatctttttacatttttattgaattttattttttactctactttgagattgaggaataaattaagacagggctcatcctcagtcagagaagatggtggtgggcaaagaataaggaagggagaggcattgagagcattaatttgtttgttcacttggtaagcatttagaatgcctgctaggtggcacaatatgtgccacagtctggcttcccttaaggggatactgttttatagtctgaccagggaacagttttctgaagttttaagcatgcaaaagaaatgagactgtttatttccagacgagcccaagattcttatttctttttatctttaaattcaagttcaaatcttttttttttttttgagatggaatctcgctctgtgacctaggctggaatgcaatggtgcgatctcggctcactgtaacttcctgccttccaggttcaagcaattctcctgcctcagcctcccaagtagctgggattacaggcgccccaccatgcctggctaatttttttgtatttttagtacagatggggttttaccatgttggctaggctggtctcaaacccctgacctcaggtgatccacccgcctcggcctcccaaagttctgggattacaggcatgagccaccgtgcccggcctcaagttcaaatcttgaattagaagacatttgattattggaaaactgatacctttcaaattactcattttacagacaaaacgctgctttttctgttttgggagcttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccaggatgaaggctgttggaactataatcaaatcacgtagctctctaggaagcttggtgtgttggcctgttaaaaattggctactgttgaattttctaaaaaaggatttttactcctatatacttcagtagttacaggaggtatagtacttattaaaataccatatatggtgaacagtgtctatgatgtatttataaagacttttggatcactagagaataataaatgtagggtaacatgtaatacttttaagatggattccaataaaaagaagtatagttgctgttttattttaagattgacttttaacatgtgccttttgaggttgccttagctggcacagttatgggaaagattgatattgtactttatatgtttgtttctgtggttggatgatactcttgtctgccttttctttttaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcaggtgattacatgcggttatcatttattgagcatgtaccgtgtgccaggcactaaattatgtgttttgtataccttttcatgtaatgtttgtgatagtgtaggtcattttattcccactttacatgggaaaattgagactacaagaaataattagcctagttcttgctgactctgaagtctgtgctttttcactgttacatggctatctagagtttgaaaccctatattccactatcagcaatctccagtcatctgagcttttgttttagcagacaggaaattaggtccatgttaatgaaagtccaggtgaagtggcagttcagtcaggcagtcacacagggttatttactttcttattttgcatacagtacagtacattcttactgcttttataagtagaatgctaatattttactggtcatgacattcctaattaaaaacaattttttaggctaaaacttttcagttttttttttttttttttttaacaaaactaacactaattggtagaagccaaaatagtgcttctctttggtggggggcagtgaccaagagagggcacaaagaaaccctctgggctgttggcagtgctccatatgatgaacttggtgggggtgtgtggctgcttacataggtagaatctggagctgtgcacttagggttgatgtccttcactgtgtgtatgttatccttcaatgaaaaaaaggggagagttatgtatttattaatatttcagtgagaaaactggatattgaatataccattgaatattttattttctttagaaaatactacctattatataaatcagaacagttgatagctgaatagagagtaaacctcacacagatggggagggagccctatcctctaccttaacttagtaagttttggtgaactgtgaaattgtcctctttgtgcttctgtttggaaagtctgctttatggtggttcatactggacaatcttcattacaggtctgatgattatagtacttttttttcagtgctttccacatggccaggccctgagctgaacactttgtaaacattatttcacctaatctttgcaacagccttataaggtagatgctgtttttattcccaatttacacatgagaaaaccaaggcttaaatcacttccctgaggccacatggttgataaattgcagagccaagatcagaccggtttccttgtgactctagagctgtcctgcagatgttcttctt

SEQ ID NO: 118193 - DNA, 5740 bp, Homo sapiens
tactgtataaggttctatacctggtagcttccaggtggtagttggtaccagaatgggcgcaaacttagtctcttctccattctgacttcaaacctgggtcactacaatttcttggatcacgaaaactgcattcttccttaaatggtgtcactaagttgtctttctgtttctttctgccatggtcattgtcagcagtgaccccaggccaaagaacagtttttcattcattctcaatacctcgatgagaccatgtgctactctgtgtttccacaactctagtgtgattttgaagttgtatgtttttctgttcctgtctagtgagacagtctctaatcttactggatctcatcattaggtaattcaatgacaagtttaattggggaaaagagagaaggatctagtcccccgaatttgttttgggtcctgtcccagttgtcttctggttagtaggtttttgtgcttaagaatatgttgacttcaggcatttaacaagggacaaaacatctatttttagtgacttaaggaagtggtaggaacagaatctaagtgtagccagatgaaaggtgacttattttgtttagacaggcagaactgtggactaccatgatctgtttcatcaaattattccaaaacaacagatcctttttcaggctttctttttctttttcttttctttctttctttttttcctaaacttccttttggcagatgtggcctcatggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagaatgtgaatggatatacaaataaaagatgaaacgtaattcatatagaagtactgacaaaaaaaaaaacactgtcattacagtgtctattgcctgtaaacctacaagcctgagctgtgtcttctgtaacttttgattaatgttatgttattattgtgtaagttaaaatactcttggcttctttatgactcctcttgaattcatgaatgcatctttgttctttcctaattttggtctttcatcctagaattcattaaaaaaaaaaaaacaaaactgttactgagtttcaagagcccctccttggccatgagggagaactatctgctgtttattcagttctgcctttgccagggatggtactagggactcagctcatttaatccttccagcaacctacaagggcaagcaccttcagcagatgaggaaaacttaggttcgaagaagttaaggaatgtctgatgttacccagataggaatggtagaatagagatttgaacccaggtctacttttatctttttacatttttattgaattttattttttactctactttgagattgaggaataaattaagacagggctcatcctcagtcagagaagatggtggtgggcaaagaataaggaagggagaggcattgagagcattaatttgtttgttcacttggtaagcatttagaatgcctgctaggtggcacaatatgtgccacagtctggcttcccttaaggggatactgttttatagtctgaccagggaacagttttctgaagttttaagcatgcaaaagaaatgagactgtttatttccagacgagcccaagattcttatttctttttatctttaaattcaagttcaaatcttttttttttttttgagatggaatctcgctctgtgacctaggctggaatgcaatggtgcgatctcggctcactgtaacttcctgccttccaggttcaagcaattctcctgcctcagcctcccaagtagctgggattacaggcgccccaccatgcctggctaatttttttgtatttttagtacagatggggttttaccatgttggctaggctggtctcaaacccctgacctcaggtgatccacccgcctcggcctcccaaagttctgggattacaggcatgagccaccgtgcccggcctcaagttcaaatcttgaattagaagacatttgattattggaaaactgatacctttcaaattactcattttacagacaaaacgctgctttttctgttttgggagcttattgttaacagggatagctagcagaatagcagtacatggggtggaagaaggagaggttttacttttattgtttaggcttgacagataatgttccccctgccacctgtgttactttctttcagctcttataaaataagagccatccacttccatggaaacaagtcactttatcttgaaggtttccctttagcttgcctggaagggagtgagggcctgttggatgtgcctttaatgatttcaaatgaataggataatatttacttgtttaattcatcttcatcaccttaaagggatatttatcatttctagaagaggtcaccgctctgccccccttcttccccctcccccatctctcttctgcttttctaaattgtaatcataaataatgagtttcattcacagctccctgccagtgagctgctaattacacaaagtactgcttgtaatttacacagtaataaactgtaaatttaaacattacggcactttaagttaataatttttctgctgtaacaaatagctcatttttcacccatcttttcccttggcccccctaccatgtctgtctgtgaccaggaggcatagctataagaaatgcagaacatgaagaatatagtatatgaaaacttctcatttaactccactaccgcccggactctgacctcagagtaatttttctacagccagttctgctgaaatgtgtagcctgatgtttagcacggtccacacacatagatgaatatagacacaaatgtgtttgaagaacagccttgatgttcttggcattcacgcccgtgacttgtgttctctcaacacaacagttactcagatgtgtgttggtatgctttcccaggtgccatggtaggtaagcattgtgaatgtactcaagttaaatgaagagtgaattgccgttttccaattttttggaaatggttcgtttctgaactctttgtggtgttatgggtaagcttttacactataatcttgagaaccctgaatttaggaatcaattttatacaaatttctatttttatttcatgagatgatgtttgagggacaaagtacagagtaacaatttttgcaagtcacaaaattctcttgatgtatttatatttagtcagcagatatttacattttaccagtgaggatttggtaatgtcccaggatgaaggctgttggaactataatcaaatcacgtagctctctaggaagcttggtgtgttggcctgttaaaaattggctactgttgaattttctaaaaaaggatttttactcctatatacttcagtagttacaggaggtatagtacttattaaaataccatatatggtgaacagtgtctatgatgtatttataaagacttttggatcactagagaataataaatgtagggtaacatgtaatacttttaagatggattccaataaaaagaagtatagttgctgttttattttaagattgacttttaacatgtgccttttgaggttgccttagctggcacagttatgggaaagattgatattgtactttatatgtttgtttctgtggttggatgatactcttgtctgccttttctttttaggagaccagcataaacactttggggactgagaggataagccatatcattagtgaccctcggcagaaagatttctggttaccatcagctgggaaaagagaacgaaatcaggtaagatcatttttctttgtcatctttattttatcatttggtttccttttctttagaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcaggtggtagaaggacagcccccctgccctgagacaacactcggaggcctgtattccagcgagagtgccctgacaagacagctctggccacccttgcctggctcctccaccttcccgtcagtttcgtgagttctccagccttttcccaggtgctcagaagttatttaggatctgagactcttgcttgggggtgatgagtagctcctgtatttgcagaatgaattctcggtgggacctttggaacaagcttccatgaaataaatggccatattggagaagcccaagtggcaaggaactgtcagcagtctctaagagctgagggtagactccagcaagaaactgaaaccctcagtctgacagccacaaggaaataaattctgccaacaacctgaagaagcttggagcagatctttcctcagttgagcctctgatgagactgcagcccgagctgtcacctggatagcagctggtgaaacccttcaacagagaaaccagccaacctgtgtgtaaacttctgacctgcagaaactgtagataaagagtgtgtgttatttagaactgctaagtttgtggtagttaagcagcatagaaaatgaatacagtaggccaggagtggtggctcacgcctgtaatcccagcacttt

SEQ ID NO: 118194 - DNA, 1339 bp, Homo sapiens
attcggcagcgaggttccagcccccagcagccccgtcctgggctacatgaggggagtataaaccacccaagtactgtcaggactcaccaccagaaccaactcctctttcaaacacagcagtggattctttctctcagaaggtcatgttgtgggaatcttttttttaaatagtgaaatattgaggcagcaattttttacaaaaaggtcatcctctgctctatttgttaccttgttattgctgtctcaacatttactacagctccatttacagaactgttgcttttttgcagttgtctttgttcttgaaaaaccagtaactgcttctgcataccttttgtgtagagcttttaatatcatttgaggaagttccaaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaactcagacagctcatcagcagcagcagctgtattgtattttacctcatcttcagagtttatgttctactgaaagaggacgtgtgtatacacacacacacacacacacacacacacagagattggtataatggagaagatggtttaggtgtacagcaaatttaaaatagtcagtggattgtgtcttactacttcatgtcccagtgtaagcctttatgtcctaagcaggactttattgttagtattataggctaataacctgcagcagaaattcatactctattataataatggcttcttggggccatgctttggggaagtaaaatgtctttttgacatgcctttatacatggcgtgtttatgatggctcagctgcatgtggagttatatatacagtcgtgcctgaagttggatgctactttgtcaaaatgagaaataagtgatggcctggagctgctggagagaagccacgctttctagaaaatattatcaggagtgtctgtcattcattcaggggcctagctgacagaagggctcttttttttataccaatgagtgcgtttactctgaaatacatagaagctcttggtgaagtgctccctgctctggtcacattgtagagggactcccactcatgcatctgcttattttctgtcttaaataggtgctgaatggggcagcacctccttcccccaaagtgcgattgcccctgtttcccatacgaagtgtaatgacgggttgcttttaaaattatagtccttatc

SEQ ID NO: 118195 - DNA, 603 bp, Homo sapiens
taaattgaaaagtataacagctgaaatgaaaaattcactagaagcgcacaagagtagatttaaactggcaaaagaaagcattagcaaacttgaagatggactgccagcttacattagcaacacgcaaaaacataaaaacttaaaataacataataaaagcagaacattaaattcttccatgccatgagcacagctaaagtcaatgcttgcaagagtagaaaagcaattttctttatggctgttacagtgctccttatggaataatattttaatcttaaaggattgattgaaaggaaaccattaggtaactaacagtttgtggacagggaatacaaatcacaaaggtttcatgagaatgactaaagttgtagaatgaatcagagaatctaaagaccttgctaattatagctaatgtgattaagtgccagcttttttttggagacagggtctgggtttctcacccaggtctgttgcccaggctggagcatgaccactgctcaatgcacccctcaacctccggggctcaagcaatcctcctgcctcaggttcctgtgtagctgggaccacaggcctgtgctaccatgcccagctaatttttgattt

SEQ ID NO: 118196 - DNA, 657 bp, Homo sapiens
taaattgaaaagtataacagctgaaatgaaaaattcactagaagcgcacaagagtagatttaaactggcaaaagaaagcattagcaaacttgaagatggactgccagcttacattagcaacacgcaaaaacataaaaacttaaaataacataataaaagcagaacattaaattcttccatgccatgagcacagctaaagtcaatgcttgcaagagtagggagagggtcaagagagaaacacaggaaaaatagagaaaggtgagacatcttttaaaagcaattttctttatggctgttacagtgctccttatggaataatattttaatcttaaaggattgattgaaaggaaaccattaggtaactaacagtttgtggacagggaatacaaatcacaaaggtttcatgagaatgactaaagttgtagaatgaatcagagaatctaaagaccttgctaattatagctaatgtgattaagtgccagcttttttttggagacagggtctgggtttctcacccaggtctgttgcccaggctggagcatgaccactgctcaatgcacccctcaacctccggggctcaagcaatcctcctgcctcaggttcctgtgtagctgggaccacaggcctgtgctaccatgcccagctaatttttgattt

SEQ ID NO: 118197 - DNA, 512 bp, Homo sapiens
ttacccaccactctacacacaatatatacaccactctacaatgtacacaccactctcaatgtacacaccactctacaatgaacacaccactctacacacaatgtacacaccactctcaatgtacataccactctacaatgaacacaccacactacacacaatgtacacaccactctgcaaacaatgtacacaccactctacaatgaacacaccactctacacgcagtgtacacaccactctacaatgaacacaccactctacacaccatgtacatgccactctacaatttacccaccactctacacacaatgtatacaccactctacaatgaacaccccactctacacaccactctacaatgtacacaccatgctacaatgaacacaccactctacactgaacacaccactctacacacaatgtacacaccactctacaatgtacacacctctctacacaatgtacacaccactctacaatgtacacaccactctacacacaatgtacacac

SEQ ID NO: 118198 - DNA, 491 bp, Homo sapiens
agtagattgttctgactatgctgcgggtgttggacttctattttcagatagcattatgcatcatgattttattaactctctggtatttgtaacattaaaaatactacagattggtttacttactgtgttcacagttcatcataacttcagtcatcttaaaatgatttcatttaagccttcttataaactgctttagaggcaactaattgtagcttagtattcagaaagaccaggctaataaagcctaatattcctttgcagttgaaccactgtgaataattcagttattaaaatctgtgacctgtagtgtaaaagaacgaagcatttactttttctgcctttaaaacattttttaaaattttataagatattataactccatatgttgattttttttttttgtgttttgtttgaactacagtgtgattctaaggaatccttaaaaaatgtgtagcacccttgaaatatgagtatagatgaatatttatagt

SEQ ID NO: 118199 - DNA, 349 bp, Homo sapiens
tgtgtgtgaaatgaatttgtgtggagcgttatgtgaatttttatgaacttatcttttattgttgatctagaaatgcttgtgataacctagaattccagacctcggtttcttatgtggataacaatgattggagattttggatagggagctaactttgctgtggaattgagatactaattatttgtgtaggattgataaatttaggatcaaaagtagaggtatgacacatttcaaaactgccttagagcaggggggtgttcaatcttttggcttccctgggccacactgaaagaagaattgtcttggaccacatataaaatacacgaacgctaatgatagctgatgaact

SEQ ID NO: 118200 - DNA, 279 bp, Homo sapiens
ggctccagccatcttgtctgaattgcaagctggaggaaggaagaaagacagaaaagcaagaagggacatctcccaccagagtcagatccctttagcagctttgccttatgttccatacaagacttctgccaatatctcattgaccagaacttagccacatggctatacctagtagcaaagggaggctgagaagtgcagtcttttattctgagtaccaaggtaccacctaaaaatcagggttccattattagtgggaaatggatgtcataagcagacagc

SEQ ID NO: 118201 - DNA, 575 bp, Homo sapiens
agcagtatcaggggatccccagccctatcccaggaaaagcagcacccctcaagtggcaaacagtgacctccacacccccacgcctgccttcctaagtcctgtccgtggagatggaggggcagacaggggccagttcctgggagggcagtgtgaccaggagcaaggaagcagagtgcccctggcagagccagtcgctcaacctgctccacactaactacacctcagagcgtctacaaatgggaggaggtcacaccaccctgctctgccccacctctgtccaccacagccttcctgcagaccctgtgcccttggttgtcctaaatatcccacaggaaagataatcatgatacatatgaggaaactgaggcacggggggggggggcagcttgcccagaaccacccccattctgcaccttcttttcctctttattcccacaaaagcccaggaaggaggaggcatgaacctaggagatggaggcttcgccttcactgtgtcttacggatgcaggcacggaggcatgcgaggattaagtggtttgcccgagggctccagctgagcgacacttgaacctgca

SEQ ID NO: 118202 - DNA, 362 bp, Homo sapiens
actccatgaaaggctagaagctttgccatgaacttttcagggtgaaacattaatgatggtgatctatactggaggtcacataattctcactttcctgattctcccatacacagggaataacgaaaaaatgaaattcctaaacttcaaagacatttccaactggaggccccatatacaaccaattagctggccagtgggtggcgccaaaggtttatcacggcctttgggcgaagggttcccatttggtcccgctggaaagcaattcagttatccattcagcacacatagatggctgtgtgccatgtgctgcgtcttgagacgagaaagacagagtctaatttcaattcacaccagggactaag

SEQ ID NO: 118203 - DNA, 369 bp, Homo sapiens
tttacatgaacagcctcaaggacatcattcacatgggccacccagagggcactgcaccctcctgaggtggctgcccgggcctcatctcacttccctactcccaaactcgagcatgctgttgcaccacctcttccccatccaaactcgggctgctccttgtgcaggtgctaatggagtgttaagtctcagaattcatagcattaatggtactatcaacaatatcagtacctttgataccagcagttaataccaatgatcaatcctaataatccatcatgttagctatagagctaaatggggctcattcctacatgcagaaggagatttcatccctggaagtggaggcaccaggacagagaggttttgggc

SEQ ID NO: 118204 - DNA, 235 bp, Homo sapiens
tggagagggatacatggcaagaaactgcaggtggcctccaggagctaagggaagcctctggataataaccagcaagaaaatgccgaacacagccttaaggccacaaggagatgaattccactaacatcctcagagagcttaaggcagaactttctgcagttcagcctctgataagaccaaagccccagctgacatcttaaattgcagcctactaagaccctgggcaggggaccca

SEQ ID NO: 118205 - DNA, 319 bp, Homo sapiens
catttcttgaaaattttaattctcatagctccaatgacactgcattactttggctcacccgccacatgtcaatgtttcctttttctgtgtgtgattgtagtccacctgcccacagcatcctgctctcacctgtaggctttacaccaatggtgagtctttgctttctcattttctgtatttcattcaagagttttcttcaagcttcagctatgactcttatttgccttgtgtaaaacagtatcacctcactatacaacgttaagaatatcatttaatctgagattgcttctctctcatttatttatttatttattttttt

SEQ ID NO: 118206 - DNA, 471 bp, Homo sapiens
aataaataaattattcgaacagctctattagttccatcctttaccttaaaatatagcatatttataacgttattgaaatttttcaaaatcctcagatgcaagataccttattacaatagaatgattcagccttactttaaaatgttcatggaaaaaataaaataaaatgttcatggagtatgaagatcacagtctttgaggtcagagaaactgagattcaaagaccagctctgttatttattagcagtttgacctcgattccatcatctgtaaaatgcagatgtctaccccttatagtcttacggtgaacaacagaattaagataaaaaaatttttttttgaaagagtcctgctctgttgcccaggctggaatgcagtggcacaatctcagctcactgcaacctccacttcccagttcaagcaattctcctgcctcagcctcccaagtagctgggactacaggcacgcacc

SEQ ID NO: 118207 - DNA, 634 bp, Homo sapiens
ggaggtcaaggctgcagtgagctgtgattgcaccactgcactccagcctgggtgacagagcaaaaccctgtcacaagaaacaataaataaaataaaataaaataaaataataaaataaccgttagcaagattaaccaagaagagcgaaaatccaaataacctcactaagaaacgaaacaggaaatattacaactgacaccacagaaatacaaaagatcattcaaggcaactatgaacatctttatgcacataaactagaaaacctagaagaagtggataaattcctggaaaaatacaaccctcctagcttaaatcaggaagaattagataccctgaagagaccaataacaagcagcaagattgaaatggtaatttaaaaattatcaacaaaataaagtccaggaccagacggattcacagcagaattctaccggacattcaaagaattggtgccaatccttttgacactattccacaagacagagaaagaaggaaccctccctattcattctatgaaggcagcatcaccctaataccaaaaccaggaaaggacacaactaaaaaagaatacagaccaatatccttgatgaacatagatgcaaaatccttaacaaaatactagctaaccgaatcc

SEQ ID NO: 118208 - DNA, 311 bp, Homo sapiens
taaatcagtcctggatcagttactcagactcctggtgagagtccagaggccagagcccagaacatgaaagttgggaagaaaatcagatgttggctttcgttcaggctctacctcaactcactgtatgaccttggccaagtcacttcccttctctggactttacttttttgtctgaagcagagaagagttaaaacctaggaaagaggctgggtgtgctggctcacgcctgtaatcccagcactctgggaggccgaggtgggtggatcacctgaggtcaggagtttgagaccaggctggccaacatgataaaa

SEQ ID NO: 118209 - DNA, 341 bp, Homo sapiens
attgtgtgaattcactttgacaagtccatctaggaccatgcaaaactagagttgactgtagtattagaaagccctcagggcaaggtgtggtggttcatggcctgaaatctcagcactttgggaggctggtgtgggggcatcacttgagcccagttcaagacaccacgctgggcaacatagggagaccctgtctctacaaaaaaaattaaagaattagatgggctacttggaaggctgaggttgggagatcacttaagcccaggaggtcaaggctgcattgagctgtgatcgtgccactcactgcagcctgggcaacagagcaaccttgtctcaaaaaaaaa

SEQ ID NO: 118210 - DNA, 619 bp, Homo sapiens
tctttcaaacaaacgaaaactagtaactcctgtcccaccttgttaattatgtacttcctaaaccaagccagttcttttcacatgtatggacaaacagattctattctagaaaatatctagacatgggctacaaatccacctcggcgttctttaacataaagaaggtactgtcaagcataatagaataaaaggtgcaccaatatacatagaaataacccataataatcctggttaccaagaaaccagagaggttccaggctagttggacttaatccactcaatccttaagcactcatttaattatctctctctccatcttgttccccaattctagcagagaactctcccacaacatgtgtgtacgcatacacaccacacactcaacatatgcacattcactcagactctcagataggagaaaatttgaccatcaacagctgccgtgttattaagcacacgttggaatgttctcattaaatcaagtttttaggaaagggtctctacagtattaactgattattttctcgaaacctcatgttggaatacaaactccaaagccagaagaaaaacctaaatgtttacatatccaaacggattattttatttcatcttatcttat

SEQ ID NO: 118211 - DNA, 431 bp, Homo sapiens
gctcagatccccatgtcatctaccacagttgcaacagcatccctttcccagttggtacctttggctaaaatggggctagaggaaagggttcccatacgaccagctaaaggaagaagaataatcctgagcttctctctgcaaaggatggcactgcctcctttgagagtgttgcttctgagctgacgtttcagctgtgcctttagatagctgttccagtgttctgtgaagttggctacttctaaatgattttgttgtagaagatatagctagagctcccatggtcatgagttcaatcctgcatctcctttactgtgaaatgggtcacctgttcaaatgttttttgtgtggtattctatacccatagatcagacattctttaagcccctggattatggtgctggctaaggtactacaatcaggaaagacaagcc

SEQ ID NO: 118212 - DNA, 417 bp, Homo sapiens
gtggacatatatgatgaatcattctgaaaaggatgaagagaaatacaaatgtaataattcagcagcagaggcaggactgcagaacctccccaccaattgtgaggcaggattgcagcagcctctgcgctggcctccagcctccatcctcagccctttttagtccattgtttgaaatagaaagcagacttgtttttcagaaatatttctttcagcatatgttcagctatatgacttccctaatcaggaatttgtgagatctcaccatcaccttcttcttttttttttttttttttttttttaaagaattttccccttttttcccaagggggcccccaaaattaaaattggatccccaaaagggaaactagataggaaaccccaacctgaaaaattgggagagaccagcaagagggcagc

SEQ ID NO: 118213 - DNA, 778 bp, Homo sapiens
tggtgccccgtgccttcttgacccccttattaactcttcatgtatccaaatcagaaagaatcaggtgtaacttaatatatttttaaagacatcttttaaggaactagttttgcattttcagctttggttcttcattgtaatacatgctagagatgtttgggtcctttaccagttttttccaggaattgtttcctgttattcttaatgtagtagtaaagatctacaggtaggactcaccttcctatatgtttgtctctctcttcttgccttggcatagatagccttcttttacctacctttttattttcaaaatacattttaagtgatacatgttcattttttatttttatttttatttattttatttattttttgagatggagtctcactttgtcgcccaggctggagtacagtggcacaatctcgactcattacaacctccgcctcccaggttcaagcaattctcctgcttcagtctcccgagtagctgggactacaggtgcgtgccaccacacttgactaatttttgtatttttatagagacagggtttcaccgtgttggccaggcttgtctcaaactcctgacctcaggtgatctgcccttcttgacctcccgaagtgctgggattacaggcatgagccactgtacctggtgatacatgttcatttttaaaactatataggaatgaaaaattacttgtgtctcctttaccaagagataaacattcccaacttttaaaaattcatattaaggacatacgtataaatcatagaatag

SEQ ID NO: 118214 - DNA, 566 bp, Homo sapiens
atctttgtactcccaggatgtagctgcaatgactacgtcctcaataaatatttgttaaatgaatatcaccatcttcatttaaaggatgaggaaactggctcagtgatgaggtaatttgccccaagtaacatagctactaagtattttatataaattataatgaccttatcttcgtactttacaagcatttaaaaatacatcatctcgctttaatgctcacagcaacctatgaaataggctttccgattactgttttatagataagaatggaaatttagtgatataccctaggcccactcgaatcctagtttatatgaagtacagctgtttctttacattgtacttgatcactacctgggtatgggagcctctatttttatgtaccaagtacattaagggtagggtataggggaggaaagatggaagtaaggcagtttaaaggcacaggaaagaggctggagcccaggtgtacaggcccatctaaagaccataaactggtattgtaatgtcaactgcacatgccactctgaaatccaatattggcccaaaggtttttcttgatatta

SEQ ID NO: 118215 - DNA, 597 bp, Homo sapiens
cagctttcccaacaggacaataacaaaggcaaagatctgggagaagcatggtttgatgggaggtgcattaaggagatgggatctaattagaatgcagaggctattttggagagcagtggggaggaaggccaaataaggatattaaagccaaaataggactgtacaaatcagaggagtttaaatttagtgaagaaatagagccacgtattaataagtcagaaagcctgatgaaaacattatttaagaaaaattgatttgtgaattaactcttattttacaaatttatcttaccagctttcaaatatattcttaatattttataaacatctttatttcttattttctcttgttggcttctggatctcttataggagaggaaaatattatgttcataaatgtcctcagagaatttgaaattttcctcaaaatggggtataaaactcaaagactatgtagtttgaaggctaaaagttaaaaagtagatttatcatactgcatatctcaaggtacacatctgattcttctgcctatgaccatcatacactgttggtgggtatataaattggtatgacctccacagaggacagtatgacaata

SEQ ID NO: 118216 - DNA, 341 bp, Homo sapiens
tccctcttgtgatccatcccacaaattgcttcatagtaccaaaacgctgtattctaaatgtcactcccctctccctgcttaaaaaccttcagtagttccctacggactatagaatgaactttgaacttggtctggcattcagccttccacgtgtagagttaagcatctctaacctcacatcttctgacttttgaacaaatgagacctctgcttcatataaagtctccttgtcctctgaacatgtggattcccgcttctgtctttgctcacttcactttccctacctgatgttccctctccctgcctcttgttttttaattttttttttcaaatccattttc

SEQ ID NO: 118217 - DNA, 243 bp, Homo sapiens
gattacaggcatgcgccacacgcctggctaattttgtatttttggagagatggggtttctccatgttgatcaggctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaaacaggactgcatttcatcaa

SEQ ID NO: 118218 - DNA, 403 bp, Homo sapiens
cttttgatgctctgtttttaaaaaccatctttggttttggcttgcttgtttgttttgctaccctccccacaacccttgagtaggattgttttaaaactgggtaaacagcccatgtttgcagagcttttggtgagtctcctgtgctttcccccgtgcaggggcgtgggccttgtgttgacagcctgccgtcagctgctcccttccatgttcccagcaatcggctcaacaaggtggcccagtcacaaacaagagagactggcttcaacaaaaaggagaaggtgctggctcccaaaatgtaaaagtgttggactgggctagcttcagccatggctggatccagcagctagtgagtgctggcaggatcctccgtctctgtctatctttacttttcctccctctccct

SEQ ID NO: 118219 - DNA, 803 bp, Homo sapiens
gtttgagtccagcttctttcactgacttttcttttaaaaaagcaaaacaaagcataccaagtgacatattatcagcttgtactttgtactgtgtaatataaggcagtgattttgatttgtttaaggtagagaattttaaaattttacactgcaataaaagatttctgttttgttctttctgttgctttaagcatggggaagataggcctaggggacttcctatgtggtatcggagtaactggtgaagctgctgttttgctgctctttgtaaaaaactaggctttataccagtttctctttctttttattttaagacgggctcttgctctgtcgcccaggctggagtgcagtggcacgatctcgcctcggcttactgcaacctctgcctcccaggttcaagcgattcttctgcctcagcctcccgaatggatgggactacaggtgcgcgccaacacgcctggctaatttttgtatttttagtagagacggaggggggtctcaccatattggccaggctggtctcgaactcctgaccttgtgatctgccagcctcggtctcccacaatgctggaattacaggtgtgagccactgtgcccggccaccagtttctctttcattacacactactatgaggtgtttgtctcccacttccattgtccaagaaaaatttttattgctaagattccagagtaataagttgataagtacacacatgcatatatacccccctcttatatacatatatttaataccaggaattaaatgtataatgtgtatttaagaaagtcatgttagtactgca

SEQ ID NO: 118220 - DNA, 352 bp, Homo sapiens
gcaaaggttatacaggaaatttggtttgcttttataatataaaaaattattttaagaaaagaagctattggggccgggtgcagtggctcacacctgtaatcccagcactttgggaggccgaggtgggtggatcacgaggtcaagagattgagaccatcctggccaacatggtgaaaccccgtctctactaaaaatacaaaaaattagccgggcgtggtggcaggcgcctgtagtcccagctacttgggaggctgaggcaggagaatcacttgaacccgggaggcggagcttgcagcgagccgagattgcgccaccacactccagcctggtgacagagcgagactccatctca

SEQ ID NO: 118221 - DNA, 313 bp, Homo sapiens
  misc_feature (22)..(23): n is a, c, g, or t
aagcgggtgctctagaggatcnnccgggtgcatgcatgtgggcacttcccaaagccattcccattagtacaagatgattgatttgccccgctccggggcaatgactatcttcttcctttgaagaaacttggaagcaagagcccagtcccatggaccatgagggaaggtacacaccagtgttggggagacacagcaggtggtgtccaccatgaagcagggtctgagccaagacctacatgcacacatgcacacatccacatgcatgcacacacatacatgcacacacgcacacatctgcacacagatgcacacg

SEQ ID NO: 118222 - DNA, 683 bp, Homo sapiens
atggtagtgcggaagcggaagaggctgcagggccgggaagcctctgtttggtccggccaggtcccgggatccgggccgccagctgcgatgccaagtccccggaggagcatggagggacggccgctgggcgtctccgcttcgagcagcagcagcagccccggcagcccagcccatggcggcggtggcggcggcagcaggtttgagttccagtccctgctcagcagccgcgccacggccgtggaccccacctgcgcccggctccgtgcatcggagagcccagttcaccgccgcggctccttccccctggccgcggcgggcccctcgcagtcgcccgcgcctccgctgcccgaggaggaccgcatggacttgaacccgtccttcctgggcatcgccctgcgctccctgctggccatcgacctgtggctgtccaagaagctgggggtgtgcgcgggagagagctcgtcgtggggcagcgtgcgaccccttatgaagctgctggagatctcgggacacggcatcccctggctgctgggcaccctctactgcctgtgcaggagcgacagctgggccgggcgcgaggtgctgatgaacctgctcttcgccctgctgttggacctgctgctggtggccttgatcaaagggctggtccgcaggcgccgcccggcccacaaccagatggacat

SEQ ID NO: 118223 - DNA, 572 bp, Homo sapiens
agcggataattgctgccaaaatcatcacaagctgtacgtcatcaaggctccctttgcactcccaagaagaactgttcattttaaacaaaagtgatgagaattcctccagaggtgggaacagagaaaacttcatgcttggtaaagcacctgaggcacccattacaatctgggacaagatgaggacatcaacactcatgctgtattccacatgggaggccaagtcaacgcaagatgatttttaagagatataagagccaggcgcggtagctgacacctgtaatcccagcactttgggaagctgaggtgggaggctcacttgaggccaggagatcaagaccagcctaaccaacaaagcaagaccaagaccccttctctacaaaaaaataagaaaattagcctggcgtggcggtgcacacctgtggttccagctacactagaagctgaagggggaggttcacttgagccccgagtttgaggctgcagtgagccacattagcgccaccgcactacagcctgggtgacagagcaagagcctgtctccaaaaaaataaaataaaagctataaatactgc

SEQ ID NO: 118224 - DNA, 327 bp, Homo sapiens
cctgcctcggcctcccaaagtgctgggattacaggcgtgagccaccatgcccagcctaaatgtttttatttttcatagagacggggactcgctgtgttgcccaggctggtcttgaactctagactcaagcctcccttttcagcctcccaaagtgctgggattacaggtgtgagcacgtggctggacttggctttaagagaccagctaaagaatatagtggtaggaaaataaatacaggcataactcagagatagtgtgggattagttccagactactgcaataaagcatatatggcaataaagccagtcacacgaagtttttcgttt

SEQ ID NO: 118225 - DNA, 469 bp, Homo sapiens
agcggagcgggggataaggttaccacgcccgcggtggccggggacactctgagtttcgcgtgtggcttttagggacgtttatatttgaatttccctgaaccgccgagtgtgggcggtggcgcagatccgtcccggaaacctccgggctccttcccgcctttctcaggcccggcccctccaaggggtccccgcggggcggcgggagggccctgggcccagagccgcgcgggtgggcagtcccaggcgtccttccttacagccctgagcctggtccgggaaccgcccagccgggagggccgagctgacggttgcccaagggccagattttaaatttacaggcccggcccccgaaccgccgaagcgcgctgcctgctccccattggcccatggtagtcacgtggaggcgccggggcgtgccggccatgttggggagtgcggcgccgcggcccgcgccacctccgccccccgc

SEQ ID NO: 118226 - DNA, 197 bp, Homo sapiens
catctgtttcctgatacaccaagcagctattcctccattatggtgacacaaagccccattaagttttatgtaatttttctcaggaatcaaaaaggtaagaaatcagatgtccatggaatttttatggaatacttcacataagtatgtattcattaaacaataacaaacaactaacatatgtaaatgttggcggtata

SEQ ID NO: 118227 - DNA, 669 bp, Homo sapiens
cgacagagcgagactccttctccagaaaaaaaaaaaaaaaaaaaagtataattgatattttgaaagaaaagagaaaatggaatcataatgttcaataaaaatcagaataggcagagagtggaagataaagaaacaagtgggtcaatgaatagaaaacagttataaatacagttgatattatctcagttatatgaataatcactttaaatgagaatggtctcaatacacaaattaaatgacagagactatcggagtgaacaaaaaacaagaaccaactatatgttgtttatataaagacacatggctagccacaatggctcacacttgtaatcacagcactttggaaggccaaggccgggggatcacttgaggtcaggagtttgagagcagcctgggcaacacagtgaaactctgtgtcaacaacaacaacaacaacaacaacaataacaacaacaaaaattaactgggcatggtggtgtgtgccatcccagtagtcctagttactcgggaggctgacgtgggagtattgctttagctcaagagttcaaggttgcagttagctatgatcacaccaatgcactccagcctggatgatgctgtcttaaaaatattaaaaccaaaatatggccaggagtttgagagcagcctggacaatacagcaagacccca

SEQ ID NO: 118228 - DNA, 537 bp, Homo sapiens
tgtctgtagaagcacaaacaacaggctgcattagatgctgagaaaaaactaatttttttccatctgaatcatgagctcacctcggaggtagtggccctgtttggtaagtgaagagaactgggaagagagaaccatctttagctatagcagaatctttgcctcactgtgttaatgtgtaaacctctcaacaggaacataccacctgcttgctacgtattctaaagagtaagcaatttaattcataaagaacagagatgagagttcacattagttagacaggtggagctggtagtgggccactgctaagctaaaacctggcatgagcttcgcctacagtcacatccaatttcattactgttgctagagaatcagtgagttcccagatgctagaccctagaagctctgccttgggcttttttatttcaggagttcttcaggcttcttgggtgccaacaatataatttaggaagagcaatatattcccacaatctcaatcattaacagcagtgtgtgtgtgtgtgtgtgtgtgtgtgtgtg

SEQ ID NO: 118229 - DNA, 619 bp, Homo sapiens
aaatatcctccagtgtgaataagtatctcaccatgtgacattgagcaatttacacaatgagcctcatttaaccgttcaactcatacattcagacaaaacatatctgctgtgcaacagatgctgttgtgggctctggagacaggtgaggaaccaggcagagaaggttcctgcccttgtggagcttctgctctaaggaaggcggagacagacaacaagccgatacataaatatgcaaggagaaaacgatcagtgagggacaaggactttgcaggcaactaagagagcgtggcgtggtagcagtggctgggcgtcctttagattgggtggtcagcgtccttcagagggagtactttgagctgaaacccaaaaagcatgaagcaatcagccaagaaaagctggggcaatctaaatcaaacagcagaaggttatgcctgggaaggttatgttcatctgagcgtgcttcagctaagcacgcacgaactccagacacggcaaacagtccagggaactacctgccaccatttcaaacgccgctggggaactgttcagctttcctgctttagtacttaacctgcgacaccaacacatccaatcagtaaaacacctcagtcggaatgaa

SEQ ID NO: 118230 - DNA, 270 bp, Homo sapiens
attatataatcttaaatttaagggaactgagcataaatatgttgaattagtggcttcctattagatcccagtgaactcctcttaaaacagggctcttatctgtgtagcatatgcgcagttgtgatgttgtgaaagtttgtctttacatcactctcttccctatactcaccttcagcaggccctgctttcactttggcatgctccactcacccagcagcaatttttacaatcagtaatagctctttcacgagtgcttctttctcctctggg

SEQ ID NO: 118231 - DNA, 742 bp, Homo sapiens
cggacgcgtgggtcgacggacgcgtgggctgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118232 - DNA, 934 bp, Homo sapiens
actcacttccgggaaggggcggaagaggtgggctggtggaggcggggtcgagatggcggcgcctttgaggattcagagcgactgggcgcaagccctcaggaaggatgaaggggaggcctggctgagctgtcatcccccaggtaatacccatgaattatatatgctgtgactttaaaggagaaggattaatacccttaaaagaaagcttcctactttctcctggcccagcctccttacataatagtctgcaaacatgcttgaccagtctgtactgtatggccaacaccccaactcctccattccaagggaaggccttcagattgattttccatttgaaagccacagacttattcatggagacattgttgatgcatcttaattagtcacttaccctgtgctattgtattctaagcacttctgcagcttcaactgggactttcttgatgataatttctagatctacagccccagccctgacttctccatgttcaagcagagattgatcagttgtttgctagatatttctgcttaaaggtctcactgtcaccttaagttactggacttactgaagtccaaaaccaagctaagtacatttgttgtcaagtgagttctctttcctgatttttctcatttcttaagttaccatcatttttctaggcatcagagtgaaaaacctagttacttgaccctgccatatccaggaagctcccaagtcttatcaatttttcttttgaacaacagtcttatatcattcacaggattcttttcaaattgtaaccgaggtggtaccattctaaaacaaatcaaccttccttctaaattctgtaagaaagttttgttttgctgattatctttcatttcaaatgctgctgatatattgtatttctatgagaaataaagttttggccaggcacagtggctcacacctgtaatc

SEQ ID NO: 118233 - DNA, 924 bp, Homo sapiens
gatggtcccccggtgaaccgcttacaggctttggataaaaaggagggctcaaagatttgcctgtcttatttcggtccccgtggatagactatatgaaaacgttcaatctgactttcgaggaccatacaggtgacctaaggcatgacctgagtagtctccttagttctagtccggggcttcaatgaccgcctccaccatacatggctctgctacatatgggtccttctcttggctttaatacgctgactttgcgcactgtggaccttccaaagaactagctaataccactttactcaagacctgctactgttgaagtgtacgtccccataggggctcccgggtaccaagttctattcacaccagactccatggaagtcacccaagtatcataatcccctgcgtaagttgtccagacgactggaattctactctagctcagtccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttctaccccacaggaggggtctctatacaataggatccc

SEQ ID NO: 118234 - DNA, 667 bp, Homo sapiens
actcacttccgggaaggggcggaagaggtgggctggtggaggcggggtcgagatggcggcgcctttgaggattcagagcgactgggcgcaagccctcaggtgaatccaggcccagaacagagtcagaggaggcgggtagtggatgttgctttgcgtcaaggagagccatgcctggtccagcatatcaataggggttacttcgtcaattgtcgagggatatggagggaacagggtccggaaaaagaagttcaaacccgtatggtcattctctgaaaagctatccctaggccaagggagcacatgagctgtgtgatccccgcgtcagaactagtatcagtgagttggagaaagacagggatactgggaggcaggaaggcttttggccaagcagtcatttagcaaatattgattagtcgtcagttacttccagaagtctctgtactcaccaccactttgtgtatgtgatggaacctttgtattctcctaggcccctaatgctatattaggcatactggacgatactattaaggaaatgggcgtggggcccccggcccccccctttttttttttttttttgaaggtaacttgtagattcagttttctttatgaattggagttaatgatgtcaactcttaaggaggagggtggtttttgtttctgtgtgtgt

SEQ ID NO: 118235 - DNA, 390 bp, Homo sapiens
cccgctgatgcagggtcagctggcggtcttgaggatcagagcgactgggcgcaagccctcaggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccgtggcgatcctgcggtcccagatagcctgaatcctgcccggagtggaggctgaagcctgcacagtgtccaccctgttcccactcccatctttcttccggacaatgaaataaagagttaccacccagc

SEQ ID NO: 118236 - DNA, 1788 bp, Homo sapiens
actcacttccgggaaggggcggaagaggtgggctggtggaggcggggtcgagatggcggcgcctttgaggattcagagcgactgggcgcaagccctcaggaaggatgaaggggaggcctggctgagctgtcatcccccagctgattgttaaaaagatcctggcatctcccttctctctcttacttcctctctcaccatgtgatctctgcatacactggctccccttctccttctgccatgagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118237 - DNA, 2168 bp, Homo sapiens
atcacttgaggtcaggagttgcactccagcctgggtgacagagcgagacttcatctcaaaaaaaaagggtagcataaatgctattttaccttagctcatgtacacctgataatttctttctgtgctgtcacacttgagtaggcgtagccttcttggggcactaactgttccactcccaattttgtaaatactactccactgactcttgcttagtatttaggattatggagaagcctgggcgacagagcaagactccatctcaaaaaaaaaaaaaaaaaaaaaaaaaaaaagaaaatgtattttagtcttgaaagtgtattccctttcaaattagagtttagtgctatagtgtgtatgtttgacccctccaaatctcatgttgaaatttaatcctcagtgttggaggtagggcctaatggggggtgtttgggtcatgggggcagacccctcatgaatagattaatgtcctccctggagagtgagagtgactgagttctcactctgttctttcctgagaaagctgattgttaaaaagatcctggcatctcccttctctctcttacttcctctctcaccatgtgatctctgcatacactggctccccttctccttctgccatgagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118238 - DNA, 1160 bp, Homo sapiens
actcacttccgggaaggggcggaagaggtgggctggtggaggcggggtcgagatggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtaagttgataatgatatgtagcattgttttattttcttaggcccccttcagtgattgccttagtttctccttttcttcctcatccttttctgctctgtgcctggtatttctgttttcaccatacgattaatatttactctgtacctactatgtttctattactttggaatctacaaaggaagtatatgtcatagcactgcgtttcagtaagtacaatctaatgtagaagatgagataaatgcctataaagcaggggtgtccgatcttttggcttccctgggccacattggaagacttgtcttgggccacacataaaatac

SEQ ID NO: 118239 - DNA, 1112 bp, Homo sapiens
atcacttgaggtcaggagttgcactccagcctgggtgacagagcgagacttcatctcaaaaaaaaagggtagcataaatgctattttaccttagctcatgtacacctgataatttctttctgtgctgtcacacttgagtaggcgtagccttcttggggcactaactgttccactcccaattttgtaaatactactccactgactcttgcttagtatttaggattatggagaagcctgggcgacagagcaagactccatctcaaaaaaaaaaaaaaaaaaaaaaaaaaaaagaaaatgtattttagtcttgaaagtgtattccctttcaaattagagtttagtgctatagtgtgtatgtttgacccctccaaatctcatgttgaaatttaatcctcagtgttggaggtagggcctaatggggggtgtttgggtcatgggggcagacccctcatgaatagattaatgtcctccctggagagtgagagtgactgagttctcactctgttctttcctgagaaagctgattgttaaaaagatcctggcatctcccttctctctcttacttcctctctcaccatgtgatctctgcatacactggctccccttctccttctgccatgagtggaagcagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcagggtaaaggatttggatgtacttttagtaaaccagttttgttaaatgtttacaaggacctcagtactaaagcctgttctctggaggaaataaagaaaatatgtttggaggtgcctgaaaaaaagaacttg

SEQ ID NO: 118240 - DNA, 514 bp, Homo sapiens
cctgtaatcccagctgcttgggaggctgaggcaggagaattgcttgaacctgggaggtggaggttgcagtttgctgagatcatgccattgtactctagcctgggcaaaaagaacgaaactctgtctcaaaaaacaaaaaaaaagttggcccacgtaataagatctatttgccattctgggtctttggaccatcttctttacactagtgatctacagaagcaaataaaaatactgagtttttaaactctggatgcagttttctcttagttatatgaattttctttctgcctttcaggtgatggaagctgttttattgtccagcaagacttagactatgtcactgagctcactggggctgactgtgaccctgtgtacaaggtacaggcctgagacgacaccagacctgggtgattctcatgagagatctagggcttttatgagactgaatccagataccttgtggtcattagggatgataaaatagtgcttattgtataagcagtgtggtaggatg

SEQ ID NO: 118241 - DNA, 1617 bp, Homo sapiens
actcacttccgggaaggggcggaagaggtgggctggtggaggcggggtcgagatggcggcgcctttgaggattcagagcgactgggcgcaagccctcaggaaggatgaaggggaggcctggctgagctgtcatcccccagggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118242 - DNA, 633 bp, Homo sapiens
gtacctgttcagaacatgtttgtgaagggatggagtcatttatgcagctccatcttctctgcccttgtagttcctttactccatcctccatcttagggagtttttttctcttgctaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtaagttgataatgatatgtagcattgttttattttcttaggcccccttcagtgattgccttagtttctccttttcttcctcatccttttctgctctgtgcctggtatttctgttttcaccatacgattaatatttactctgtacctactatgtttctattactttggaatctacaaaggaagtatatgtcatagcactgcgtttcagtaagtacaatctaatgtagaagatgagataaatgcctataaagcaggggtgtccgatcttttggcttccctgggccacattggaagacttgtcttgggccacacataaaatac

SEQ ID NO: 118243 - DNA, 1677 bp, Homo sapiens
actcacttccgggaaggggcggaagaggtgggctggtggaggcggggtcgagatggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118244 - DNA, 1578 bp, Homo sapiens
cccgctgatgcagggtcagctggcggtcttgaggatcagagcgactgggcgcaagccctcaggaaggatgaaggggaggctggctgagctgtcatcccccaggaaaccatctttgtatggcagcctgacttgtcaaggaattggcctagatggcatcccagaggttacagcttcagaaggatttactgtgaatgaaataaacaagaaaagcattcatatttcatgtccaaaggaaaatgcatcttctaagtttttggcaccatatactactttttccagaattcatacaaagagtataacatgcctggacatttccagcagaggaggtcttggtgtgtcttctagtactgacgggaccatgaaaatctggcaggcttccaatggagaactcaggagagtattggaaggacatgtgtttgatgtgaattgttgcaggtttttcccatcaggccttgtggtcctgagtgggggaatggatgcccagctgaagatatggtcagctgaagatgctagctgcgtggtgaccttcaaaggtcacaaaggaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118245 - DNA, 1150 bp, Homo sapiens
gtacctgttcagaacatgtttgtgaagggatggagtcatttatgcagctccatcttctctgcccttgtagttcctttactccatcctccatcttagggagtttttttctcttgctaggtatcctggatacagccatcgttgatcgggggaggaatgtggtgtctgcttctcgagatgggacagcacgactttgggattgtgggcgctcagcctgcttgggagtccttgcagattgtggttcttctatcaatggagtggcggtgggtgctgctgacaactccataaaccttggctcccctgagcagatgcccagtgaacgggaggttggaacagaggccaaaatgctgctcttggcccgggaagataagaaacttcagtgcttgggactacagagcaggcagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaaaaaaagaacttg

SEQ ID NO: 118246 - DNA, 586 bp, Homo sapiens
tagagatggagttccgctatgttggtcaggctggtctccaaatcctggcctcaagtggtccaccctccttggcctcccaaagtgctggaatttcaggcgcgaactacgcgcctggcctcttttccactttaaatggaatgataaaactaaaaatgaaaaggacgggagagaaagagtctttttgaaataatatttgacaggatttattaagaagatcacaatagtagctaataacaataaatactatttgagtgctcattatgcaccaggtacttttctagatatttgacatatttaatttagtgtattttcagttcattttcctaacttatgagatagatattatttttacaaccattatactagtgaagagatcaaggttcaaataacttgcccaaagttatataagaataaagtaacggaaccactgtaactccaatgattccaaagctcttggggaaatgaaaggactctcagagaaggagagcattacattggtggaatgcctgcatttgggttttttacatagaatcaacatggcagacggtacagaaaagccacggaagggtgggagtctttggctata

SEQ ID NO: 118247 - DNA, 692 bp, Homo sapiens
gagccagtgtaaatctagtccaagggcaggggaagatgagatgagatgtcccaactctagcagtggggcggaaaatagaggccagttccttcctccttcaccttttgttctattgaggccctcagggaattggatgatggctacccacatgggaagggctgcttctttgcagttcacgaattcaaatgctagtcatccagaaggacccttactgacgtaccaagaaactgtattttatctgggcaccctgtggcccagacaagtagacacataaagtgagtcatcacagcaagtatgacaatgccgtgtactggaggcagtgtgtggatgtgcagccactttgcattccatatgacctggcaactgacttctgactgatgtgacttaaaaacagagatcccctggctggggctgggatgtttctaggcctcaggaggtgcacacatctgtctaatacataaagggtctgtctaatacataacgtgtaccctgtcataaaactcttcaggctgaactggaggttccagttctctttctcttcatagttgcctcttccacaatggaaagttattcctgatctttgctttgttgctacagggaggggaaaaaagcctatgaattgccaaaaaagaggcctttaaaatattaatgttgagaatttcagctgagattcttattctggcagtttctgg

SEQ ID NO: 118248 - DNA, 117 bp, Homo sapiens
gagggctctgaagtactgggtggccatataccagcagcacagtgaatcttctagctgtcactaatgtgcttagctcataggattgtcaggaaggtccaatgtgatatgagtatatgt

SEQ ID NO: 118249 - DNA, 786 bp, Homo sapiens
atccagacaggtcgacgtagctggtcagtaaattagctggtccaggcgaagctggggccattttggtacagcaaatttctgtactcctcaggggctattattggttttcttactcacatattccctggagactaagtagcactgctttttgcctacaagcctaaattgtcaggtactgacattaagaacagggaagctggaaagaggtactgacctttaagtcacattcctgttaaatacaataataatatcctctcacaaagtgaaggatctttttaaatcatccccttcttcatttcatatgttgctattcctacacaggtatatgatttaaaaagctgtctattactgacatacatatgcatgagaaatacaagccttaacaaatgaatcctttagcatcataaatgcttacccagtaatgtctacaattagaccatattcttcttcagccattttctcaaaatgtaaagccagttgtactaggtacgtaagtaccacacccagccagtctagttataatgagttttcctatgatagaaggcatttcctcaaacttcagctttattttatctgcatgtgggttgcatttaagaaaggaaatttatttctcacattcaatcatatatactgcaagtaagcatctgaagaatacaaggcttccataatccaaacaaaaataattttgtatttaaatctgattcatacagccagagatcagttactcagaatggatcagaaacactgggcctgtgctaaaacatacacaatttaaataaaagccag

SEQ ID NO: 118250 - DNA, 333 bp, Homo sapiens
gcaggacccacccacctcagttcaaaccaggcagcaccaccgtggcacactaggggtcagcagtgtgccccgggtaggccgccacggccacagagtacgctccttaatttgggagctagtcacacgggtttgctcgtcatatgaaaattcatcaacagcacatctaaagaagtgtgtacacatttttgtatgtcaaacttcaatgtttattatatatataatctatatagatctatatctatatctatctagatatagatatagatatatatttttgtttgtttgagacagagtctcactctgttgcccaggctggagtgcagtggcgcgatc

SEQ ID NO: 118251 - DNA, 247 bp, Homo sapiens
ctcatattctgaatatataagcatctatagttcagtaagaaaaagacagttttttaaacagcaaaagacttccggcactacataaaacagggtgtccaggtgattaataagcatatgtaaaggtacacaacctcattaattatcaaagaaattcaaattaaaacccaagtgcaataccactatgcacctaccaaaatatcttacgtgaaaaagacaaaaatactaaggttgctgaggaggcaaagta

SEQ ID NO: 118252 - DNA, 544 bp, Homo sapiens
ctcggctctaccttgtctgagacaaggtcttactctgtcactctagcctggacgacagagtgagactccgtctgaaaaaaaaaaaaaattaaccgggcgtggtgacagacgcctgtaatcccagctacttgagaggctgaggcaggagaatcacttgaacctgggagatagaggttgcagtgagccaaaacggtgccactgcactccagcctgggcaacagagcgagactccatctcaacaacaacaacaacaaaaattactcatagaacattttccaggtcaggaaagatgagaagagctggatagacctttccagatgtaagacccccaaacctaaatatgccgggtacgtttaaggcccctttaaggtggataactccccctctgccctcagcccagaaaagcttgtttccaataggccttggctggagggtggggaaatgtcccatccttcacggaatgtgtgggattgtgggtcagttccatggggtacctgcttgccccagccaccagtgagtacccactggagacaggaaaaaaaaa

SEQ ID NO: 118253 - DNA, 438 bp, Homo sapiens
gtccattatacatggagtggctgattgaaggtatttctacatactgacttgaaagttctatcctttcattaaaggttcttctacatattgacctgaaagacaggttcctccatcagtcctcctgtcatcctaattgtgactctagctgacttttatttccatttctgcatggttgtcttaatactacttgtacatattatgttctctctaggccttcttttctaagccatttctcaaattttatttgcagtccactggtaatccacctagctacttaagaaaaataaaatattagccctcttttggtttgaacaattaagtattacctactagaaacctctaagagatttattaaaacttgctaaaatttggcacttagtacattcaacacagtaagtctgtactagagacttgctcttgagtgggggtaggagtggg

SEQ ID NO: 118254 - DNA, 787 bp, Homo sapiens
tgctctgggaaacgcctgctgctcttgcccttgcccacgggcccccagccccagcccctctcctgtggcccaccacccctgctttggtgccatgcagctgccacccttcgacatgtggaaggactacttcaacctgagccaggtggtgtgggcgctgatcgcaagtcggggtcaaaggctggagacccaagagattgaggagccaagtcccgggcctccgctggggcaggatcaggggctgggggcgccaggggccaacgggggcctggggaccctgtgcaacttctgcaagcacaacggggagtcccgccacgtctactcctcacaccagctgaagacaccggatggcgtggtggtgtgtcccatcctgaggcactacgtgtgtcccgtgtgcggggccaccggtgaccaggcccatacgctcaagtactgcccgcttaacggtggccagcagtccctctaccgccgcagcgggcgcaactcggccggacgcagggtcaagcgctgagcatcgtgagatgctcaccacccgacccctgaccctcctggtccatcccacccaagtccctaaactctctcttccagtcacccagccctttggaatttctggcccccagaactccaccctggctggatcctgaaacagtggaggctgctgggagccaggccagccccgcccccttggacctgtcagccctcggagctctggcctgtgggcgttggcctgagggtccttggtgccgcgggaacccttcctgcacggccctgtagcgccctctgggccccg

SEQ ID NO: 118255 - DNA, 587 bp, Homo sapiens
gcacgaggagggcttacttggaaatggtatgtttcccaaagatatatcagagaacaccataactactatgacactttatgggtggtataatcatctccctaaaccagacctctgaagatttggttgggggcagaatgaatgatctctatcaaaataagcagctgaatgtcatggattttgctcttgggtgttagttttgaagtcagggattgttttgccaacactccacttttgagctacaggggcagtgatttaattgcaaatttgattctcctatcactgaaaacagtgtctgttatttgagtcacatacttagactgaggaagccatgtatcttccacgtttctgcgtgtttctgatatgaaaaatgactcactgataatgcatatttacagctcttttttacattctaagactgtaatattgaccttagtttcattaaaggatatctgcatatccatcagtaattttctatatctctacattttcctgaatgtaagactatgcctgtgaaaatagtggctaaaggagtatcccctagaatttcagttgttacctagccatttcaaactagacctaagaaagaa

SEQ ID NO: 118256 - DNA, 420 bp, Homo sapiens
tgaggctacaggagcaggaaggagccaggtcaggaagggcctttcgtaccactcagagtttgagttttattttgaaggtaacatggcgtcacattaagcaatgttgaaagaattaccctatgaaattgtacttcaaaactaaagtaccaaatacatgatcccgagttattaataaattccttattttaaagtgtaaatatttgaaacagtatctgagaccacatgcaattgttaaatactgtcaactagttgcatacaagattgtagcgttctgtaatccctaggacagtgtttgattgaccggggaccctcaagagagcatggcgagtgtggggtgtgcctggataggccccctttgcaggcagtcttttgagagtctcaccatcgaatggcctcctagggcgtgtgaacgttattgtt

SEQ ID NO: 118257 - DNA, 443 bp, Homo sapiens
tgaatgaatgatctggggagtggcgtgggcatcaggatttttaaaagctcccagaggactctaggtgcagccaaagttgaataccactggccacagggtctctgtcagttgaaacacagcttgtgaaataaaatgctttctacaagtggtaaataataaaggccctaaaatccattctcaacatcctgcatgtacatttcaagtggaggcatttctgaaggaaatgttaagttccctgtgattgccaatagggtaaaaagccatcatttgcactgaccaggtcccacggacagtaaaagccacaaagacatacagggtttggcatgaggaagcttgtgcacttggcagttaagtctgtgaggctgcagctgtcacagtgggtttgcaggggagtcctgcaaacccactgtgatcaggtggttatcaggtgattgaaatgtggc

SEQ ID NO: 118258 - DNA, 197 bp, Homo sapiens
ccgccagggacattacagttgatactaagggaggaaggaagggatggaggataagtgcaggcagctgcttcacctctgctgttccagggagccccaattccacacaccccaacaccacagccccctcctaccatctaccctgagaactgctagagcccctccaccccataataggaacctccacagtggagcagccc

SEQ ID NO: 118259 - DNA, 306 bp, Homo sapiens
tcagaatgtggcctttgggaaggacgatgttgaaggggaagaactccttccactgaatgccgctgctgtctatgctaaaacatggggagatgggccgggcacggtggctcacgcctgtaatcccagcactgtgggaggccgaggcgggcagatcatggggtcaggagttcgagaccagcctgaccaacatggtgaaaccccatctctactaaaaaaaaaaaatacaaaaattagctgggtgtggtggcgcgtgcctgtaatcccagctactcagggggccaaggcaagagaatcacttgaacccag

SEQ ID NO: 118260 - DNA, 218 bp, Homo sapiens
cttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtg

SEQ ID NO: 118261 - DNA, 414 bp, Homo sapiens
  misc_feature (65)..(66): n is a, c, g, or t
ctaaaaaatacaaaaattagccaggtgtggtggcaggtacctgtaattccagctactcaggaggnnagagacatgagaatcgcttggacccaggaggcagaggctgcaatgagccgagttcgcgccactgcactccagcctgggcgacagagcaagactctgtctcaaaaaaaaattttagcgatgtcaattcatttttaaagtgggggcttaagggtttggtctggtttggtttggttttgccatgctggccaggctgggcttcgaactcctgaccccaagtgatccacccacttcggccccccaaagcgctgggattacaggtgtgagccagcatgaccggctgctaaaatttcttaggaaaaaaacctttaaaggtagacatgctggaatccttgaactcttcatttcatt

SEQ ID NO: 118262 - DNA, 319 bp, Homo sapiens
ttggttgtaggttgcaaatatcaataaacatagttaagagttttatttttcttgtattttttagagacagggtctctctctgtcacccaggctggagtacagtggcacaatcatagcccactgcagcctcaaacttctggactcaaccaattctctgacctcagcctcctgagcagctagaactacaagcatgtgccatcatgcctggctaatttttatttatgtgtagaaacgtggtctcactatgttgcccaggctcaaacttctggtctcaagagatcctcttgccttggcctcccaaaatgctgggatttgtttt

SEQ ID NO: 118263 - DNA, 324 bp, Homo sapiens
tcacacttctctggcctctgccttttcactctccctctcacgtgctgcggcacagacccacagaggctgctgggcgcatggtgtcgcaagagcaggagggcaggagaggagaatcctgctggaggaatctaaaacatcactcagcactaaattgtttttgtctgggacaaactagtttccgtaaagatgtgatttatgataacatgtaatgggattattattcttttaaaataaatttggctacagtggctcaggcctgtaagcccagcactttgggaggccaagatgggtggatcgcttgagaccaggagttcgagaccagcc

SEQ ID NO: 118264 - DNA, 441 bp, Homo sapiens
ggatgtgatgtgttttgaagacataagaggcaggaaagtttggttgccaaaaataaagagaaacagggaagaatttagcttctgaactggatggtcactcttgccagaggccttggaggagggcaaggttttgcattttgtttgccaattttttccttaaataaagtgccctggacttcaggtcagtcttgccccttgagctgctaaatgattctgccagattctttcagctgagctgtgcggggtcctgaagacctgctttgacttcctctgcaccaaactgactcactccccagggaacaagatcaaggctgaggaagagaaaaagcagggcatgaatggaccctatacccaaaatagtaattccattttctccacctgccattctaccatcacagtgaagcttttctaaattgtaagaggctcttgtaaaaatgaagc

SEQ ID NO: 118265 - DNA, 412 bp, Homo sapiens
tggatgtggtagtgtggtaaagcaggacaggagagggatatttgaaacctcacttaaacctgcttgcagaaggagtcacacatgcaaacatgcacacacacggagtccctctcagatcgctctagagcctcatccaaattcacaaattatgtctcagctaatactttccgtcttggcacaacaaagcgcaaggttcttctgttaggagcttgcatttaaagatggggaagagagtcctcccattgccgcatggattgttttctccctttagtttagttgtggatataggatttatctttgggataactgcagccatgattgatgcccatgactattccagaggtctggcctctagagagttctggctttccagggtccatacataatacatgagtaatctaatgtctgagcc

SEQ ID NO: 118266 - DNA, 542 bp, Homo sapiens
aatagacaaccttatacaaatcattctgaagtttcacatttcttcaatttaaatttatgacattcaactattttgaagtggtcctcaaaagtactatataagaaacatgttgcctggcgcggtggctcatgcctgtaatcccagcactttgggaggccaaggtgggtggatcatgaggtcaagagatggagaccatcctggccaacatgatgaaaccctgtctctactaaaaatacaaaaaaaacaattagctgggcatggtggcatatgcctgtagtcccagctactcaggaggctgaggctggagaactgattgagcctggcaggttgaggctgcagtgagccaaggtcacaccacttgcattccagcctgagcgacagagcaagactctgtctctaaaaaaaaaaaaaaaaaaaagccaaactaacagaccctcaaaagtgacattttgaggctatgcaaaggccatatataggaacccttaaatggcgacagcctccccactgtgtcagcctgacatacaatacccgtcttttcccta

SEQ ID NO: 118267 - DNA, 723 bp, Homo sapiens
atccaggtacaagtggagtcattcagttaaacccatgttattaagggtcagctgtacctatatatgtcatttgagtgtaatggttaagaggatgggactgaattccaaatcctggctttgccatttattagtgtctgtgggcacaatccttaatctgtcttaaatttctggtctgtaaaatggagatgataaaagtgcctactttatatgggtataggaatccaagctcataatgtgtgattagctcttatcagactgcatgggacatattaaatagtaaataactatttaataatctgtagaatattactagtttgacatcaactttactaatatttagtatttaactcacccattgtttacttctatatagacagtcgggatacttgcccttttaagttttgttgttgttgttgttgttgttgtttttaaaacattcttcagatgcttttacattgatcaaaaatcactgatgctgaccggaactcaaagtgataagctacttgctaactatcaatatcaatgttttcattatgatatttctctttggagaagaccagtgtaaaagaggagttgatcagtattcctttcctgtcaactgaccttcatgttgtactctcttcctcaggcttcatctttcttaatttaaaaattcatgtttgtctgtagtaattacaaaaattcattataggatttccaagttctaatagttgctttctagat

SEQ ID NO: 118268 - DNA, 230 bp, Homo sapiens
ttcggcacgaggtaaatgttataactagtcactgatgggcacaaacctcaaatccctttcactgctaggttgtcagtgaagcagagatagatatttgtggtttgtgcccatcagtaactaattagagaagtaaatgttataactagtcagtattctgtggctacaatgtggcaagttaaaataatatccttaaggtgggcgctaacgcaatatgactggtatccttatga

SEQ ID NO: 118269 - DNA, 354 bp, Homo sapiens
tttaagagatagaaccttacttagtcacccatagttcatgtaacctcaaactcctggactcaagtgatcctctgtcacttcagcctccaccatgcctaattaaaaaaaaaaaaatttctaaagatagggtcttgctatgctacccaggctgactgtgtactaattggatgatgtctattattattggtttactacagttgttaatattatgcaaaatatctttgatcgataaagagcttctcctggtcctttgggcatggctttctgaggggaagacgacctctgggatgctcaccctgccctcttcccctctcatccccatctgtcccctctgccaccatgaggaacattttc

SEQ ID NO: 118270 - DNA, 365 bp, Homo sapiens
tgttctgtatgaacttgagaactgtaatctgctgttgttgaaataatgtatagatgtcaattatacccagttgattgatggtgctattgagttccatcatgtccttactgattttctacctgctggatttcaccatttctgatggaggggtgttgaagtttccaactataatagtagattcatctattctcccttgcagttctatcagtttttgcctcatgtattttgacactgttattaggcaaatacacattaaggattgttatgtcttcttggaatatttcttcctttatcattatgtaatacctctctttagccttgataacttttcttgttatgaagcctgctctatctgcaattaatac

SEQ ID NO: 118271 - DNA, 264 bp, Homo sapiens
ctgggaccaaaccataagaaagattacaccactcagtatacattctgcaaccagtggagccagacttaaaaacaatctgtcaacttcactcttccatcctcatttaaaagagtaacttgcactttacctttaaaatgtgctatccaatcatcagtaccaatccagtgaccacttactaatgcagtgttactttaaccaacctagggctactagtgggcattttcaatctctccagctctactccacgctagatataagaaaccc

SEQ ID NO: 118272 - DNA, 470 bp, Homo sapiens
acaaagaagttctgtgttgtctgtcgacttttcttgtggaattgtttccttctttttccagaatttttaaatatatttttctttatatttgaccttttttctcttattaaaatgaagacttggtagtagtaatccatgacccattaaaatttatgtattacattttcctcaagaactctagtattgtggtggctttgttccttcttatgtccctgtgtgagttgtatcacccagtaacctaccatagtgggtagccttgtgaaaaatccacaaaaataccaactgggaccttattcatgaaaaatgtgtcttaaatgataaggaatgaacagctccaaaatgcttactattcattggaaatttattcacaattcttgggaaaccaatcttcaaatactataaaaatgaatgttctagaggttttaagtacagggacttgtctgtagggggtcagggctggcaatgcaaat

SEQ ID NO: 118273 - DNA, 568 bp, Homo sapiens
tgaaatgagtgatgagatacatatacatatacacacacatatatttgtgttgctaagtataccattttatatatatatatatatttatacatagttttacgtacacacactaaactgacaggttattcttttctagatgggagagaacaagacctttgtaatggaaaatggtggttcctgtctaatccattttaaagcagaatgaatgtgtctggcacagtggttctcaaaatgtggttttcaaaccagcagcatcagcattttatcaaaatgcaaatactcaagcttcagtcagaaactctaggggtagagcccccaccaatctttagtttatccagctctccaggtgtttccaatatatgttaaccactagttgtagagaaccactacaactagtattcaatagtggttcaatagtggttcaatagtgtattgaaccactagttgtagagaaagttccagagagactattgagcagaaagctaactatctagaaatggattttgtttgtttgtttgtgtttgcagtgaaagtctcagcatggatcctagggtctttaacacttctg

SEQ ID NO: 118274 - DNA, 408 bp, Homo sapiens
ccaagtcgcacatcccaaatgagcaggtcttctggtgggactgaggaaggaaccaaggtaagaataggagctcaacaattacctagatagagtctccacagcccagacaagccaggactagagaagtagacttcagaaatccctggaatttctggcttttgggaagaccttgtaacagatcactgtattttgtctgcctaccctcctcacttccttttcccattttgtctggtaacaggatcttccttcctaaggaaaatccactggatgtggttcagtagggctcacactgctccgtcatcttctcgaactccagacctcaggtgatccacccacctcggcctctcaaagtattgggattacaggggtgagccactgcacccggccggctcagtcatcttctcccta

SEQ ID NO: 118275 - DNA, 305 bp, Homo sapiens
tcaccctagggctccgagccaccacgcccctctgcctttcccgagggatgctggtgcttgtgacttgtccagcagggaggtgggtttctgactgcccctctctgaccctgactcttagatgccaggtccagggcagctgtgctcacagacgctgcattctctgtgcgtccggcggaggagatgatgggacggggaactctcgctgccgcccaccccataaagtgtaaccggtctcttccttgcacctgatcaagacatgtaacgttcaacttgtgcaaggcgtaagtgtcctcacagtaaaccat

SEQ ID NO: 118276 - DNA, 511 bp, Homo sapiens
tttaagggccgtagacttaaaaacttgaaaaaaagaaacaaaatacgaaatcaaagtttgattagatatactaacaaacaaaaaagaagtgtatcctggataaatcaagacatctgctaatgcaaaaaggttaaaaaaaaaaaaaagaaagaaatgcatgataagcttagaacactttatatggagaatttttaagtacaccctggcaaatttacctttgtgattttacttcataaaaaagaaattgaacttaacttagtttgtatttttgtgtcacagaatgacacttcatatgacacaaaatcagtcgtctggagtcccaagatctgtgttctagccatatctgatttttatctagctctatgaaaacacacacacacaaagctgatgttctacatgagttcaataatattcaaggctacttagctgtgagaaggcgagcacctttcattaatgcttctatagtagaaaaaatgtggtattctttaagggccgtagacttaaaaacttg

SEQ ID NO: 118277 - DNA, 398 bp, Homo sapiens
cagcttctgaggcttccggttcccccaaatccttgcccacactcaagataatcagtcttcaatatgagccatttaaataagtgtttagtggcatattggtgcagtttaaatttgtattttgcaatggctgatgatgttaagcattttacacatgcttatttccatccacatatcctcttggctaaagggtttctgaaaatccctgacatatttttgattgggttacttggtttctactgagttgagagtttttcataaatgtctttatcagctatatatttgcaaagtttcttccagtctataggggtatatagtctataaataaatcttttttttttttttttttgagacccagtctcgctctgtcacccaggctggagtgcagtggcccaatctcg

SEQ ID NO: 118278 - DNA, 322 bp, Homo sapiens
agattgtaccacttcactccagcctgggtgacagagcgagactctgtctcaaaaaaaaaccaaacaaaaccctcccaaaaaacccaaaatatataaattagtgctattaagtgcagtgaaaattgaaccagggcaagagaggatgccaagagaggatgatttcctctgtagaaccaggcaaagcaaaggaagaagctttctctcaagaaagtgacacaccccgaggacaaaaccagtaatccccatgcatggatggcaaagttggatatatgtatgttgggctccctgagtggcaggagaggtggggctgagttgcaaactg

SEQ ID NO: 118279 - DNA, 418 bp, Homo sapiens
tgtgacttagaatggttaactatctgggaatgcaggccagtagatctcagccctgttttacccaggccctattcaaaatggatttgctttggttcaatatgcctctgacattttccccctctattattattgttatttttttaaacaaggaaacccttaatcctaagggttgtagtgggacgaagatcaatcttctgttactacttcatgctgaatagaggtgatgatattcttgcctattagcgtcttttgtatttgaggtagagaggagctcaatcagaaagcatcagtttgatgacggccattcctaactcccagttccaacaataggtgatatctggaagattaataagtgttcactttaagaaaacacccagtaagtttattctgcatttctacacaaggagtagaatggcaa

SEQ ID NO: 118280 - DNA, 656 bp, Homo sapiens
atccttacaagacagaggcaagcagagaaggcatagcagcagcgaccggcgctctgttttcattttccactctggccaggggataaactggaccccagtggactccaacaccaactctctgcttcccagttactttcgattttctttcccttctccttctttctctccctctctggcattcaaacagaagcacaagaggacccaccagtggcaactctaagcctccttgcaggccacattccctgctgacgtggtccttcctgcaggagagcccttctgtgattatctaataatagccagggtggctgagaatagaatctggctcaaggactctgcacacccggggcagagacactgaatctgtgggtcagggcctggcaacattccttggagcctccccctctgagcccactctttgggcacccttaggcttgcctgccccccttataaggggctttgtcagccctgccatccgctgtatttcatgtgctggttcctagctaaggagaattgggcagagcaaaccctttctcaccctggtctgacagttgtgatcccgacagaatgcgaccttgtttggagaaggcgaccttgttgggttggctgtgttctgaaaccaggcttgggagtgttatatatttattatatacaggctt

SEQ ID NO: 118281 - DNA, 523 bp, Homo sapiens
tgcaacagggtctcactctgttgctcaggctggagtgtggtggcactatcacagctcactgcagcctcaacctcccaggttcaagcaatcctcccacctcagcctcctatgtagctagaattacaggcatgcgccaccacgtccaactaatttttaaatttcttgtgttgggtcttgccgtgttgcccaggctggtcttgaactactcctgggctcaagtgatcctccctcctcagccttccaaagtgctggaattacagacattaggcaccacaagaatgatctgcatcttggttatggttgtggttgtatgggtgtatacataacttaaaactcatcaaactgtacattttaaataggtacagttgattgtatgaatagatatacagcataccctactaaagttgttattaaaaaaatcattagatgagatttagagcagattagaagcagcaaaatagtggatttatgaatgggaaaacaggcagcagtaagtattcagatgaaagtacagaaagaaaag

SEQ ID NO: 118282 - DNA, 269 bp, Homo sapiens
cccctggctctgaacttagtactggctgaacttagggaaattgttatgcacttattttttctgttaggaagttggctcaagagttgcttatgtgctatcagggagcagggacatggaataatgattttttaaaagctttaccttgatgtctatgtctctacattagacaattgtatgttcaggggatagaaggaacagttgcaatgatcagcgtctcaccctgggcagctgttgattttgtaattaatgtagttcaaaagaagcctttc

SEQ ID NO: 118283 - DNA, 610 bp, Homo sapiens
ccctgccagtaaagattatttatttactttccacagggagttaagagtggtgggcggtttggggatagcaccaggagatatcagctgtgatggcttggagaaacagtgtaaaccggcagtgtaaacaagagcagggcatgtatgagtagttgagaacggtgaataggattatgactagacagaagatagtagggatgacaagtttttggggcacagcccaagttgggctggtgtctggaatgagacgggggcctaataaaaaggagtgtctatacaggagctcaaatgggctgtaacctgtagcattccgaggacaggcccgaattttgagaagggaaagtggtaaaagtattgtctagtcattttttagttggtggctgagcttggtgaggtgcgtttttaaaagaccattagtccattctaccttttctgaagattgaggatggtaagaggtatgagggtttcactgaataccaagagcctgagaaactgcttgggtgatttaactagtaaaggccggtccgttattggactgtatagaggtgggaaggccaaaccaaggaattatgtcttacagaaaggaagaaatgaccgcagtagccttttcaga

SEQ ID NO: 118284 - DNA, 342 bp, Homo sapiens
tgaggtcagttgggtagggttttggccagcagaggggtgaagcatggatgtttccaggaatggtggggaggtgcaggagctatctgggggacaggagatgatctgaagtggccgggccaggcagagagggaaccaagaggtcctctgaggctggttgggccaggccttgaacattcttaaagcgctgacttgtgtcccatggaaacaagactcccttgaaatggggaggggagacgtgcagggttggggagctaactgggggtttggagtgttagggagagctcagatgagctgaccccaaaggcctacgctggccagcacacgagagagattccatctcac

SEQ ID NO: 118285 - DNA, 248 bp, Homo sapiens
ttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggc

SEQ ID NO: 118286 - DNA, 744 bp, Homo sapiens
gctctctgatcctcccaggtagggctggcagactctatgtaatcccagggacaccctgtagaatatctcttgcctccccttgctgagataagccatgtccctctctcctctgctttgtgcagtgctgggtcactgtttgctcccccatgcattggtgtcatctgtcactcagtgctctatgctcaaagtagtagttacagggtgcgtagtgatcactagctgagctctactggaaacactggactctcctaataaactaataaactgagttaaaaaatacattaaagccacagctgaaaaagataatttttaaaaaggattgcttctgatctcttggatttctgggactaactcttacataggagtctaacccagttagcaaatagtgtattcaataaatggagtgaaacacataaatgttcttccgaatttagctgcttgctcttcaacctctgtctcaaatctcaagactatgtacagaaaaagggcaagggtcaaggagagctgaggaaggctaacataagtttgatgtcaggagtgtatgtgtgatgcacgggatttcatggtcatgcatagatagcacacgatgggacaatttccacacggcctttgaaaacaggaaggtctcgtacattggcttagatcgagagcttctacaagctctcacatgtcgacaacccaaatacctggggactcctaggtccacatgccagattctcggaatctagacatacatggcaacgg

SEQ ID NO: 118287 - DNA, 423 bp, Homo sapiens
ttccactgcccttggaataaagactaatccccttgatgttgcttaggaaacgctacatagtatctttgcttttctagttacataactggctactttcctccctgttctctatgctcctgcaatttaacgtgtgtcttgctttctttgctcttgcacatgctgctctctcttgcctggcactgtttcatctaatttccttggctcattcctactcctttaggtccccactcagccatcatcactttctctaggaagtctcaacctcaggtctatggtaagcagctgattgtgaagctcataaagcacccaaattcctttatttctcatctcacgctatgaaataatagcttgtctaatgattaactttctctcctttgaggtcactagattgttgtgtccccagcccctagcacaattcctgga

SEQ ID NO: 118288 - DNA, 610 bp, Homo sapiens
aagaatcctttggcagcctctcttggtttgtcagtgcagtataaggcaaatagaccttcatttttagacaatggtgtggaagttaccatcttgcatacaaagcccagggacccagcctactgtcaggaaagatggaggtcacctgattatgatctgcaggtagagaaagcatcaaaggctgaaggagaacttgtgtgacagtcaggagagtcagactgaagtctcaatatagggatagagggttcttcagagacacagcaccaataggatgtgtgcgtgtgtgtgtgtgtgtgtgtgcgtgtgtgcatgcagagagagagagagagagatttattttgaagaactaactgacacaatcacaattatggaggctggcaaatccaaaatctgctgggtgggcctgcaggctggagacccagggaagagccaatgttgcagtttgaatctgaagaccatctgttgtcactactccctcttgcttaatggggaggttaattttgtgttctattcaggccttcaactgattggacgaggctcactctcattatagatggcaacatgctttactcaaagtccaccaacttagatgtcaacatcatccccaaacacc

SEQ ID NO: 118289 - DNA, 422 bp, Homo sapiens
agaggatccccccggctcgggtataggcctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagc

SEQ ID NO: 118290 - DNA, 296 bp, Homo sapiens
aaataccatttcatcagcgtcagaaaaaaattcctctgctcagctctccaaacagcgacctggccttcttatacggggagtggggagaaacgttagggcacagacccctttgagaactggatgggggtcatggatcagtcctccatgaccatgcaagcatatgactgcaccacctgcacacacacagcggtacacacacaggcacacacagccacacaatgcatagaggcacacatgcatgcacacacacaggcattcatgttaccagcaatttgaaggccatttctagctctcaa

SEQ ID NO: 118291 - DNA, 535 bp, Homo sapiens
tgatcaacatgcccatgacaagaaatagagaactaccctgatgggtttagatagatgatctgttagagaatggatgctgagaaaatatcaccatacctcattaaagtttctatataagattagcttttgtgactaaaaaattctaccaggaaaagggatgagatttaatagtaaagaagtatagatagagggaatattccaagggtaaaattacttgttgtcatatgtaaaacagaaatggagagaaaggagaattggagagagaaaaaaacaaaacactagtggttccagtccaggaaagagaaaagcaaggtctacattgaaatgctgatcatgaaatcatgtgacatagtccttgtcagaattcattgagaatcattggtgtgtatttttctgctgttcagcctaaacaagttaaaagccagactataatttttgaattgaaaagcaatgtgtctaacagtatgcatatatatacatgaaaatatgtaatccaaacaagtaatggatgtgttttatgtatgtattcctgaac

SEQ ID NO: 118292 - DNA, 650 bp, Homo sapiens
aggtggagcgtccttactgcacagggtgtggagggaatggcgtgggctcagctggctttgtcatcggacacgccgcaggctcagtttctgcctctgtttcccactaagctgtttagcacagaagaagttatttaaccacatctttggcctcagtttttaatctctgaattgtaaagaacagtaatgagtctttcatggagtttttgtgcagattaattcagtttctgcaaagtgcttagtattttgcctaaaactcagcaagtatgaaatgaggttgttgtcaatttttactgcagaggatatgacttagaaccacacctctaccccctggtgcccgtcatcaacaggtgaggcccacctgacagatgggggaaggcagagaagtacagccctgacaagcaggctcgtgaaaatcagactttgttctgttcacaaaggcgcagctcacctcgtgcccatggaacgccgcctttattaacacagcacaggcacgtcccaccagcgtgcaacaccgtgcggcgtggaactgccatctctaggcatgaacctccgctttgcaggcttgtttccttgtttgtcaccgaggcaaggtgctgcacagaattcatttcttatgtttgcagtcacagtgcagtcatcaaatccagaga

SEQ ID NO: 118293 - DNA, 436 bp, Homo sapiens
ctgatgcaggaacagaaaaacaaataccacatgttgtcacttaatggtggaagctaaacaatgagaacacatggatactaggagagaaacaacagacactgggcctactttagggtggagtgtggaaggaggaagatgatcaggaagaatgcctattgggtactatgcttattacctgggtgataaaattatctctacgctaaacccccatgatatgcagtttacgtatataaacctgcacatgtacccctgaacctaaaataaaagttaaaacaaagaaagttgattttttgtaaaagattaacaacactaacaaatctttatctagaatgaccaagtgcaaaagggagaagacttgaattactaaaatcaagaatgatacagaggatatcactaccaacttcacagaactaaaaaggatagtatgaacaattgt

SEQ ID NO: 118294 - DNA, 375 bp, Homo sapiens
tggttaattcagcctctcgggaatgtagccttttatcctttcatgcaaacatgtctgttttgagtatatagaaatgcaccctacagtgttcataaaaccaacagatgtgtaattgcagtcctggagcattggtcagttcaccttatccttctttagaagactgatttttgtcaatgcaacattttgtttctactgctgtggatcctttcttccttcttcttcttctttttttttaattagcagtaccagcaatcctgctgtaagacatatccaaaagaatgaaaatcagtacattaaagggacatctgcacccccatgtttattgcagcactattcacaatagccaaggcatagaatcaaccattcattgagtgt

SEQ ID NO: 118295 - DNA, 1104 bp, Homo sapiens
ttgtctccaaagcagtcatctaaaatctacacccccacgattagatgagttattactgagaagttattgcacccacaaaaaagctgccatttttttccaaagatgtcaaaagctagaaggccaggtcttctcaaagtaaaatacactgtgtattggggaaaaaagggtaagaggcataattaccaagttaggcatagtctgtcaagttgtatttagctattatcatggaatagtgttattccctgataatgaatgttggcatcataaccagaatgattattctcatctccatatcttcgtatttacatctaggaaatataaagcttatttatagtgaacactgagagtggtctctctccaaggagtaaagtaaatatgccctggctaactagtgtaagtttgtattctacataattaaccattataagaagtcactgagtagatcctaacttaagggatatttgtttgtgtttgagtatttctcgtgtggtgtttctaagtttgaaaagtgttttataagcatagagcttatgtgtgctactggggacaaatgtctcattttaaaggaaagagggttttctgagatggcatgaaatgagtgaaatctatttattgcctgaaagctaaagtggaatatgaaggcaagtctttctgaacagagcagtcctgtcactgactaacccagggaaaggacaggaaaaagctagaaagtgttttgaaaactcttctgcttaccttttgaattgggacattaacaaagtaaggaccatttatgtgactggcttcctttggttagttatgattcattcattaattaattcatcagatttatatagagcacctgccatgagccaggcattatactagatgtttgggaaacattggtaaacaaaagcaaagatccctgcttttatggaacttaagatattctgagacactggatcatacattctagtgcagtcaccttattaaaacttaagattttgtgatgcaaacaaacagccagaagctacaaataatgtaaatgttatatttaaaaaatacaatttcaaagaaatgacatttaaaccagttttaggaaagctgaagacaatattgctttta

SEQ ID NO: 118296 - DNA, 276 bp, Homo sapiens
acactttgttgcacgtgacatttgcctcataggttcacctgcctcaggcttcctggctccatcctgtgacttattatttttttaataatacccaagtacagctgggtgtggttgctcacacctgcaatcccagcactttgggaggctgagggggggtggatcacctgaggtcaggagttcaagaccagcccggccaacacagtgaaaccctgtctccactaaaaatacaaaaattagccaggtgtggtggcgggcgcctgtaattccagctacttg

SEQ ID NO: 118297 - DNA, 329 bp, Homo sapiens
gttatttgcctctcttcttctttattaccattcctctagcccaaatcaccatcatcctcacctaaattacttcctactatgtctctctgaccccatcatggcccctagactcattaaatttagcatccagagtgattatttttaaatcaaagtcagatcagtcactattctgttccatggtgccaatggctccccattgtaagagtaaaatccatgacccccttctatctgtccagtcacatctcctaccactctttcccttgtccactgtactccaattacatttagcattcttgctattcctcaaaaattctaatatctttcttgcc

SEQ ID NO: 118298 - DNA, 316 bp, Homo sapiens
gacttcatcaaggctgtcctactccttgccccttttcctataggactcatctctactgaatcccaaaatcttttgcttgtcagggtgagacagggtcttactctattgcccaggctggagtgctgtggtgcaatcatggctcactgcaatctctatctcctgggtgcaagtgattctcccaactcagcctcccagaagctgggaccacaggtgcatgccactgtatctggctaatttttaaaatatctgtagagattggggtggggggtctcactatgttgctcgggctggcccaaatcttactttagaaagaatc

SEQ ID NO: 118299 - DNA, 363 bp, Homo sapiens
cactgcagcctcccaggttcaggtgattctcctgcttcagcctcccaagtagacctgccactacacacagctaatttttgtatttttagtagagacagggtttcggcaagtgggccaggctggtctcgaactcctgacatcaagtgatctgcatgcctcagcctcccaaagtgctagggttacaggcataagccaccatgcccggccagtaaatacccatttccaagatagcgtctttcagatcggcaacgatgcaaacacttgataacagtgttagcaagggtgtggttaaatgggcagtcctgttcattacagatcaggagacttcactgtagagcctttaaaactttgtgaattttgaac

SEQ ID NO: 118300 - DNA, 616 bp, Homo sapiens
atcaatgtgaatctggtcctgagctttttagaaaataagagtggtggccgggcgcgctggctcacgcctgtaatcgcaacactttgggaggccgaggcaggcagatcacaaggtcaggagatcgagaccaccctggctaacacagtgaaatcccgtctctactaaaaatacaaaaaattagccaggcgtggtggtgggtgcctgtagtcccagctactttggaggctgaggcaggagaatgctgtgaacccgggaggcagagcttgcagtgagccgagatcgcaccactgcactccagcctgggcagtgagagtgagactccgtctcaaaaaaaaataagagtggttaactttttggttgatattagtattatttgtgagaagagtttccccacccttcttctgatagaacaattgtctgtcactggagaaatctccctccagagctttggcaaagttactctgatctgggtctgtttaaaaggccgggtctctaatttaggaatcggtgatttggaagcttttgcagaacatcaccagaagaagggaagcttcccagagtcagaagctaaattaaaataatttccaaggctatttgatcagccttcttccttttt

SEQ ID NO: 118301 - DNA, 650 bp, Homo sapiens
caacggtgcgcaactggtcgatgagtgatttttttatggaacttcacactttaaagcacttatctatatgatttaattcttataatcctgggatagaggaattactatacccattttgtaattctcagaggtagggaggttaataagtaatagttgcttaagagagtaagtaacagctggaatttgaacccaagtcttttgacttcaagttcagtgttctttccattcttttgcattgccttcttaactttaatgtattgatatgattaaggaaactgaattgtttaatgcctgctattgatcaggacctgtgcaaggtaatttgcagtagttatctcatggcagacaatcttgagaggttgttattaaccacatttcatagatgagggaactgtgttagagaaggtaaaatacttgcctaaggccctagaatccaaccaagctctgtaaagataaagctctttccctgtatctatgtggaagcaaaaaagaaaaagaaagctaaaatccatttatgtttctgaaaggaaagaatctgagttccttcactaaactaagaccgtgggatatgtttgctgtgttccatcgtatcatagtgacatgctttgtaaaggcatgtcacttgatgtacatccagatgtagcttaggg

SEQ ID NO: 118302 - DNA, 657 bp, Homo sapiens
ggattattgaattagagatcttcaactggtaagtatataatgcagatactccaaagtgtggaaaaatccaaaacctgaaacacttctgcttccaagcatttcagataggggatacttaacttgcatattttaatctgtaatgttatttaatactatatttaaattaacattcttagtcaagacctgtaaaagtggtaaacttactgagtattcacttgtccttaaaatcaaatactgtttgtagtattgaagtactgccattgttttttaaatggatacttagtggtgttaaagtaaatagcagtagaagcagatagtgtaatttataagaagcctcaccaagatagaagaattcctgcagtattatgttttcttacatgtatttcaccttatatttcagtattaggttgtgcatatttaccctgaaagagaagcagcagaagagaattcatatgtgtatgcctacaaaatataaaaatcagtatttttgagtaaaatctatattttaatagatttttttatgtattaaaagtaggaaactttgcatttgacagccctcaaattgggaattacttgtctaatcttctgtttattaccctatcttgatttagtagttagcagcttcatggctgtaaaatacttttattttacatgaca

SEQ ID NO: 118303 - DNA, 438 bp, Homo sapiens
atacatgcgtgagtgggcacacatgtatcttcagagcagtgttgaggcaccgctgagctactcccctcccctctcccaatggcccctactgggctccttatctcctaagccacaactaacaggcaaagccactgaaagcatgcaaatgccctccctgttgtcgcagccaactccagataacccagtatatggactatcaaggctcttggcttctcttggtcctccctgcctgagagcagtttctgctctatcatccatcctcttcaaaagggtgagctcagatgggaagaagagagagagcacccagggtatacacggcgctcccttctgagtagcgctaattaaaagttggctggaaagtgagggaggcagtaactgtgattaatgcacgttctgtggcctcagaggtcatcaggagttggctgatggacagttgga

SEQ ID NO: 118304 - DNA, 845 bp, Homo sapiens
gactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactgggggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttcctttgttttctcactattgcaagagaccagaaaattattttaaacagtaagctcaa

SEQ ID NO: 118305 - DNA, 481 bp, Homo sapiens
gcactgagccttactgtgtctgtagtggtgtcaaatggcaagcacctctacctgccaccacccttggcaaatcccctacctttaaattccaccaagaggcttttcccaccacccggccagtccatggcacttcctagttcttcccttctgaaagactcttcacagcaacaatgcaatctatgtgaaattgaattagcagatttgaaaagtgtaatgtgaaagttttaattgtcactttatgcacaaatttggaaacaatttgatcctcccattattttttcttacaaattacaagatttcaaagccagatggctgaactataaactctgctcacccttgaactggtaaaccgaaatagcccatcctttgtccacatcctgtgaatcttttgttgcttgtaggcattggaaggctgtgagtcattttggtaatgattgtgctgttattttaacatacactgttattataattggaaatcctt

SEQ ID NO: 118306 - DNA, 700 bp, Homo sapiens
ctcccatttttctctccacccacataaaatagtatgttcagtgaaatgccactttctatctttaattgttcgtatcatatatgcgaactttttagacatgaacatgacatgttcagctaggcagagttctcatagataattttcaaatattttccttggctgtaatttatgtattcatttatatcctatccgtcttttgagcttcagatctatatactcttttgtactctcatcactccgcactttgctgtttcttacctagactctcttttacacaatatgcacatttttaccattgtggggtccaaatttaagataccttccactcactaataatatgaacttatatttcctgggagtagccaggttaaattttctatactttggtccataatttgatttgatatgattgtttcatttataatttgcccaaatacatggagcacaaaatttagtgaatttataaatctggatttgccttgtgtccttctgagttttcaaaggcaagtattcaacagtccctgtgtgatgactgacagggttatttgcctcatccacatccaccttcggaatacattaacttcctttgtaatttatttgaaagtagtgttaaactcattcagatcattcagttggattttcccaatgaagaggaaaaggaaagtagttattcctagctccatttcttattttccaccaa

SEQ ID NO: 118307 - DNA, 584 bp, Homo sapiens
ctgatatggtttggctatgtccccacccaaatctcatcttgaattgttgctcccataatctccatgtgtcgtgggagggacctggtgggaggtaattgatacatgggggcaggtttttcccatgctgctctcgtgatagtgaataagtctcatgagatctgatcgttttataaaggggagttctcctgcacacacactcttgcctgctgccatgtaagatgtgcctttgctcctctgccttctgctgtgattgtgagacctccccagccatgtggaactgtgagtccattaaacctctttttctttataaattacccagtctcgggtatgtctttattagcagtactaatacattaacccactaacccactatttgtatctgcttgctcccaggagagttgagttgtagactacaagataaaacataacttaaaaaataaggcactagggtagtttagtaaaacaatggccagctttgaaaccacttatcaaactctggaaccttggaaaaattaactaacctaccagaatgttacgtttcctcatctgtaaaatgcagtaacaactttacagagttgttggga

SEQ ID NO: 118308 - DNA, 396 bp, Homo sapiens
ggacactgggaaaacaagctccaacactgccttaaaaggatcattgccatgataaaatctgagtttgagacatcatgaagaaatgcccttggataggaatctgaaggggaaaaacacttaccagttccaagaaatgtttactctctggtttataacccaaagcaatgagtcttttggtgtccggaatcagttttcttaacaaaggagatctgattctttcttacatttctgtaatgttcttctttgactctgatgatgatgcagactaacacttgaattttagatcaggaagaaaaatacacagctttagaaaattctactggagctaatattgttgtgtggtctagaaaggattagaagtctccttttaatctagggcaaaggaaaagaatcctt

SEQ ID NO: 118309 - DNA, 362 bp, Homo sapiens
aaaaggggaagggagacacttcttagccaatgacttacaggctcccccattcctgcggctcagtgcccatttcgaggccacaggtgttggtggcttcacaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcgggctagtcgggagactgtcggctagtcgaag

SEQ ID NO: 118310 - DNA, 416 bp, Homo sapiens
tctgtgacctgcaatcatgagtcttaaaatcatacagggcttaatctacctttttagtcttatctccaactactcacctttctgaattctgttttggacaagcatgactcatttcatcatgaaaagatcttttgttggccttttgcacattcatgatttttttttactcttctctaaaatgccctcctctccttcctttttccagacctggtttaaatcttactttttctgtaaagtttttcctggacacactagttagttttttactacactggaacttaacctttatcataacaattgtctaaataatttgagaaggaatcatatagtactactttgtatcatctcttctattattttgaaagactgtttaatttttcatgtcttacattcccaactaaagcctaaaattgttt

SEQ ID NO: 118311 - DNA, 237 bp, Homo sapiens
ttttgaattatgaatggtgtaagcatgtaaacacaccagtaacagtaaaatccattaaaaaacacaacacttatttagtgcttaccatgtactctgtgctagacactattttacgtgatttacaggtatggatttttttaaaacttaaatccattagctaggtgctattgtcactccattgtgcataagcagaatttgaggcacagagaggtcaagtcaccagcccaagttcacaca

SEQ ID NO: 118312 - DNA, 601 bp, Homo sapiens
agtcgagcgcggaaccggtgtatcgatgccactggtgtttatcgatgccactggtgtatatcgatgccactgtcaactgagctttcagaagttgtcagtggctaaatgatagaccagaaatggaaaggatgaattccagccctacacctaccattaattttcaagcattgctgaggcagtcatgatgctaatcttggcttcaacttttctcatcttaaaaacaagggcattgttttgtgaagcaattggcggtttgttaggatttaattcagtgtgcagggttggataacaatggttcttaaaaatggttcttcaaaagaacaatggttcttttgctttgaaaccaggcagaatgggcattaactttcctcataagggaggagggagagcaggttacacagttcctaattgagatctgtcacttcagaagtagggacctttaacaaatggccatttggaggcgctgggggagatgtactctgtagtatttttgaggaaatattttatgattgtgctctaggtttcttgcttattcattgatcaatattgacaagcattccttaagacaaaaatattacattcttcaggtagcatacataga

SEQ ID NO: 118313 - DNA, 501 bp, Homo sapiens
cgtgttggcacatgtctgcagtcctacttgggaggctgaggcaggagactactttgaacccaggaggcagaggttgcagtgagccaatatcgtgccactgcactcgagcctgggcaatagagcaagactccatctccaaaaaaattaattaattaaataaaataatgttaagcttagtgttagttgttctggacattttaaaacattctttgtggcagagaaatagctttctgttaattatacagcctgccagtattcacaagagtttttcatcctattaaaaagtatagttgggctgggtgtggtggctcacgcctgtaatcccagcactttgaaaggccgaggcgagaggatcacttgagaccaggagttcgagaccagcctggcccacatggcgaaaccccacctctactaaaaatacaaaaattagcttggagtggtggtgcacgcctgtagtcccagctactcaggaggctgaggcaggagaatcacttgaacccg

SEQ ID NO: 118314 - DNA, 464 bp, Homo sapiens
ggattttaaatagggaattcagacattggctaggggactatgctaggtgatctttaagattccttagaagctctagtctgactcttactgggttggtcaagactaggaaataaaataaagaataggagctaagagggatgactgtttaaaaataaaggaatgtgctagcagttatttaaggtggcacctgaagtttagagacacagaaataaatagatgctaggtttggctcatgagtaaagataaaacttactcttataaatcaaactgtagggttttgaaatgaacttgatcaaaattgagtcagatttcaagtcaaggtctttgagcaaatttagaatttgcttgatattctgaagatttgagattccagtattcattataggaaaaactttgaaatatataaatcaattttagtaattttatatttttttctttttcttttttcgagacaagccccacac

SEQ ID NO: 118315 - DNA, 313 bp, Homo sapiens
cccttcacccgccattcaaacatccgtccacctatcgctcctctgacatctccccggccatttctcatctaccgtcattgccacatctgatatctcctattcacctgctcagtcacttccctatccacccactgtcatctccattaccccgtcccacccctgcctaccgcacacactcattcctccactcacccattcacgcacacctattcattcacttcctgcaccatccactcatccactcgggtgggcgatgccaggaaattggggtgtgtgtgtgtgtgcgtgcatgtgtgcacttacacacatgagt

SEQ ID NO: 118316 - DNA, 350 bp, Homo sapiens
gattctgatcctgtttttatttctcacagaatgccaattcctgtccagttgatcgaactctatttaagtgcatttgtattcgagctcaatttggtggtaaaatcttaagaaaggtgagtgtggacgctgccgtggaggccccagccgtgcttctatcccggccctgtgggacagagcatgctttccaaagtgggcttgctctcctgaaatgagggttggttaaatgcttcatagaaatcaactcaagtgccccttgtggccatgagccctgtctggggggtttggggtctgggttgggggttagaggcagagatattgccagctcctgggatatcccttcgaccccaccc

SEQ ID NO: 118317 - DNA, 297 bp, Homo sapiens
agctgcaatttctcgtgctcacggttgtacagtattccattgtgtggctctgtgatgacttagtgatccatgctactgttgatgggcatttgggtagtttccagtttggggctatcataaatagtgctgttataaacagttgggacatgccatattgtgaatgtttatgtatgcatttctcttggatgcaaaccaaggaatgaaactgccaagtcatagggtacagtataaatacattgtgcttaagtagatgctggtcagcagctttctgaaacatcgggtcaatgttcactccca

SEQ ID NO: 118318 - DNA, 354 bp, Homo sapiens
atgtgttaaatgccattcagagaacccaagacactgaccctatccaaggggttggcaaactcaagggataagatactaactcaaccactacccatgtacaagacttatagacaaaaaattaagctattttaaaaacatatgtgaagcatattgtgatggttaattttatgtgtcagttgaactgggttaagggatacccaaatgtctattaaaactttatttctggatgagtctttcagggtgtattcagaagaaactggcatttgaattggtagactgagtcaagtacatctgccctcaccaatgtgggcggacaccacccaatctgttgagggcctgcctgaatacaatgaa

SEQ ID NO: 118319 - DNA, 289 bp, Homo sapiens
attaaacttttgtttacttatttttattttacagatgtcaaagtgccaaccctggaccatggttgggaggtcacagtgagtcaccttctggctcagcagaagaattttctgatgctctaatagctggtcaaaagtggaatagagttgcctgggtctggctctattgcccaggctggaatgcaatggcgtgatctcagctcactgcaacctctgcctcccaggctccaatgatcctcccacctccgcctcccaagtagctgggactacaggcgcatgttaccatgcctgg

SEQ ID NO: 118320 - DNA, 691 bp, Homo sapiens
aactgagccccggaccaaaccattccagctgccgacacccttgcagcctttttggagcaggacagatgcttccacgacgggtcaaaagccattttggaagtgggcaacaccggacaatttttgaaggaggaacgctaaaccctggcgaagtggcttcaaatacagtatttgcataaaaggggatatttctacttcatgatttctcaacctcggcacatattgaactgggcagtttttgtgtgggggttgtccggtccttgtaggatgctgagcagttgccctggtctttctccccactcaatgccagtagcactccccaaaacatgtctctccagatattgccaaatgtcgtctcggggagaaaaatcgtcctcagttgagaaccgcttctatttgaactccgaaccgggttatgattcaatagctaactatggtggtgatttagtccatgtatgaatgtcatttttaagctagctttttggatttgaggttatggctgaaaggactgataaataatatacatatttgaccacagtctgcgaatatgaagtttattctttgagtttcaggcactatgcctccttgactcaatgaagaaccaaatcaacttacagctagctactcatgggcttgaactttctgctgctgcttcagctcagctgtctacaactagaccacatagctggatgaa

SEQ ID NO: 118321 - DNA, 190 bp, Homo sapiens
gtttccctatgcctggggttttagtctctggagagcgcaatgctttttcagctgaatttgtttttagcaaggatggaagtcccttcctctgctttccatctcaccgtatttcagttcctcactattttcaaggtgaagaggcaaatcaaggaattaagactttagagttctgcttctgtcaggggccagg

SEQ ID NO: 118322 - DNA, 678 bp, Homo sapiens
tgtgtgctgctttttgttctgtcattttgcttttttatatatacctctttacatgtattgatataatacctcatatttatcactataaatggccaaaaaaaattgatggcagactattcttatgattattgaatactgatttccaattttaataaggaaaatctgaaacaatgaataaatttggggcttaagctggttagcattaaacttcattcttcaatatcataactgaaaataaagtactctgtaaggtaacttcatgaaaaattacctatttttttattttaatcatttgtaaatctgggcatataaagatatcaagttatttaaaatgttacctttcaaactagagtttacaagcagggtgtgcctgcttgtgtttataggaagtaagttcactaacggcaagagcaacattttcttttatatttcccctggcttatagtacaatgcttttgcacagaggtggggcccaataaacaaaacaaggttaggaaaacttattaaagcatcatatgaaacataaacatgttttgtaatgtagatttaaaagtactcgtggtcgttgttgttgttgtttttagcctgagtttcgcttttgttgcccaggctggagtgctgtgagccaagattgtgccactgcactcaagcctggacaacagagcaagaatctttctc

SEQ ID NO: 118323 - DNA, 380 bp, Homo sapiens
gagtcgacaaatgggggcatggggccagggtggggaggggttaaaatgatctgatttatattttagaatgactactgtaaagttctgtattaaagtagaagtgccaagaatggaatcagggacaccaattaggaggctactgcagttaattaacacctttggactcagtcagtagactggtgagaaaaggttgtattatcagatatcagaaagaagcaatagaatttcctaatgaattagataatcctgaacagctgcctactccaaactctttgatttgaaagagtggattaattaatctacattaactgtttaggccagctggatttttagatgcttgaaatgaacacaatcctgacacactacattttatgtcgact

SEQ ID NO: 118324 - DNA, 339 bp, Homo sapiens
tatgggaattctgtgtttaaccttttgaggagctgccagacggttttccaaagtggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgtattgagttggatcacatgctgctggacccatggcttgtcatca

SEQ ID NO: 118325 - DNA, 101 bp, Homo sapiens
tcctccctctacaggaagatccttcagttaggaacacagtggcattagcatatacctactttcgctggggggcacagtgactcacgcctgtaatcccagca

SEQ ID NO: 118326 - DNA, 854 bp, Homo sapiens
attccagagagagagactgcgatttgcctttctttcctaaagggctgagttccccaaacattagtgacaaggcctatagtgctgctgaggctccagtatctttcacttattctgccagaagagacacttggttggtacattattttctttttcccagataattggctctttctgttttgagagaccaatacaatattgttaccaggctgttgagaaattcttatttctttggaatggtataaaccaaaggataaatcagtttttcagaaatccctagtctttttctttctaatatgctcaaatgttaatcttatttataaatcttgatgactctttctttattcaagttgatatcaggttaggaatttgcgatatgggattgctaatttaaaatacaccagttattcactggactaagaagaaagatcaaattggcttgcagagaattctttaaaaacaatgaaaacaagaacaaacaaagattttataaaattttatccattgatcctacattctgttgctcaagagagaagcttaccaggatgtgactttctgaagccagtgaatttatcatgactacctggtttagcacatagattcgcaaaggcatttcatgtccctgggcccagtagagagaatcagcagtaagaatacaattactttaattttactgtagaaacgtaatcaaaagtagatatagccgggcgtagtggctttcgcctatagtcccagcactttgggaggctgagatgggcagatcacgaggtcaagagatcgagaccatcctggccaacatggtgaaacctcgcctccactaaaaatacaaaaaaattagctgggcatggtggcatgtg

SEQ ID NO: 118327 - DNA, 473 bp, Homo sapiens
acacactactcaactcagggatctttagtgattagcttcatgtaaagacttaaataatgctatttcttaatcttgacttgacattgttgacttcctacaatggaagaggagttagcttctcttacactgtctttcccacaacatattatcacccccaccctcgacacccacatttcctctcctattagtctccctaagcagtttgatattggctgaaacctgcattcacagtttagtataactgtatgtttaccatttcctgttgagccctttattggtttatgattacatttcctttaggtacaacttttgatttttcctggagttaattacattgtttttctcatttgcttggttttctatgctcttgtcactactttacccaaaagtcgctgccctaaatgtaaagctcttcccaacaaagtcatgtgcatcaggtaatatgctccactttctcttcgagatgttcctga

SEQ ID NO: 118328 - DNA, 403 bp, Homo sapiens
ccagtgccatgtccaggtgccagatttgttatctcaaacatcaccctgcaagtgcaccaagatttcctaatgttagtcagagatctcatctccagaatttgtttttgaagacccatttgaccagggaaagcaacagggaaaaagtagcctttgaacctggcagaatgaataagagttcactgcagaaaagcagtctgcaagaacagaatgatgccgtaaggaagcctccttgggaaaccaccttgaattggttaacaaagttgctgagagctgagcattgccttggtctgttgtacagccatctttataaggaaaaagaagcagtcatggactaaacacagagcaaactgaaaggcctggagaaataactctccctcccccactttttctttctgtgttcaat

SEQ ID NO: 118329 - DNA, 478 bp, Homo sapiens
gggggtgataataaaagggaccttgatatgaaccgcttgggaaccacctgtgtaggaggcagttcgggagcaactctcaaaaggtgcagtggcttgcaagattcagagctggcgtgggcagggacacccctctcagagctaacacagtgcaccgcagccctggcgccagctcggggaatcaggtgggccctacacgagaaggttccacagatactgcctgcctaaagtggatcttgagtcagatcctacgaaagccagaaggagggcatggctgagagtacctcggagaggcagaaaaaggggagctgactcaacactgctctgttgggaagatgtggggagagattctggagatgaccttggctcctggagatggcatcttaaagcagatctctgccaggcgagatcccgtggcccatgggacacaccttcactgggcctgagctgtctgtcggcttcatctactgggacactggca

SEQ ID NO: 118330 - DNA, 472 bp, Homo sapiens
acttagtgagaatatgcctctacaaaaaaaactaaaaaaattagctgggtgtggtggcaggcactgtggtaccagctactcgggaggctgaggtgggagtcgcttgagccccagaggttgtcatgatacttgaataaacaaaaattaaaattttaaataaaataggaacaatcaggcaaagaaaggcagaagacaagagtattgcaaggaaagagaagataaaagcaaagaacttaaaaagtggcaaaacacctaatgctcagagtaccgatccctaatctgtgttatgtcctcctggagaaaattatgttaaaaccatttgaggactttttgcttatcacacatcattactttgatcctgatctccatgattctgatacctgtcagaggaaatcctctgagttaaattaattctcttacggtcctatgacccatagataaagcagaaattccatatggttccatgtttatc

SEQ ID NO: 118331 - DNA, 443 bp, Homo sapiens
gtcattaaggaaatgcaaatcaaaaccaccagataggctgggtgtgctggctcacgtctgtaatcccagcactttgcgaggccgaggtgggctgatcacttgaagccaggagttcaagaccagcctggccaacacagtgagatcccatttctaccaaaaatacaaaaaattagtttggcatggtggtgtgcacctataaccccaggtactcaggaggctgaggcatgagaatcgtttgaacctgggaggtggaggttgcggtgagtggagactgtgccactgcactctagcctgcgtaacagagtgagactatctcaaaaaacaaccaccatcaccaaacaaaccacctaaaacccaccagataaccatttcacacccattaagatagcagtgataaaaaaaagagtggccaggcacagtggctcacgcttgtaatcccagca

SEQ ID NO: 118332 - DNA, 728 bp, Homo sapiens
gcaaagaaaatatactatcaaagtaaattttttgaaaagttaaaacctgactctcacagaaatacaaaacgaaatgccaaagatgtattaacttattaatgaggaaaccaggcagagttaatgcaggtccagagtactgaaggaactgatctttaggcattagaataagattgctagattggagacaaaactggtgacgttctgcatgcactaaaaccacagtttttagagttatcctttctgctggacagaaatctataagctaacgttgtagtttcacactatctgtgctctaacagcaactaacaaagtcaaatgcattggcattcttctagggaattaaataatccttgggtgaagctgtgaaacagtgctctagagtaatatgagaaggccacacagctccctaatctttttcttttttcatgttttggataattttaattaacaatcgctttttaagattattattttcttttgagacgaagttttgcttttgttgcccaggctggagtgcagtggcgcaattttggctcactgcaacctccgcctcctgggttcaagtgattctcctgcctcatcctcccaagtagctgggattacaggtgcccgccaccacacccagctaattttttgtatttttagtagagacagggtttcaccatgttggccaagctggtctcaagttcctgaccttcaggtgatccacacaactcagtctcccaaag

SEQ ID NO: 118333 - DNA, 401 bp, Homo sapiens
ctcaggctggactcagagaagcctccccagctcccgcagctatgctgcggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaag

SEQ ID NO: 118334 - DNA, 629 bp, Homo sapiens
tggaaccatttcacttgtaacattcttttgtcccatagcactctgctaaactactgtctttcaaatatctttctgttttgtttgtttgtttgtttttgagacagtctctctttgtcgcctaggctggagagcagcaaaccctgcctcctggatttaagggatcctcccacctcagcctccggagtagctggaaatccagcagcacgccaccatgcctggcttatttccgtatttttagtagtaatagggtttcactatattggccaggctggtctggaactcctgacctcaagtgaaatgcccacctcggcctcccaaagtactgggattacaggcgtgagccatcgcgcccagccatctttcatatatctttctaaagcaaaaaaagccaaattcttccatcatggtttcctttgggacttctagacctatagtaagtctattttaaaaaattatctgatacacttagctttgtgtgtttattcttttttcccaaattttgtgtggcttatattagttactattcattattgttgagttatttttcagattcactcatacttgaactgaatgactttgattataaattctttggatataaagagcactgtcactttaaattattctgt

SEQ ID NO: 118335 - DNA, 658 bp, Homo sapiens
tccctcgggacttctgcctcctgccaccagaagctgcctacagagactgaagcccaccacgttctcgattaactgcagtcatggacggctccagagatcttctcccttttgtctctggcacaaaagcttgctcggtgtgaagacaacacatgagttatcacctctgccaacaatgcatgcattcttggggaggctaggggacactgggagccctggctgtggccaaggaggcactaaatcaagctgcttcttggaggctttcatggtttcctctaaacaaagcagctctcatctcacagcatgaaggagtttctgaacacagttgctaaaaaggcaccaggctgtcctcgagatgtggaattctcaactgagcaggtggactaaggggttcgcaggtcacggcacgagctcctaggaaccccaagtagcagcaagagggttacatgagatgatagtaagtttcaccactttcacttaccataaaggaaagcggccactacaaatccaataattagtccactcaacatttctctcctgcgcccacgtacctggtggtcttctggaagctggggacgcaaccatgaatgaaacaaagtccctggttttgaagagcatacactgtactaacagagattggggctgaaaaattcgtatttca

SEQ ID NO: 118336 - DNA, 531 bp, Homo sapiens
acattaaggaagactgattttgtataaaaatgtccaataccatattcttgaaatatatttttaacaatttatggaggtatactggatataaaataaactgcgtgtatttaaactgacaaatgtgtcagtgaaaccatcactacagtcaagataatgaacatatccatcactctaaaaaatgtcctcttgtccctttgtaatctgtttattatagcccttcccaccatccacagcctatgcttaagcaatcagagctctgctttctgtctctataaattacttggtattttctaaaatgttatataggtggactcatacagcatgcactctttctgtctggcttctttcactcagtaatcattttaagattcattcattttgtagcatatatcagaagttcatttctttttattgcggagcagcatactgttgtatggatacaccatggtttatttatccattcacctactgatggacgttttgtttccagttttttgttgttgttacaaataaagctgctatgaatacttg

SEQ ID NO: 118337 - DNA, 246 bp, Homo sapiens
gaagctaaaacaaaattcaccaagccacaaagacatcagtaagaacaacagagatctgaaagtctaattccaggagaaaacagggatatatcctcattccttctgcaagtcaaccttgggcaggccactcctcctccgcttgagcctcagtttcctgtttgtgcccagtgttgggttcagcagagcacagtacacagaagaaagtcccaggtagaatcctcagtttgtctgctacccaactcccaa

SEQ ID NO: 118338 - DNA, 377 bp, Homo sapiens
tcacgggcagggtgctggggatggaaccccacaaagccagccgagaaggggcagccggagggcaagaagcctgacgtgatgatgtgatgcaatgtcatgatgccacatggtgtggggtggtcagtggggccagccactccagagccctccaacaggagcatggctgaaagttgtctgctgggtttagtgacaaagagcttgttgttaacctcagcagaatggtggagatgaagtcagactgaagtggggagaagcggaggtgaggagaagaggtggcaagtggagggaagacattcaagaagcttgacagggaggtggggagaaatgggtagcagctagaggatgaagttttgtttgtctaagataggagagagttg

SEQ ID NO: 118339 - DNA, 286 bp, Homo sapiens
tcctccacctcggtcacagcggggtctgtcccctgcagcaggtggctcaagcctattcacccacccttcctcactttcctctcattccaacaacccccatttttctagatcttattagccagatccctgtggtcctagacctctgtttcttaacaaccagtacttcttcctgagctcctgatgtcttccttcatgccattttctcttggggtgtggcttgtggtaggctgcaggaacctggtgacactgttgcccctcgagtgtaaatgccgtctgttctgcatat

SEQ ID NO: 118340 - DNA, 353 bp, Homo sapiens
agcccctgtgctaagagggttggatgggtgggaggaaagaggcattactatctggtctcctcctctacagtgtcattggaacacttacttccaatctccttgccaaaagttcctaagtgcctgggctttctttgatgttttctctgttccatagcctgtgctctcgtggcaaggtgagtaggaaagcactgttatgtttctgaggaacaaagtgcttcttattcctgaccctcagagaacagagcattcgccactttgtcatcccactcacgggagcccaggagggcatgtactcaggggcctcccaccaaagtgctgggctgagaatcaaagacctccatgtggactcccca

SEQ ID NO: 118341 - DNA, 840 bp, Homo sapiens
tcatcatagctacaagaggtggacacaagcttctggccataaggcagtagacaaggctcagacatatcctcctgagcataaactatgaggaaactcgataaaaaagaggaaacgactgttttcagatgctggacgagaggcaggctcgtggctggcgcagctccagcactgagggcatggagggagctcacagaggctgaggcagctggaagcctcgggcagggctctggagaggagggaatgatacagggagctcccggagcctgcatcagggtctccctaagcctttgctgaataccccgctgcccagtcatagggcgaaaccgcatcaaaccaaagaacgactgggaagctgtaagcaaaacaactctccaagctcacagggcagagagccagtcacgctcccaacagccaaggcggagggccctggctgacccctcagccattcaggagacacccggggcagggtacgtcacttagcagatgggttaggctataaaccaaccctagagaaaggctgttctcggcccaccccaaagctgtaaaaacaaacccccaaaggatcaaggggctcttcaggcagcttcaatcgcctgccagggcaaagcccccaaggtgattatttttttgtaatagtcacaaatggaaacaaccccaatgctcagtagcaggtggacagaagaacaaagcgcactctgtcccaaccacgggacattcctagcaaaaaaaggagccgccgctgagacacacagtagcccagctcggtccgaggcaggaggctgagggagagaggcagacagagcgcagaccgcaggactgcacagcgcaagactctgagat

SEQ ID NO: 118342 - DNA, 526 bp, Homo sapiens
  misc_feature (487)..(487): n is a, c, g, or t
  misc_feature (505)..(505): n is a, c, g, or t
gagtctccgtcttccccccagcaagaagcgtttgttcctgcaattcggggggccgcctttgcgcgcggggtgcgctgcttcttggagagttccctcacgggtcacatcgcggaggttcgcgccggcgccgggtcgcggcctccctgcgcagcttctttggcacctggtaaccttcagtggctccgtccgctcggagttaggaggctgtgtcgagctaaccttgaccttgtcctgcagtttttgctgaccatccccaacagcacactgtaaagagttagggtcctctcgaagagttgggactgggcacttttgttggtagtgctaaatttcaacaccctgaggagtacgctgcccaaattattgtaggaaagaattacctggtttagtggttataatactttttgtccccaccacacttgaataacagaaaaaccctcccaacagggctgctgatgattctgtgagggacatgatgattatgataatntgctatagctgatggtgntggggtgatctggtatttttg

SEQ ID NO: 118343 - DNA, 601 bp, Homo sapiens
gagtctccgtcttccccccagcaagaagcgtttgttcctgcaattcggggggccgcctttgcgcgcggggtgcgctgcttcttggagagttccctcacgggtcacatcgcggaggttcgcgccggcgccgggtcgcggcctccctgcgcagcttctttggcacctggtaaccttcagtggctccgtccgctcggagttaggaggctgtgtcgagctaaccttgaccttgtcctgcagtttttgctgaccatccccaacagcacactgtaaagagttagggtcctctcgaagagttgggactgggcacttttgttggtagtgctaaatttcaacaccctgaggagtacgctgcccaaattattgtaggaaagaattacctggtttagtggttataatactttttgtccccaccacacttgaataacagaaaaaccctcccaacaggggctgactgcaaaagtgattttctgtgtaggggacattggatgtatttatgtatatatcagtgcctatcagtctgtatgtgtgtttgggggtggatgctgtgtaatttaaaaaaatctatggagattctgataatttgataacctgtttctccggt

SEQ ID NO: 118344 - DNA, 327 bp, Homo sapiens
ttagtagaaacggggtttcactgtgttggccaagctggtctcgaactcctgacctcaagtgatccacctgccttggccttccaaagtgctgggattacaggcatgagccaccacacccagcctatattgaaactctaaaactaaaaaacccctaaagttagactcatttaaaagtagatatgtttaagaacatactggacacagtaggagagagaactgatgaagacagattaccagaaaaattttaactaaagaacggagacaagaaaacatagaaaaatacagaaaaatgtctgaaaggcatgtgggtaacagcaaaatatatat

SEQ ID NO: 118345 - DNA, 655 bp, Homo sapiens
acttccaaagcctcttcaggtagatgactatgtggcaagacctgttggtagaaactaccaggcttctctgtgtgtgagtagaaagtagagggtaaagttggtatcccagtcttccggtcacctggtccaggaaccgctgaaacgttcttagcctcttcagttagatgactacctggcaacgactgttggtagaaaatactcggcttctctgtatgttgtgagtaagaagtagaggttacagttggtgtgccagttgtctggtcaactggttcagaggcaactgaaattttcagagcctcttcagttggatgactatgtggcaagacctgttggtagaaaacaccaggcttctctgtgtgtgagtagaaagtagagggtaaaattggtatcacagtcttctggtcagctggtccaggaaccgctgaaacattcttagcctcttcagttagatgactacttggcaacgactgttggtagaaaatgctgggcttctctctatattgtgagtaggaagtagaggttacagctggtgtgccagttgtctggtcaactggttcagaggcaactgaaattttcagagcctcttcagttggatgattatctggcaagacctgttggtagaaaataccaggcttctctgtgtgtgagtaagaag

SEQ ID NO: 118346 - DNA, 419 bp, Homo sapiens
agatattagctagggcttccattatctgaaggcttgactggggctggaggatccacttccaagatagctcactcacatggctgttggcaggagaaggccttgctttcttgccatgtggatctctctacaggacaccttgggtctcctcatgatactacagctggcttcactcagagcgaatgaccagagtgagagagagggagagcaagagagagtgagagagagctagagagagcacgagagagagaagatccaacacctttgatgacctaatcctggagcacacacactgatgcttctgctttattctgttcattagaagcaagttgccaagtctagtccatactagggggaggtgtattcaagtttaccttttgaaaggggggagtatcaaaaggatttatggataatatcttaaa

SEQ ID NO: 118347 - DNA, 394 bp, Homo sapiens
gggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgct

SEQ ID NO: 118348 - DNA, 452 bp, Homo sapiens
gggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcaggtgagagtcctgtgtgtcccaaaaagctatcatcagggcagagaccctggcaccacttatagggaatgccaagccagccgcaattatgctgagttccaaccctgctcacagggttcagactctcacaaaacagaggaggacagaacaccaagttgggaccagggccactgcatgga

SEQ ID NO: 118349 - DNA, 559 bp, Homo sapiens
aaaccttacccaatctagaatgacaaaaaccttaattttccttaaaatctgtcatgcaaagtggaaactcttctttttcctctaatacttatccacttgacccagtatccatataaatgagtcatcttacccctttccactacttttatatatcaccatgtaatcattcttttatacatattgggggccactgaaggagtttttatacatatttttctaaagacaaacaaatctctttactgtatgtttttctgtaattctcaatcttttaaacacaccaacatttttcacctttttaatgcttaatttttctcctgattctttatattctagcaaaaattctcaaacttgtcctccatctcagtattactcatttaaaattgttgggttgattgtgattattattttgctgtttataatgcagattttaactttttgtaatggattttccaatgtctttattatctttacttatttaaatccttttatttctacttttcaggtataatctttattatttcagtctgctacttgttttattttgttgtccgtggttcct

SEQ ID NO: 118350 - DNA, 677 bp, Homo sapiens
gtggacaatcaagatagccaaattgatttcttcaaatggaaagtactaacaaaaatatgttgctattttatagtaataacacatattttccatgggaatagtttgattgggtagaattgacacatgcatataaatgcaaggaattaactatgattatattattagcagttattgtggcaataatttcagaaaatggttatatccatctgtctgagaaaacagactttaacacaaaatgaagtcatattcattacacgaaaaaagtgattagaacctagtagtaaagccagctaaatgcgtttctactaagctccaagtttaagttttaatgcatttttaaatgtttctggtctcaaaacattgaacagctgacaatttccctcaagagaacaataccttgaggggaaaagcaattagaatatggattgaccagcaatcagtaatcattacttggtacattaaatgtagtacgctggcacctggttaagtaatttagaaactggttaagtatctggaaaacaggtttctcaagttaaatgtgaaagctcacagaaataaaatggactttctcacagttacaacgtatcaagaagaaaactgcagaataaggttttagaaagttaaaattgggtgaacatattaaagggaattggaatcaaagggattgaagtagaaaa

SEQ ID NO: 118351 - DNA, 834 bp, Homo sapiens
agcggctcgtgcgccgaataatagaccttagtttaggtattggggccaaaggatggatgaccatttcaaacgatccaggctaagccaggaggagagctcaaagtctgatctggtacgttgcaaggatcgagggacagagcgtgcagcaagtggccaatgaatagaagtctggttttctgagcatccttgcagctgcaggcttcagtctaccagagaatgtgaggtgttattcttctagggcagtggttagaaaagaaaatgaaagtagcagtactcttttcctaatgcgaccatagatgatcagaatttgtaatccataaggtagaagctgctgtgcctgaagaaatagaaagtgggcagaggtggaggggcaagagcaggaggtgaccaatcttggaaataaggaagggagagaggcagccaagccagcagctcctaggattagtcactgcctggagccagctcttggaagttccccaggagctgtccagtcttatgtcatgtctagtcagcagagtcccaaagaagcttgtcattctctaggcatttgtgcttacattctgatgggcctaatagcagggagatgacatggagcccaggcagaactgctgagatttctactggtcatgacctccatcttctccttcacacctttcctacctttctttttccatgcattcaacagacatttattacccaataagtgccaggtagtaagcgaggacctggggagagcagatgagtaagaaaccgtctctgtctctcaggagctctcagatttttagggacacattgtgcatcctaataaacacagtgcatcccatgaatgtgtaa

SEQ ID NO: 118352 - DNA, 295 bp, Homo sapiens
tgtcacccaggctggagtgcaatggcatgatctcggctcactgcaacctcagcctcccggattgaagtgattcttgtgcctcagcctcccaagttgctgggattacaggtgttgagccactgcacctgccgtatcttaaatttttaactttttattttaaaataatttgacttttgaaaaacagtacaaacaatagtcatataaccttcacccacattttctaagtgttactatttgtcatatgtgctttgtcattcattcattcactcattctctctctgaaatgtatgagagt

SEQ ID NO: 118353 - DNA, 1308 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 118354 - DNA, 2214 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118355 - DNA, 2109 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118356 - DNA, 1203 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 118357 - DNA, 2358 bp, Homo sapiens
ctgataaccaaagcccatcaaaggcattcatcatttcttttgcattgtttttgatttccagtattttcttttgattcttttttagagtttccatctctgtttacattacccatctgtttttgcatcctgtttactttttccattagagttgtgaaaatacatgtcattgtttaaattcctagtctgtttatgccagtacttctaccatatctacatctggtcctgatgcttgttctgtcttcaacttgtgtggctagtttttacttttgtactttggacaaattgaatcagtatttttttaagggaaattttctataagtactatatacatgatttgctttacttaacaaaataagaatgtagtaaacgtttactgttatatgaagatggaagacttcggtaacgattataaatggcatttaaagcaattataaatgcatttaaattaaaatattaaagccagtttaatttttttctgtatttactatttatcactatatttttaaggtaataattgtagatgtttctttttctttttaaatagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118358 - DNA, 1843 bp, Homo sapiens
tgtagcaggggccagactgtgacgtgggaattaagcccagctctgcaggttgcattttcatctttttcatcttctcacgccttgagggctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118359 - DNA, 1916 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgatttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118360 - DNA, 642 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactggtgaaaccccatctctactaaaaagcaaaaattagctgggcgtggtggcatgtgcctgtaatcccacctactcaggaggctgaggcaggagaatcccttgaacctgggtggcagaggttgcagtgagctgagattacgccactacactccagcctgggcgacagagcaagacttcgtgtcaaa

SEQ ID NO: 118361 - DNA, 480 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgactccaggcctgtgatgggag

SEQ ID NO: 118362 - DNA, 331 bp, Homo sapiens
ttaatcgaggaaataatagatacataaggaactaggtcttatatttttaatttttaattaaaaaatatttttatttttaattttaaatagttcatgatgggccacagtttattttaaatagatttaagactctccaataaaatttgacttctcaccctcaccaacagggtgaaaccccatctctactaaaaagcaaaaattagctgggcgtggtggcatgtgcctgtaatcccacctactcaggaggctgaggcaggagaatcccttgaacctgggtggcagaggttgcagtgagctgagattacgccactacactccagcctgggcgaca

SEQ ID NO: 118363 - DNA, 438 bp, Homo sapiens
ctgataaccaaagcccatcaaaggcattcatcatttcttttgcattgtttttgatttccagtattttcttttgattcttttttagagtttccatctctgtttacattacccatctgtttttgcatcctgtttactttttccattagagttgtgaaaatacatgtcattgtttaaattcctagtctgtttatgccagtacttctaccatatctacatctggtcctgatgcttgttctgtcttcaacttgtgtggctagtttttacttttgtactttggacaaattgaatcagtatttttttaagggaaattttctataagtactatatacatgatttgctttacttaacaaaataagaatgtagtaaacgtttactgttatatgaagatggaagacttcggtaacgattataaatggcatttaaagcaattataaatgc

SEQ ID NO: 118364 - DNA, 1267 bp, Homo sapiens
cacgtgactgcgtctccccgccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 118365 - DNA, 1178 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagccagcaaccagataagaaaatgctttaagttccactctggggaaagctggcctctgaaatcttaatgcaggaatgggatgcaggcatggaagaccttacacggttaaaagagaccatagataataatcctgggggagttctccactttcagtctctttccagcgagaaacattgggtcattcactgggcctggtggggttcttcaatcaacccaaaggttgggaaaaattattggactcttccttataagccaaattctaggcctcacaatgtggc

SEQ ID NO: 118366 - DNA, 2162 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcattaaacacacaacattttgttgagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118367 - DNA, 2057 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcattaaacacacaacattttgttgagttaagtatacccaaggtggacttgaaaacctcgaactttcaagaaagtattttgcacaggcattgaaactgaacaacagaaatatgagagctttgtttggactttatatgtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccacaaggttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagtattgtcaatatcagcttcttttaaccttttgaatagttctgctaataaattattctccatatctagtctaat

SEQ ID NO: 118368 - DNA, 828 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgaaatagaatcagattctcatgcgcattttcttgtgcatgaatatttaaccttgttctcatactacaaacaactgatgagaaacagaatgaagacatttgtctattgtctgtggtctatatatataatgtgatctagaggattgaggtagtctatttgcataagtctaaggaaagtgggagctaaaataaaagtaatagctgtaatttaatgaatgtatactatat

SEQ ID NO: 118369 - DNA, 665 bp, Homo sapiens
  misc_feature (22)..(22): n is a, c, g, or t
gcgcgggcgagtgtagggctgncgctgccggacgcggtgctagtcgccggatgaagtgaggccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagctttgggtccaggaatggcaagaccagcaagaagatcaccattgctgactgtggacaactcgaataagtttgacttgtgttttatcttaaccaccagatcattccttctgtagctcatgagagcacccctccaccccatttgctcgcagtatcctagaatctttgtgctctcgctgcagttccctttgggtccatgttttccttggtccctcccatgcctagctggattgcagaggtaaagttatgattatgaaattaaaactaa

SEQ ID NO: 118370 - DNA, 581 bp, Homo sapiens
cacagtgtcaaaacatagaggtgtttggtgtccattacccatattggttactcagttgttacatgacaactcatcaatttctttaaagaatagataaataaatgttactggatgaattgtatccctctaaaatttgcagtaagtcttaaaccccagtatctcagaatgtgactgtatttggagatagtctcaagaggtaattaagttaaaataaggtcattagggtaagccctagtgccatttgactggcatccttataacaagaggaaattgggacacatacaggaagaccatgtgaagatacagggaaaagacagtcatctaaaaaccaaggaagaaactgactctgccaatgtcttgatcttggacttatgatctccagaattgtgagaaaataaatgtctattgtttaaatcacccagactgtagtaatttatgatggcagccctagcaaactaatataacaatgcttcttttggaggcatagacggtaaacactggatatgtgatataaacagactggtcctgttttaggactcaactctcactccatccctgtgcccgctctgagcatagtctag

SEQ ID NO: 118371 - DNA, 770 bp, Homo sapiens
gtgtcattttacgaagtcaaagaaaagatgtaaaagtaaaatccttcagggcacacctgttaaatgaatcaccacctttctagcacaggggtattaggatcttgtgcaacaatcaccaccggagacattaggatccctgaaacacctgcctcactcactgtcatgtctgcagtgaatgcagaacagtgtctgattaccaagtacatccagcacacgcattggacatggatgttgaccgagttccacttggtgtgcctgaggcaggcaggaaattctcttggaaacagaatccttaaggggattgggggggggaagcacccatgagctagaactcaattctaccctacagtaagcagcacttcaagggccgggcatggtggctcacgcctgtaatcccagcatgttgggaggaccaggcacgtgaatcacttgagatcagaagttaaagaccagtctgaaaatatagtgaagcctcatctccactaaaaatacaaaaaaaccagccgggcgtggtggccggcgcctgtagtcccagctacttgggaggctgaggcatgagaatcacttgaacccgggaggtggaagctgcagtgagctgagatcacaccactgcactccagcctgggtgactctgtctcaaaaaaaagcacctcaagaccgagaagcggccgggcgccatggctcatgcctgtaatcctagcactttgggaggccgaggcgggcggatcacgaggtcaggagatcaagaccatcctggtctaactcgatga

SEQ ID NO: 118372 - DNA, 615 bp, Homo sapiens
atcagttattttcgcctgccatagtgtacaccagtcttgaaacttgttactgtcgtagagcaaccaaaaatttgagaataccgaattgtattccctacccgtccccaggatgtcccattttggaaaatatggagccctgcgatctggattggctcataagaatgttaaatctaaaaagactgatcgtatccgtcatgcacctaatgtgtgtccagtgtttaacatagtttcctatgtacaggattggagatgtcgaaagatttcttgacctcttaacattgttcattatattcttttctttagattctctgaacttttactccactgtcataatttaattgtcaaggttcataggataacattcgatgtccctgccattagtcaactatgttgggagtgtgatttgttctccaatgtggcttgttatttatgtttcatctccacttagctttccccataggaagacacttccatagggagtgttttgtgttttgtagggtgacctctgttgtagttctatttccagatgatttccctttcgcagattgtcagctgtgcagatcagacctttttgcttaagtccttttgtttgatacgctaatcctattaagtatc

SEQ ID NO: 118373 - DNA, 770 bp, Homo sapiens
aaaaaagtacagaccaatattcctcatgaatgtagatgcaaaaaattactaaattattgccagatttaaggccagtgtacaaaaatcaattattttcctatattgtaggaataagcaaaataaattttgaaaagggatactgttttcaaaagcatcgtaaacattaaataatgtaacataatatagtcataatattaatgcagaaaaccatacaatgttattgggagaaggtaaagaagttctgagtaattagaaggatataccatattttgttgattagaagtctcaatattgtaaagatttcacttcttaacaaattgattcaccgagtcaatgcagtcccaactcaaaatccagtaagttttttttctttttttttgagaacttgacaagttgattctaaaatgtatctggaaatgcaaaagacctagaatagcccagacaatcttgaacagtgggaaggctagccatattggatatcaagacttaatatggccggtcatggtggcccacacctgtaatcccagcattttagtaggccaaggtgggaggattgcttccagcctttttttttttttttactaaaaaaaaaaagagagagacaacatgacactgtaattattaagaaagtgtaatattaatggaagaatagaaaaattgatcaaaagactagaatagagagtgctgaagcagaatcacatatatctggacacttcatgtatgagcaaattgaccctaaagagaagaagggaaataattaaatttttttc

SEQ ID NO: 118374 - DNA, 882 bp, Homo sapiens
ctctcttgaattgcctttgcacctttgtcaaaaaatcatttggctgtatttatttggttcttgagttcttgagttgaggagacaaagttaagagtgggaaaaccaaagcacctagagctcttagaacagacagaagaccagagatgagagaatttcatagagagtaaaccgcaactctctgcagagggtccctctggagtgttcagcaagctgctgatcagtgcatgcgtgcaaaaactacctgaagtcaggaaaagaaccatctgaaaggattaaagaaaacagtgcctggtgcttataaatggccaaaaatagtgcctgttcccaccagacttgcaaaacttcaaaaaagggaaaatggtacaaaaaacaaatggaaataacaaatagagacaaagacaacaacaaaaatagaaaacagacaatagactcaaactgaaaaaattagtaatcttatgatatggcttggctgggtccccacctaaatctcatcttgaattgtagcttccataatcctcgtgtgtcatggcagggacctggtgggaggtaactgaatcacgggggtgggttttccatgctgttctcatgatagtgaatcagctgcacgagatctgatggttttataaagggcagtttcctgcacaggcactcttgcctgctgccatgttaagacttgcctttgccttcaccttctaccatgattgtgaggcctccccagccatgtggaactgtgagtccattaaacctctttttctttataaattacccagtcttgggtatgtctttattagcagcgtaagaacagactaatacatcatattaagtggaatggtccaaaaactccaaataaaagggagagcttgtcagattggataaaaaacc

SEQ ID NO: 118375 - DNA, 490 bp, Homo sapiens
tatacatcaataaaagggtaagtaaaaagtttatagctgtaatcagataatgaataattataacactaatctattagatttagtgtagatcatctgaaaattacaattagaacaaaaactgaaatgctccatttttcacaaatatggtcctctcagaaaaaagttcccttattcccatgagagaaagaaatctaaacagaaagtatataccactagagattaacaattcttccaaaaagttgagatccactagatatttttattaaaatccactccctaacattaataccagaaatatgtatagcagaaacttacatcttacattaaatacagaagacattctacttttaccaccctcaattacctcttctaaccagtaatcttctctactttgtatttattatatatctataacaacaaggaatttacctttctttttcaaaatgtccaataaaacatgctttgtggtccacagacaaagggtattata

SEQ ID NO: 118376 - DNA, 297 bp, Homo sapiens
aaaagaatatttacttatcccagaaagagtggatactgttaaaatcatatttagagtatcataaagtcttaaaaacgtttttccatgttatgtactttttaaatgagttttaattcaacttgatgaagcataagaatgtaataagacactaaacagatgactatattgattttaagaaccaaacatctatattacctatgtaaaaaatagtaaaatcagactgaggaatgatgaaaatctatcaactgatgtgactggaagagaaagaagcagtgagaaaactgcttatcactcgaa

SEQ ID NO: 118377 - DNA, 510 bp, Homo sapiens
agcacattggatagagttcataaaacagtgtatcaccttagactaaaggtttctctgcctctatcttggaaatacggccaacaaattccagaataaaatttggtacaacttaaaagcatataatgaaattttgtattcaagagagtaaaaatcacggcgtccattgtctgattaaagattgccaggcatagaaagagcaagaaaatagcaatacacaaccagggaagaaaaatcagtcagcagaaaagagcaagaaatgacagagatggtggagatagaaggcaagtacattaaaacagctatgataaacgtttcccatgtgtttaaaaaggtagaagaaaatgtgaacattacagtgcaaaaactggaaaatataagaaagacccaaattgaacctttagaaaagaataatacagtatctgaaatgagaaacactgaatggaatgtccagtagagtggaaactgcagaagaaaatgttagtgaacttgaagacatagcaaatagaacca

SEQ ID NO: 118378 - DNA, 433 bp, Homo sapiens
ataaattgctcagtctcaggtagtatctttatagcaatgtgagaatggagtaatacacaggctcagaaaagttccttgcatttggcaattgagagaataatgggatgatgacttctgtcagaaaagtttgtgatcaggaggtgggggtggaattctgacttgggtgggccagaggaactcaacggtggaaaaataagtggtgacatcataaattgacacctgtgagagatggcggatgaactgaataaagtgtagggtatttagcttgtcatgattgtccctgagaaacaggttgcaggaatgctacttgcattgaataattttattagttatcatttaattcctttaaattgatttctttagttccctatcagagacaagctcaaactacacacaatgaatacatcacggacttctccttctctttatttcg

SEQ ID NO: 118379 - DNA, 241 bp, Homo sapiens
tgtaacttttggcaagttgcctaagctctctggatctcagtttccccacctataaaaatgggatcaataggccaggcacggtggctcgtgcctgtaatcccagcactttgggaggtcgaggcgggcggatcaccagaggtcaagagttcgagaccagcctgaccaacatggagaaaccccatctctactaaaaatacaaaaaaattagctgggcctagtggcacgtgtctgtaataccagc

SEQ ID NO: 118380 - DNA, 546 bp, Homo sapiens
ctcgggtctagcctgtcggtcatgggtagtattttcctagtatttattttattttatttttggtgtttcacatatttaagggattttataagatgggatgctggacatagtaatatttggttgtggggtgtctagatttggctttctcttagagtgtttggtttggtagccacctaaataacttgctggtcagttttatcccttcagggctacatgggagttggtctagagaaggcttggctttaatggtagtagctcctacctaaggcatgatccttctgagtctttactaaatgctcccagtgtcaccgtgttctcttcactcaggttagagagaatttgaggagtctcccagtcctttataagtacggggagacaaggtagagccgagctctaccttgtctctcggatctaccttgtctctcggctctaccttgtctctcggctctaccttgtctctcggctctaccttgtctctcggatctaccttgtcttctttttctctcagcccagatccagtaggtatcaggaccttcaaggtaaggt

SEQ ID NO: 118381 - DNA, 592 bp, Homo sapiens
caggtgaagagaggcccagtctgaggacaagaccctcgcccttgctgagctacaattgtggtggagatttgaagaggtcacatcagtcactgctcaagcagtcacacaaacgccaaacagaactatgatctagggtctgactctctatgtagacggaagaattgtgttaactataattcccttcatccacgagtgtgctcacacgacagtcacacatgagccaagagctcaaactaagcaagttgttatgtctcactctggggtcaaacccattacctggcatgctaagttttctgaagttccaatatatgagtttgtttcccacagttccttttactgaagggtgtcactgaatcatttgtatctggacagctcctgccacctccccattctctgtaggcttctagccacttgaaagcctggtgaggcataggggctggacaatccaataagcaacaggctgagtttttgctgagtgtgcaccctctgtggcatgtgtgcaggacacagagacatgtcctgccactctctaccaggtagctgaggtcccaatgccaggaactgcagagatagcttgctagcattttaaata

SEQ ID NO: 118382 - DNA, 416 bp, Homo sapiens
  misc_feature (12)..(12): n is a, c, g, or t
ccctattgagcncgcacccctccttccctctctcacgatcttcctctctcacgtatgggagggtcccaggatctaggccactggccaatcccctgcacttgaactactaccttaggctactctccacttctgaaacttctctcccacacccttaggaatcccaaattccccacccaccaccaggccactgggcatggcagagaagcataaggttttaaagtacaattaactcctaacccctcctgaccccatcgcatgtccctgtgttcccccaaagtttttcccaccctggttagcatcgctcatccacacatcctcttaggtggccctgagcgtcgctgattggtgtggtgcctacgtctcctgcagtagccgttgaatgaatggagacatgaacacacgcatacgtgagagag

SEQ ID NO: 118383 - DNA, 458 bp, Homo sapiens
tgggtgatgatgtgtgacatgtgtatctatatgggaatcatgcctctgaatgtgtactgtgtctgtgtgggggatctgtttagtccttctataaaaacaaaacaacatgctcgtaccagccaacatttcaacgcagctaccccaagacttcctgcttctattctggtgagaaagggaagcttcgggcgccaacccccagtggcctaatggaaagggaagcttcgggaaaagccaagagaagaaagagctggtgtgtctctgtcattttcatctgggttaagattggagggaagtcatcattggtgattgtgctactgtagggccggcagcccacgccttcccatctgctgaaaggatgaagtcagtcctctgggggaaaagggggtggagaggggactctgtaaaaatgaaaaaggaagctttttaggagctttgaaggaggggttggggtagaggga

SEQ ID NO: 118384 - DNA, 262 bp, Homo sapiens
tgactatagtacttgctaaagtttgagaatcgtggaactggatgatcacacccatcatttattgaaatcttttagacctcaggaaggcaactctattctttatgccttctacccagtatttaggtggcactggctgtgtgccagtcacttcccaggcaccagggaaacactccttgacatgatagacaagatccctgctctccagcagcttacatttagagaaaggagactgactgtaaaccaagattatggcaggtataat

SEQ ID NO: 118385 - DNA, 198 bp, Homo sapiens
aattgaaaggtataggatttctttcaagatgatgagaatattctggaattagatagcggtgatggttgtgcaatattatgaatattctaagaactactgacttacacactttaaaatggtaaaaattctgaatgttatgttaggtgaattttatctcaaaaaaatttttttaattctaattggaattttgattgagat

SEQ ID NO: 118386 - DNA, 471 bp, Homo sapiens
ttcctgatcgcggcctgctgagctcaagtgacccttccacctcagcctcctaagtagttttgactacaggcctctgtctcccgggttcaagcgactcttctgcctcagcctcccaagtagctgggactacaggtgtgccaccatgcctggctaatttttgtattattagtagagatggggtttcaccatattggccaggctggtcttgaactcctgacctcatgacctccccacctcggcctcccaaagtgctgggtttacaggcctgagccaccgcacctggccccagctgtgtgatcttaggcacatttacttcttgtactctcagttcctcatgtaaactcgggataataatatacgtcttgccgatctgtcatgcttgtgtccaggatcaaatgatgcaacgtgtcataatgtacacgaaaacacttttaaaagcaccacatgctccacaaatgtcgagtattatta

SEQ ID NO: 118387 - DNA, 249 bp, Homo sapiens
attgagtcttttgttattgatatatatttctaacctatggctcttccctttctcaacttagccagatgttctgcatttattgtcttcacttatttggagatggggtaacacagggaaatagggggaaaaaaatcctgagtcaatattttgccttctgagtttcacaaaacctatacctgaagaagggggaagaggagagatcttgatgcatagaagaaaagcctcatgagaaacagccagcttcttccc

SEQ ID NO: 118388 - DNA, 299 bp, Homo sapiens
cagcctttagagtcacactgcagctacttttgtacaacttgggaaagtccttccatctctccaagcctcagtttcttgctgttaagggggataaataatcatacccatcacagagagttaccataacaattaaatgagttaattcatgtaaaatacctgacatgtaataagctgcacttgaatgatagctactatcctaataataataatgttgttgttgtcatcatctgggttaccagctgatgataagtcaaaaggtatatgttagaccataagtctgtgtctgactacctagacct

SEQ ID NO: 118389 - DNA, 394 bp, Homo sapiens
cgacttctgctctgcgtcgaccttctgctctgcgtcgaccttctgctctgcgcgaccttcaatgctctgtgtacttagaccttagactcctcaactatctcagagggcttctgcctagtctttcacctcttccaaaagactgattccatggccacaggaaaacatgcccccatgtgacaaacagggcttgaactcaggcgatttgaagtactggtaatgctctgatcatgttagttacataagtgtgttcagtttacaaaaattcacagaactaaatactcaatgctatgtgttcatgtctgtgtttatgtgtgtgtaatgtttcaattaagtttttttaaaaaagagatgatttccaaataagaaagccgtgttggtagggcaggagcagacc

SEQ ID NO: 118390 - DNA, 525 bp, Homo sapiens
gcatgaattgcagggctgtgggagagatgctcaggaaggaaaatggctgttgggcagcccctgcctcccttactcagtcttctggtcttaatatgagcaccatataggtatccatattctcagtttcaggcatgccttcctctgatctacaccacctgtctctcaagctctttttctccactacccaaactgtagcatgcacttggaccccagtagggtttaaaatccattgatcctacttttcatggttgctcactcacctcaacttcttacttccccctttcactggtttctattgcatgatccatcattgtaaagatacctttggtttcacaccttgcctttctttcactttgttatactcatctggcaaaaatccccatcttgttcaacttagctatttctcttgcttgtccctgtgtatctgaccatggctggagataagcatgcagccatcccatttcctatccctaaattctaggactccaatgagttgttcacgatgcccagcagtccagccatgtt

SEQ ID NO: 118391 - DNA, 554 bp, Homo sapiens
cagcctcccaaaatgctgggattacaggcatgagccatcgtgccaggcctagactgggtaatttataaacaatggaaatgtatttctcactgttctggagactggaagttcaagatcaaggcgtcggcctctggtgtctgtccagggcgcctcgttactgcatccttatgtggtggaaggtaggagggcaagagggctgggcgctcccatcagcctccttcacggcacccatcccattcatgaggcctgccttcatcaatattataaaataaaaaatatcccataaaaataccactggaatgtagccatgctcctggatgccagcctagagttagcctcagagatcaggccagcacacctgtaactctgtccggcttgcactattaataaaaatatcctatcaataaaccagaggccctcaatcccatgataccttaagagattcagtagcttttcctgagtttaatgaaaagaaaaaaacttctgcccttaagtagaactaaaattaatactttattaacatgctaagaacattttaaatcaacaaccaccag

SEQ ID NO: 118392 - DNA, 269 bp, Homo sapiens
tgaggagggaccagccacaggaaaagccagagagttttcacagcagaggaaacagtaagcgtgcaagttctgcagcaggaaggagctgggctcagggacagaacaaaggcctgtttgctggtacacggagagccagggtccagggtcacaaaatgagcttgcagaggtggagatgagtcacaggatggggccaagggaccatgccaggagcttgggccttatgccaagaatgatgagatgcccctgatggtaggaggggtccatgaaca

SEQ ID NO: 118393 - DNA, 197 bp, Homo sapiens
cacccccaacgtcaaatgtatacccaccctctgttcacacgattcctgtgcttagaaggccctgtccttcttccagaagacactcttcccacttttcctactttaacctcatctgtgaactctttcccactcatgcataattaaccattcagttctctgtccttccaaagtactttgttcacaccattaattaagca

SEQ ID NO: 118394 - DNA, 286 bp, Homo sapiens
ttagtctgtttcccttattacacatgtggtttcctctttctaaattcggacttatgccccattttagaaggtcaggagaaagtaacgcataatgcaaaagtatttcaagcaaatcatatgatatctgtacttgataatttctcatggttttacaccaagagaatcactgcatattgaagattacacattttttaaaagctagaacactgagccttcctttcagacaattcaaacaaggagcgtattgctgacacagcaacactgtggtctcagactgtgggaaatg

SEQ ID NO: 118395 - DNA, 602 bp, Homo sapiens
cttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatcttttta

SEQ ID NO: 118396 - DNA, 400 bp, Homo sapiens
gcctgtacaaggacagtactaagttgaagagctcaccaattatgaaagaacatgatttgggtatatttttgcccaatgacgcttgcagtaagaagccaagggttttttcttctgagaagtggccagtcatttgaaaacggctggaagaaatgattgtttcaaaattggaagacatttcctccacaggacaaacttcgctgtggctttgtatattcaggcaaataggaagaaatctaacaattgtagaggttaaagaccttgagttccctggaagcatggcaggtttaatatctttttatatgcatatcggaaaattgagtttagcagaaagtcatttcactactctgaccactgcaagtttatgtaacttttgacaagtggattaatgttttcctatgtc

SEQ ID NO: 118397 - DNA, 480 bp, Homo sapiens
tgcatggagtggccagccactgggcttcagagccaaacaaacctgggctcaaagcccagccctgcccccctgttgtgtgatgtccaggacagtggtgctagtagttgatgtgctcatctgccccacctctgcctggctgtactcgcagctagtacatgtatagtatataagtgcccgactgtatcattgtatgttccagagtggtcagggtcagggtggtcatggctgagcttttttttttttttttttttgtgcgtccctgtgtgcccaggctggattgcagtgggccccatccggattccttgaagccctcaaatttccttccgggccttaagtgatctacctgcctcagcctcctgagtagctgggactacagacctggaccaccaagcctggctaatttttaaaaatatttgtagaagttgggggggtcggggggctctgttgcccaggctggtctcgagctcctggcctcaagtg

SEQ ID NO: 118398 - DNA, 202 bp, Homo sapiens
ctccaacatcgaaaattacatttcaacatgagatttacaggggacaaacacccaaactatatcagatgtcatctggcttgtgaagccttaaatttgccctgaattggacttactttgccccacctccgtgattccagagctcatatctttcattatgcagcattgatcacattcagtcgtacactttagttatataaccttt

SEQ ID NO: 118399 - DNA, 519 bp, Homo sapiens
gcagatttcaggcaatctcagttcctacttatccactaattcttgctggccatcacttgaaaatagtaagcatttcttgtttgtctattttaaaatgaatgttatggtatatatcttaggtatatgacatgatgttataggatacatataaatagttatctgctactttgtatcctctggccaacatctccctgtttcttccccctactccagcccctggtaaccagtgttttattttccatcactgtatatttgactttttttttttaagattccacatataagggagatcatgcaatagttttctatgtctagcttatttcacttaacatagtgccttccaggttcatccaagtggcagaattgccttctttttaaaggctgagtaatatttcattgtctgtgtatataaatacatacatcagtttctttattccttggtttgttggcaaacacttagatggttgctgtatcttggttactgtgcataatgttgcaatgaatgtaagggttcagata

SEQ ID NO: 118400 - DNA, 569 bp, Homo sapiens
gagcggggcgcgagcggtgttcaggccggggctggtgagagggcgactggctgcgagtgcctacggggtttgttggctgagacgtctagcccactccctggaggggtcggcacggccatgctctttggacatcatcttccatactaccccggttcgcagactcgaggagcttagtagaggctggcgggacgcccgagggtactgtgtggatggaggctgcgcgtcggacactggatccgagaggaaaattagttacacagctaattttagataaattgagccagttgatagaatttgtcatgtttagactccttctgtgtttgagttctctccccgacccccaaccaaattgtaggacgttgtctttatgagcctggcattcagtaggctttaaaattaatatctttctgggttgcagtgattccaagcataccatcgttctgtccaccaaaccagaaacaagaagtaatcacacatcttcctaatatgcccagataggcttaattattgttcccaatggagaaaatttacagttaaacatcaggtttcccttagggtgatcatgatca

SEQ ID NO: 118401 - DNA, 267 bp, Homo sapiens
ctgtctaacatagcaggtttctgtccaacctcccgtcccaggatctaggggaggtgtgaatgtaaaggcaagagaggacaaggcattgcatggagcttcaaggagcttcagcctgcatgggaagttggaaaagaaaccgcagtgtgggtagagctcagggctcccaaggatttggtccccacaggcactccgcttgccagtttacaaagtgctccacgggtatcattttagacagccctccaaacagcctcatgaggtcagatttat

SEQ ID NO: 118402 - DNA, 234 bp, Homo sapiens
tagaatatagtttcatttaaaaaaaattgatggggataatgccaattcgtctgagatttcacagaagacatgagtactcatcgtgatcttggggaagggataggtttggggttggcaaagaattgggaacattgggtctggtggggaagaaagtgtcagtgaaaaccagaggtgggactgatcctccatgggatactctatgtgaatgcaatggagagcctgagtccggggaga

SEQ ID NO: 118403 - DNA, 876 bp, Homo sapiens
agacaaatatccctgaacgcttcaaagcagatcatgcaccttggtccactgggatttctccattgcagagcctcttttggaagatatggttttgccctgggttttcctaaggatggaatggctacagagaacccactaatgagatgtctccagaagctggagctggggctgtctgggtgggtcctgggagtcctgaagcaatcagaaagcagtgagtgggttctagaaggagatggtttttgaaggtgggggagacttggtcaagactcaactcttggttctgtctgttctctacaggacttcaagaggctgatcaccaatctgaagattgacttcttcccagggtccccactggctacctcattatctttcaacagcctcatgctgatatctacagcaaagcagcacacctctttttttttttttcttgagacggagtctcgctctgtcgcccaggctggagtgcagtggcgcgatctcggctcactgcaagctccgcctcccgggttcacgccattttcctgccttcgcgccattctcctgcctcagcctcctgtgtagctgggattacaggcgcccaccaccacacccggctaattttttgtagagacgggtattcaccatgttagccaggatggtctggatctcctgaccttgtgatccgctcacctcggccttccaaagtgctgggattacaggcgtgagccaccacgcccggccacacctctttttaagagacaacatggggtgctcagcaatcatggaatttgccaaaataattaaatacaacccccaattcttctctggacaagttatccaacatatctgagcctcggtttcctcatctgtaaactaataaaataaaatctacctccc

SEQ ID NO: 118404 - DNA, 689 bp, Homo sapiens
ggcagggaggtcatagcttcaagcagttcattcttcaggcaaggaaaactattgggaagatttcctttttgttatcgctggcatttttatttaatcccatcattttccccacagtctgggcagaagtacaaaagcttcagacaggcacattctgcccctttctctttttctcgctgccaaaagtaaccttggcaattgatggtttagggaaaaactaccacgccccctttcctcaatcttattttctctcatccatcctttcttattctctttttttcttcgcacttctcttggggtctaaagatcaggagggtagaaagagtcatcttaatggagcctgatgttagcagccctgcctatttctctgtattgattgtagtggaaggttaggaagaaatcttccctgcatgagggcacatatgtccctcccgcagtcgtcagcctggttgctgtggaagagggctggtgttgttattagagcctgtcacagccaatgaatttcattccaggccctacacaggaaacttcataaaggaaaaacaccaagaatgaaaagaattcaagaaccttggtttgtatatctgagtgcacattaggacattgaaagcacatttaatttcatgcagaaaatcatcatgatatcatcacaaaagacagttttgaaatcagaaagtgaatacggtaaaagg

SEQ ID NO: 118405 - DNA, 503 bp, Homo sapiens
gccaagctaaaaatgccctgggggtaactagcacttggactagttacaggaatgtagcttcgtctcagaggattccaaaagctaatgccttgcttaccaagggcttgtaatctcacaggatgtgatgggtggggcctcagatctgctgatgggagcataaattggtacaaccactttggaaggcaactggctatctagcaaagttgaagaccctacaatctaacagttctcctaggtgcatatcccagagcaagtctcacattgatgcagtgagatagtgaataggaaagttcatagcaccattatttttaagtagtaagaacccggaaacaatctaaatatccatcagtaatagatatatgtgatagtcatacaatggaatactgtggcaataaaaaataattagagctacatatgaaatagggatgaaacatggatgaacaaagaatgttttagaggaatatgatatttaaaatttgaagcatgaaaaatatgtgtttatg

SEQ ID NO: 118406 - DNA, 454 bp, Homo sapiens
aattgcttgaaccctggaggtggaggttgcagtgagctgagatggcaccactgcactctagcctgggcaacagagcgagaccctaactcaaaaaaaaaaaaggacagaggggaggaaggagcagaaaccaaaaatggcaattagggagaaatctcaggaatgtggcatcccatctccccttgagacctatcactgaattcacaacccttcgagctcatgctggtgcactgagtcccttgggcgctgtaaaggtttaaccccttgactgtaaactcagacttagagacatctgagtcacacagtccccgccattgtcacatattctcactgacactgcagtctgtgactcctccaatgtttcacgtgtattttatatttattgatgtctccttccgcagattcatttctttgtacttaataaactttagtaagtggaaatgcttccagtcgtttc

SEQ ID NO: 118407 - DNA, 460 bp, Homo sapiens
tggtgcttcgcctcaagcgccttggcgggaggcaggtgggggccctgggaatgaacctgtgccccgagttcctccttagaaagcaggtggcggccctggccttgtttctaatatcttcctccacctctaaaaattaggtggcagagccagctccactctgcgtgtgcccccgactctattccgcttgtgagccccactcggaaagtaggcagcggtccggacttcccttagagtcttctaacttaaaaatcgggcggcggcacattcctgggaaagggaatgtgtcttccctgtgaatgtgtctttcctgtgaatgttctctgcaaaagtcagatagcttaatcagaccaagtcagatgtaactacgatctggctgcagaaagccggcgtctgggctccttgctttatgtcttatatcccttttacattccccacaggttctaagcagtagacctgtcat

SEQ ID NO: 118408 - DNA, 249 bp, Homo sapiens
gttttatcctagattctgagaggtcctcaaagtgggagagtcagctgccaaggattaaagggcaaggaggaattcaatgaaggctaggagtaaagggataagaataggactataagccaaaacagcaagctctttatcactgtcttggagaccccggggggatcatttaattcctctgcacctcactgcctctacctgaaaaactgagatatttagccacttggtctcatttgtagggttgtaatgaga

SEQ ID NO: 118409 - DNA, 253 bp, Homo sapiens
aggaatgtagcagggcataggcacatatgtacagagtgacattagtgttggggggcaggaaatatgaagagatgtcaagtagaaagaagataatgccattcaagagttgtcaagggccaggatatttaagcagaaagcagctgagtacattacatcagatgtggccaagacaaccagggacagagagagcaatggccaggagacaaccttggcaggcctgtttcctggcacagtggtatggactccacatttt

SEQ ID NO: 118410 - DNA, 488 bp, Homo sapiens
gataaaggacatctagaaaaacctcacagttaaaaatcatacttaataagactgaatgcatttcccctaagatcaggaataagacaaggatgcctactctctccactcctagtcaacattttactagaggttctacccaaggcagttgggcaaaaaaataaataaataaaaggcctccagactgaaaaggaagaattaaaggatgatgttgtctcttttagcagacaacatcatcttgtaaacagaaaatcctaaggaatccacacaccaaaaaagttagaactaataaagttcagcaaggttgtagaatataagatcaataatacaaaaatcaatcatgttctatatattagcaatgaacaatctgaaaatgaaatttagaaaagaaccatttacaatggagccaaaaagaatacttaggaaatttttttttttgagacagagtctcgctctgtcgcccaggctggagtgcagtggcacgatctcag

SEQ ID NO: 118411 - DNA, 190 bp, Homo sapiens
caggtctccaggtgtccggctggagccctctccacttcctccatgcctcctgagaagctgctggaagacatttgttccctgtgggttgggtgagccatgggatggctcccagagaaatggcagaacaggctaagtacttgggcagcactatttgaggcactctgggccattgccagacctagaggctggg

SEQ ID NO: 118412 - DNA, 403 bp, Homo sapiens
caaacatacaaatacatataggtacctagttccttcattctccatcggtgcaatactgttgtgcaatcgacttatttaatgttttactgtattcacattgtgaacacttttcacagctgagccatgtggtattcttttgttacttttctattctttcacaatttttgccttctctggagttaatctttttttttgtttgttgctacaattttcaatgtacttagctgtcactgcagtgctaagccatctacatgtttttttctaattgactaaatcctctctcagcatgttaaaataccaaagtccaggagtttaattaaagacatctgtttttgagccttcccacctactttattcagaatgggtttctgcctcagttttgtgcataacttttacgctgaaa

SEQ ID NO: 118413 - DNA, 482 bp, Homo sapiens
ctcccatgcacatagactttaccatgccatgctgtcactgcagcagggatagggtgggggtggtgtcagcaattcaagactatctttcctaccctctgcagtgcctctttcagctatccaggtactgagtgttcatctgattttttgttctcatgtatgtatatgtgcttttttgtgtgtagatagttgtcaaatttggtgttcctgtagggggatgactaatggaaactttattcagccactgcgctcttctccttattctccttatattattgtcaaggaaccagactagactgggtggaatttcttcctggatggagaataatttttaccaatataattgttaaaacaaagcaaaaatatgtatcactgtttcatgacttagttgcaggattcataacccaaaccagtaaactcgtactctcctttcttggacctcttcagtctgccccaaagactgggaattttatcaagcaagatgt

SEQ ID NO: 118414 - DNA, 259 bp, Homo sapiens
attatatcacagttctttctggaacgttgctcatgtagcttcctacatatgtgcaactatcctcctctttttctcctcatacctgcctaccccctctgttcatattcccctctcaaaatctctttctgtttttcttttcttagtgactttcaagatgtccttttaactaggaatagaacctgtcagatatgctaacataactgtatctgctttcaaattgtgtgacctcttgttgatggtgagcaacatattttcaact

SEQ ID NO: 118415 - DNA, 351 bp, Homo sapiens
cagcccactcggctgaatgcaaccaacaccaatacccgtgtgaaccacttgggactaagaggatgtttctgccactgccattgtcatcattcacatcaagctggctgccccaggggttcaagaacatccccacccaccccacctactgttgtcactgctggcatccaagtaatctgtctggaaactcaacaattggcccatctggactcactaacaatggtgccagaccaccctggagcccaaagacacacatactcatcccactgctgccaccactggggctcaaagaccgacctacctggtgttacagtccccagcaaaaccacagcctcatttaataattgcaccctg

SEQ ID NO: 118416 - DNA, 390 bp, Homo sapiens
atacattataatgaaacagtagtacattgagactgtcacctttttaaactaccgagggttctttgttgggtgctttttattatatatgccttttaaacttttttttttaatttcacacaaaggagtcaggtgcagtggctcacacatgtaatcccagcactttgggaggcagaggtgggcggatcacttgagtcaggagttcaaaaccagcatagccaacatggcaaaaccccgtctctactaaaaatacaaaaattagccaggtgtggtggcacatgcctgtggtcccagctacatgggaggctgaggcaggaaaattgcttgaacccaggaagcagagaacccaggaagcagaggttgcagtgagctgagaccgtgccattgcactcc

SEQ ID NO: 118417 - DNA, 1401 bp, Homo sapiens
  misc_feature (595)..(595): n is a, c, g, or t
  misc_feature (657)..(657): n is a, c, g, or t
aatttaatttatttagctattaaatgatagacttggtctaatcaatgtcaaatttcaaataagttaaatttgaaggatgattagagatgatgggcatttaattcctagagaagaaaattcatttttaaaaaactaaagaagaaactaaaaactccatttattaatttactttttttcctttttcttttcttttccttcttccttttcttttttttttttttggagttgggagtctctcaacctctttggccgaggcgtgaagtggtgccacttgtggtgttgaatactcaagctctcacagtgtgcaaacctctcgtggcctctcgcggggaactctcgagagtgtgaatctctctcctgtggccttcagagccttcgcacaaaggtatagctgggagattaacagggacaacacacaaccacaacacaaacatcttcagacctataattttgtggaccatctcccttatagacaagaagtatgttggggttcacacacatgtgtttgggggcacagaggcgtgggctctgggaactctcgcttgaaccttcagggggtgatctcacacgctgtgccttggggggcctctcccanaagaggtatcagcgggggatatttacacggagcgccatatgacaaccccgagtgtggttggnccccatatattctaatatgtacacatcatgtctcactctgtggttgggggacactttatattgcggggggggatatctctccagctattttctcccatattattcacacccagcgtttctctgggggtcgactacacatcctccttctcgtggggacaccaaaccatctacaatattccatcaggtgttacagagcacccacttctccatatctaccacactcaacagtgggctcagcgataactcgcggggtcgcctacattttagaaaaaccaatcatctcttcctgggtcttctcctaaaaccatgtctcatatatttgtctccctctcaaaatcttcaccttttagactttttccaccgccatatataagacttctcccatccataagtcttcccctatctacataagggggggttcccacagcacaccggtggaacgttcctcttgtggagacgccactaaattcgcgggtggcggctacaattttcatcaaacaacaggtctctgtggaaaaagttcgccccaaaagtttaagtcgcttccacccgccgtttctcatattactcacaaggcggactagagggtgcgatccatcaacaggactttgtgggccgacactgtgagtgtttgtgaattcccctctctgtgacaaaactgtggacaattacttggggggttctcctacaacacaagcgttcctctctatgatttccttccaccaaacggctcacaacggtcaa

SEQ ID NO: 118418 - DNA, 781 bp, Homo sapiens
tactttcacttttgctttaataaatcttgccaccgcacactctttgggtctgcatgtttctctaatggagctgtaacactcaccactgaggtccatggcttctttccttgaagcctgtgaaaccacgaacccttcaatcaagaaaagacctttgatcaggagaagacttctcgtctcatttctggggacacattcaggatttctccaaagcaggtgaaggtacgctcgagcgtggtcattgaggacaagtcgacgagagatcccgagtacatctacagtcagccttacgtctgcaggtgtacccaacagctccgaagagacagcgaccatcgagaacgggccatgatgacgatggcggttttgtcgaaaagaaaagggggatgtgtggggaaaagcaagagagatcagattgttactgtgtctgtgtagaaagaagtagacatgggagactccattttgttatgtgctaagaaaaattcttctgccttgagattctgttaatctatgaccttacccccaaccccgtgctctctgaaacgtgtgctgtgtcaactcagggttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccagagacctttgttcacgtgtttgtctgctgaccctctccccacaattgtcttgtgaccctgacacatcccc

SEQ ID NO: 118419 - DNA, 199 bp, Homo sapiens
atcctgccccacgctcatgagagctcttcaagaaagcactggcaatgctcacgatggattttgaaacaggcagagatgaactctcccaagtggtaattcccacacctacatcaacagcctccagctccagagagcaccacgtttatttcttcttgacttttttttttttttttttgagatggaatctccctctgtttcc

SEQ ID NO: 118420 - DNA, 500 bp, Homo sapiens
agacagaggataatcacaagttcctggaggataatattggaaagggaatctgacaggagagacatctgatcacactcagaggtggcagaggaacggcagtgggatgtctgttgccttgccatccagttgtttggctcaaacctctgcatacgcttcctcaaccagtacttctccaaggggcctcacatcaagtgagtttttcaaatgcatggagctacaaggcccactccagactagagtcagaacttctggggcaaaagtttggggcctgggcatctgtatctttaaaaagctcatcaggtgattctgatgcactccctgttgctataaaccatggccagatcgctgctcctgcctgggtcggtgtgtctgcctgaccattggtacttagagaacaggacggagacctgtgtaattctctccattcagaagctactctggcaccatacacaacggtgcacaattgaagggcttgttctgctcctccacatggcaccttt

SEQ ID NO: 118421 - DNA, 320 bp, Homo sapiens
aagggaaaacagcagtgttctgtatgcatagaattgcaccatccccctggcgccactgaccctgcctgctatcctgggtcagggatgtgcagtggctggaggagtggctgcaggtgggggtggtacacacagcagggcagcttctccgagaaggctccccactgtagccaccccctcatgaatgtcacacaggtgaggtccacgaggactgcagaaactaggaagccctctgccagaggctcactgcttttccctgaatacttcagcagagagtccatggagccactgatctaggaatgggaattgatgtcagtggacag

SEQ ID NO: 118422 - DNA, 244 bp, Homo sapiens
aaggttcaaggaatcgtgctggtgcttactagctgcattaacttgaaaaagtttcttagtctctctgaacctttctttacctgaaaaaattatgaggataattcctgcactgtatgtctatggtgatttttatgtgtgaaaaagtctataagacaccaatgacagcagtgggttccttgaaaatgctcattaagtggtaattgtaagatgatgatggcaatgacggcaatgaaggggatgcttg

SEQ ID NO: 118423 - DNA, 582 bp, Homo sapiens
ttagggcatgtgcaaaagagcaacgatagtgatcaactatggggtctaagttggtaagaaggaactgacaatgttgggaggtatggatgagggacagtgaaaaacagtagaatcaatatagctgaggttccacggaaattggagaattattgcagctggagttactacatagagatagtggtctgagtgcggaatactcaaaatgaagagtatgaagggttccagtaatagaaaagacaaaacccaggatgcgggtgcatgggagcaaatggtgaggaagaatgaaggaaagtatcactgcaggaagagagctcaagggtctctgactctacctgaataactacttcaaattccaaatacacacaatagttacatttataatttctgacaagaaaagaagaagaaattgagatgtttcttaacctttctcaaatggggttctgtcaaagaaaataacttaagtaactattctctcaattataccaatgatgaaaaatagctagaaccattctacatgaacaggagataagtcatttcattatatgcaatgatttgtttggaaactcattctctcatgaaacc

SEQ ID NO: 118424 - DNA, 282 bp, Homo sapiens
tagaggttattttaaagtgacaaggatggcttttttccttgggtgccttcccacatgtgccagaattacttatatttatagtaagtggcttgtcctttttattaacattgttgtgacatcgctgatttcaattttaccttatgcaacactaaaaacttccatgaattaccattggttcacctaaaatttgcaagattgctttattaaacctgggactagttattaaagttttatgagctccacgggtttcctcacattagattcaagctctgactactcaag

SEQ ID NO: 118425 - DNA, 346 bp, Homo sapiens
taaagaagagcaaaatattatcattattcaggtagagcaccacatttttccttttaattctttaataacttttgaaaaattgaagtagaaaaaaactacaattctaagatgacaggaaaaaaattcactagactaataattcagagatcaccttgaaattgtcctgcccctgtgactatgtgagtattgtccgcacctactcaaatgctgcctctaggcccagcttgtaaacatcatcaagtttcttttgggtattgctataccaatacatacaaaatctgttttcatcttagtataaactcacataggccacaataaaaagtgaaatttcatgtttttagagtaa

SEQ ID NO: 118426 - DNA, 700 bp, Homo sapiens
tgtggtggctcacgcctgtaatcctagcactttgggaggctgagacgggcaaatcacaaggtcaggagttcaagaccaacctggccaacatgatgaaaccatgtctctactaaaaatccaaaaattagctgggtgtggccgggcgtggtggctcatgcctgtaatcccagcactttgggaggttgaggcgggtggatcatgaggtcagatcgagaccatcctttctgacatggtgaaaccctgtctctactaaaaatacaaaaaaaattagctgggcgtggtggcaggcacctgtagtcccagctactcgggaggttgaggcaggagaatggcgtgaacccaggaggcggagcttgcagtgagctgagattgtgccactgcactccagcctgggcgacagagtgagactccgtctcaaaaaaaaaaagagatgatgtttaaacccaccatgtagctagctttggaaagacaaaatttttttggagggaatcttacttttcagtgactcttgagtcttccactcaaaagctgatctgctttctactctgcaagtctgattccaactgatcttgttctcaactattagatgaaacaacagcctctggtcctttggcagacagaaacatgactgcctatcaaatctcagttcagatacacacctacccatgtttgcataaggttctaatgccatctggtgatc

SEQ ID NO: 118427 - DNA, 555 bp, Homo sapiens
tccacagagagagaaggaagatcagtggtggccagaggctaagagggaagagggaatagggagaattgctaatggactcagggtttctttgggtgatcaaagtgttttaaaattgattacggtgctggtgcataactgtaaatatactaaaagccactcaagtgtacactttaaatggctgaactgtatgcaaattacatctaaattaagctggtaacaacaacaaaggttcatcccgctgcagtgtgcagaatggagacagggcagagaccagtgaagaggctgctgtacaaatgcagctggaaagggcagtggctgaagaacggagaggggttcacaggatcagactacaagggggccagaggaggagactacatcctgaggacgccacaaattatcctgggtacctggtaactctccagagaggagagtgggaaacaaatgaggtatctgcaattatcatcaagcagcaaacatgtatgtaaaatctcctacacataagactaagaggaacacacaaagtgtgcagccctgtgcaaaagtatgtggggagtg

SEQ ID NO: 118428 - DNA, 893 bp, Homo sapiens
agacgtgaagctggcccgagacgtggagccatgctgcgtaccgaagtgccccggcttccccggtccacaaccgccattgtctggtcgtgccatctaatggccactgcctccgccatggctggaccttcctctgagacgacctctgaggaacagctgatcacccaggagcccaaagaggccaactccactacgtcccagaagcagagcaagcagaggaagcgagggcgccatgggccccgcaggtgccactccaactgccgcggggacagcttcgccacctatttccgccgggtgctgaagcaggttcaccagggcctcagcctttcccgggaggccgtgagtgtcatggattctttggttcatgacatattggaccgcatcgccaccgaggctggtcgcctggcccgctccaccaagcgccagaccatcactgcctgggagacccggatggctgtgcgcctgctgctgccggggcagatgggcaagctcgccgagtccgaaggcacgaaggctgtcctcagaacttcactgtatgccatacagcaacagagaaagtgaatacgctgatacaagaagcaagaatattagaaaaatgtcatgaaaatagttgaagagaaatgctcactgcacaaggagaccaagaaaaaccccccacgaaatcagccacaactaaatcgctctggacggtgccgccaggtgaccctacatgtccggagcaacactttgaaaaccaaagacgcttggcagaaccctgttcctttccagagacagagctgtgtaccttgtctaaaacaccgcatctcactcagtgacttatttctcattatgctaattgttttcgctttaaagcgccagtctttctgtcaaatgggacatacaaataaatttctaaa

SEQ ID NO: 118429 - DNA, 660 bp, Homo sapiens
agagattgtgtatttccaggaatttatatattttctctagattctagcatgtgtgtatagaggtatttctagtagtctctgaggatctttgtatttctgtgggatcagctgtaatgtcacctttgtcatttctgattgtgcttatttggatcttctctctttttttcttttttaatctagctagtagtttatcaatcttttttttcctttcagaaaactaacttttgatttcattgattctttgtatggattttggggtttcaattttgttcatttctgctctgattttagttatttattttattctgctagctttggggttagtttgttcttctttagtttctttaggtgtgatgttaaatcattaatttgaaatcttctaactttctgaggtcagcatttagcactataaactttcctcttaacactgcttttgctgcatcccagagattttggtatgttctgtttcttttttcatttatttcaaataatttttttattcctgcctcaatattattgtttacccaaaagtcatttgagaggaagttgtttgatatccatgcaattgtgtagttttgagagatcttcttggtattgatttctatttttattccactgtagtccaagaataaggctgatttggttttgatttttttgaat

SEQ ID NO: 118430 - DNA, 299 bp, Homo sapiens
ctgtctcaaaccttaaccactctttaactccttccaaactcctaaaagattaccttgcctacttcctccaagagaaaaggaggcccttttgtaggaacttcctcaactcttgcttcttacctcacctgcattctcagtggaggtgttcttcctcgtggacaaagcagactttttttctacctctgctctgttttatatcccatctggccttctcagaaaccttactctactggttatacccttgctatctatctagtatcttcactatctctctgttattgcctcttcaccttcagcct

SEQ ID NO: 118431 - DNA, 300 bp, Homo sapiens
atattcattgagcattaactccctctcttcatgtgactctagtctagaggttcagagacctggactccctcaagtcttgcctttaccattaactggttcttaaccaagaaccagcctcttaattcacactaggagattatctgtaaacgaattcctttcctgttcagctatgaagttcaaatgagataatacacataaccttaactttgaaaattataaaatgtctcacaaaagcatagtattagctgtgagagtgcatgtgtctacatgtacagttgtgtacatgtgatggtccagtgg

SEQ ID NO: 118432 - DNA, 238 bp, Homo sapiens
ttatctgtccacagaagaatctcctcccaaatacagaacttgcagtttttccaaaatgagatgtccagagaccacaaataccacaccactgggatcaacagccacactgggttactgaggacacacctcaaaacagcgaggaggagtgcacgggagcagcaccgactctatgtctatgtaatgttccaatttctgcagttacataaatgaattctgaaatcgctgtgtgttggtgctt

SEQ ID NO: 118433 - DNA, 679 bp, Homo sapiens
  misc_feature (254)..(255): n is a, c, g, or t
agacagatagaatcgagccggtaccaattccattccagcgtagagcagcccaagaggcaccgtacccatgttaaaactgcatgcttgtactgcaaatgcagcttccagacagcggctcccaccctcagctactccgccatgctgctgcccctgagctctttgggagctgccactgccaccccagtgggtcaatggggcaagttggcatgaggaacaagaatcattgtcagaaatcttaaagaatccctcactgnncgggcacgtagctcacacctgtaatctcagcactctgggagtctgaggcgggcagatcacgaggtcaggagattgagatcatcctggccaatgtggtgaaaccctgtctctactaaaaatagaaaaattagctgggcgtggtggcgggcgcctgtaaccccagctacttggtaggccgaggcaggagaattgcttaaaccagggaggcggaggttgcagtgagccaagatcacacccctgtactccatcctgggtggcagagcgagactccatctcaaaacaaaaataaagtatatacctactttgcggaaaacagaaactttgtggttgctgaatactgagacattactctcttttctggtgactcattctggtaattcagtttatctcttctgataattctaatgcctatcttttcccactg

SEQ ID NO: 118434 - DNA, 290 bp, Homo sapiens
tggctatcaagggacacctggggccgggcaacttctaaagaaaagtggtctctttggctcacagttctgcaggctgtacaagaagcctggcaacagaatctgcttctggtggggcctcagcctgctcccacttagggtggagggtgaaggggagccatgtgtgcagagggcacagtgggagaggaagccaaagggagggaggggccacgctcttttaacacctggctcacgcaggaactaattgagcaagggcccgctcatgactggcaggtggggtcggcaggaagcca

SEQ ID NO: 118435 - DNA, 366 bp, Homo sapiens
tagtgtttatccctccttatagggtgcaaaaagtcccttgtgcttagtgagtctcagttaatacctacaatggatgatgagtctccagcaagggattaatgacttataaatcattggaggcatggtggctccaagttatatgtacatattagcacatgtgtccaagacctttctttttctctctccttctttctttcaccctttgttttcttttttttttttaattatactttaagttttagggtacatgtgcacattgtgcaggttagttacatatgtatacatatgccatgctggtgcgctgcacccactaactcgtcatctagcattaggtatatctcccgatgctatccctcccccctcccc

SEQ ID NO: 118436 - DNA, 408 bp, Homo sapiens
ctcagattcaaaacagtcgagggctagatataaaactttatattaaccttaagttaaaccattatcaagagttagaattacgactatgacctaggataaaatgagtaaaactagggattgtttccttctagttttgtttgtttgtttgtttgttttttctgagacagagtctcgctctgttgcccaggctggagtgcagtggccgatctcggctcaccacctctgcattcaagcgattcgcctgcttcagcccgcgcctgtcaccttctagttttatactatgatttcagaagataagaatattggttcctatgaccttccttgctagatggtaaatttcataaggccaaggggccatagtctcatttttatcctctccttgccacatgtaacaccaagcactatacc

SEQ ID NO: 118437 - DNA, 552 bp, Homo sapiens
cttaagacacaccataacccagagcaaggccctaactctcttcaactccatgaaggctgagagaggtgaggaagctgcagaagaaaagtgtgaagccagcagaggttggctcatgaggtttaagggaagaagccatctccataatgtacaaatacaaggtgaagcagcaagtgctgctggagaagccggagcaagttctccagaagatctagctcagattattgatgaaggtggccgcactaaacaatagattttctttttgttgttgtttttttgtttttgttgttttgagacacagtctcactctgtcacccagactccatctcaaacaagcccactccagcagggggtgccatatgctagagaatctcctgggccgggcccgaccaagccaggccccgccaagccaagccaagcgggcagggccaggcatggtggctcaggcctgtaatcctaggcctttgggaggccgaggcaggcagatcacttgaggccaggagttcaagaccagcctggccaacatggtgaagccctatctctactaaaaataca

SEQ ID NO: 118438 - DNA, 381 bp, Homo sapiens
caaaaattagtcaggtatggtggcacacgcctgtaactccagctatttgggaggctgagacaggagaatcacttaaaccagtaaggtggaggttgcagtgagctgagatcgcgccattgcactccagcctgggcaacagagccagactccatctcaaacaagcccactccagcagggggtgccatatgctagagaatctcctgggccgggcccgaccaagccaggccccgccaagccaagccaagcgggcagggccaggcatggtggctcaggcctgtaatcctaggcctttgggaggccgaggcaggcagatcacttgaggccaggagttcaagaccagcctggccaacatggtgaagccctatctctactaaaaataca

SEQ ID NO: 118439 - DNA, 227 bp, Homo sapiens
tttcaaatcacatcacatctaatttaacttttaattttaagggactggtccagatagtagctgagaaccattgtggagacacaaaatgggaacaagtttcctaagaaagctaacaggccatctggggcataatctaacaatgaatctcatctaaacccaatgtcccttggaatgaagtttttcctcttaggattaagacatttagttctatctcttgcctagaactt

SEQ ID NO: 118440 - DNA, 379 bp, Homo sapiens
cacactcacctctctctccaggccccccgggttccctccgcctctcttgctgcctgttctctccttttgcaggttgcgtttattggcttatctctgggggttggtgctcttccttgttttcatggaaactgcatggccccaagaggcccaagcagctttgagctgcaagggcaggatcatgcaggccaccgctgccctgccgcttagccacagggcactatttctgactcggtttattagagacatggtgtggcagtctctagaccccacagtcgggctggcatccggggacaggaccaacatccccacaccccagaggcgaactagtggtgagtgtaaagagcccctctccaggggaagacagccagccgggtgcagt

SEQ ID NO: 118441 - DNA, 790 bp, Homo sapiens
tatgcctctacttcattccttcatgtgacaactaatgaaaaaacagatggaccctgcttgcaaaaccataggtactaaaaaacaaactccagggccacttcagcctcttgagtagctgggattacaagcacaagccactgcactgggtaagttcatacactgtgtgtgtgcttgggtgtgtgtgtgtcagggtctcattctgtggctcaggctggaaagcagtgatgcaattatagctaactgcagcacgagccactgcactggctaagttcatacacacacacgtgtgtgtgtgtgtgtgtgtgtgagattctgtggctcaggctggagtgcagtgacacaattatagctcactgcagcatgagccactgcactggctaagttcgtgtgtgtgcgcgcatgtgtgtgtgtgtgtgtgtgtcattctgtggctcaggttggagtgcagtgatgcaattatagctcatggcagcacgagccactgcactaagttcatacacgtgtgtacgtgtgtgtgtgtttgtgtcattctgtggctcaggctggagtgcagtgatgcaattatagctcactgcagcctgcaactcctggacccaagtgattttttacctcagcctcccaagtagccaggactacaaatgtcaaagtgtgggactacaggcatgagccctatacccagcctaatttcacacccttttaagcctgttaaaacatcatgtgacattctaaaatttttcaaatataagcaacttattttctttaagtggagaatcataaatgctcagattaa

SEQ ID NO: 118442 - DNA, 412 bp, Homo sapiens
taaacgcaccaatcaacgacctgtcaaaacaggccactcggctctaccaataagcaggatgtgggtggggccagataagagaataaaagcaggctgcccgagccagcattggcaactcgctcgggtccccttccacgctgtgggagctttgttctttgcaataaatcttgctactgctcactctttgagtccacgctgcttttatgagctgtaacactcaccgcgaagatctgcagcttcactcctgagcccagcgagaccacgagcccaccgggaagaacgaacaactccagacgcgctgccttaagagccgtaacactcactgtgaaggtctgcagcttcactcttgagccagcgagaccacgaacccactagaaggaagaaactccgaacacatctgaacatcagaagg

SEQ ID NO: 118443 - DNA, 103 bp, Homo sapiens
ttcacttacatttaaatccttatttaggcatgtgtgcagccttaatttccatattttaagctatattgcaggttacttatagcaatgctagaattcagtgaaa

SEQ ID NO: 118444 - DNA, 458 bp, Homo sapiens
acatttattgcttgctatgtgccatgtaatagggaataaatctaaatctccatggacttacattttagtgaaggaaactagacaataaagataaatttgtaaatgcagatagtaggtcaaatggtagaaagttctctatgaaaaatagttcactcctgtaatcccagcattttgggaggccgaggcgagcgaattgcctgaggtcaggagtttcagaccagccacatttcagcgttttaagtgtttaacgttaacacacacatgtcccatgctgacaatagcgtgtcatggacggcctgctgttagtgatgacctgacctgccacacaatgaacggagatgttcttcattgacgataatgtgggtgtccgaatcaggatccacaggtcagtgtcccagctccaccattgactagctgtgtgattccgatggagccaaccgtggactagtgggtaccga

SEQ ID NO: 118445 - DNA, 342 bp, Homo sapiens
ggctgaccatgaggatccccacactgggtcgagttccgtcacttgttacatgtatgactctgagcaagatacttaaacatctaacatgaggaaagagcataagataactaatataccatctgttccacaccacaccattgttggttgccaattgtcaggattaaatgttagacagcagcatcttaagtatcaggtccataccaatacacaagcaagatttgtcaaatgactaagtggaaaaatgaaaaagatagtctttctttttcattctccttgccctccaccccactttgatttccctcttttcacttttattcttttttttctttttttttttttttg

SEQ ID NO: 118446 - DNA, 431 bp, Homo sapiens
  misc_feature (192)..(192): n is a, c, g, or t
  misc_feature (231)..(231): n is a, c, g, or t
  misc_feature (297)..(297): n is a, c, g, or t
  misc_feature (383)..(383): n is a, c, g, or t
  misc_feature (395)..(395): n is a, c, g, or t
  misc_feature (429)..(429): n is a, c, g, or t
tgaactgatatatttaattagatccttaaagcccataggatttatactggtcatttctgtcaattgtgaatctgctcatacttgttcttcatgaaactatggaataatttttcatgtattttcatgtgtcaatctgaaaagaaacttaggttctccagaacagaggagtttatttgaaaatagcagaggcgngtggatcatgaggtcaggagatcgaggccatcctggcanacatggtgaaaccccatctctactaaaaatacaaaaattaaccaggcgtggcggcatgcgctggtnaatcccagctacttgggaggctgaggcaggagaatcacttggaacccgggaattcagaggttgcagtgagctggagatcacgccantgcactccagcngggcaacagagccaagattgccttttcaaaaaanat

SEQ ID NO: 118447 - DNA, 268 bp, Homo sapiens
ttcactgttaaggtctacagcaaaccaatcctcttcctccgttagtacgagttccggccaatgacgttcgccctcttaggtttttttttttagcccgccctccaaaagcgtgacagccgttgggtcataagtctacagggcagaatgttcacgtggcctatttcacgacccagagttcctctgaccagagggtttttttttttccttttccttttttttttttttcctgcagggaggcattatgggtttgtggtttttttcccccccc

SEQ ID NO: 118448 - DNA, 484 bp, Homo sapiens
tttccctttctcccatctacctctcccgtttttctccctcatgacattgatttgttgaaaagaatggtcggttcatctgtacctcatactgagttttttttattgcttcctcaagatagcatgtaatttcttgatcttccatatgtcttacaaactaagtctctgaagttaattaaaattcggatttaatattttagacaaaaaatgtcaatagcaacatgcttgatattgaagcacatcaggaagcacatcttttttggatcacttttaatgatactaagaataatagctaggttagtgatagtctaatccttccaatgtaaagttatattcttttagcttgaggccaactagaaatctgtggcatcatactttggctccatgggaatatccaattcccaaacatttttgtctgacagttttagcacccattaatgatcctggcccaaatcaattattcataacaggttgtaacaaattgtca

SEQ ID NO: 118449 - DNA, 616 bp, Homo sapiens
ggggggagggatagcattaggagatatacctaatgataaatgacgagttaatgggtgcagcacaccaacatggcacatgtatacatatgtaacaaacctgcacattgtgcacatgtaccctaaaacttaaagtataataataataaaactaaataaataaataaatctacgggtggatttttcagatgcactggcagagcaaatatcggttttatataaaaagtcagcataagccaattggagaaatgtgagggaatgcttctaactacttcattacatcctaatcacaaaagcagaaaggacaatggataaagacaaaagcaaatgtacattatcacattttggccctatacaactattaggacaagagaggaaggagaaaagcaggcccacgtcagtttaaaaatgccatacactgcactccaggtctggtaatctggctcaaccagattgaggctggtaacctggctcaaccagttctgcgatttcacccaagaacagaagacagcaagagaaactcactttgaccccctatgattccatctccaacccgaccaatcagcacaccccacttcccaagcctctccccaccaaattatccttaaaaactctgatc

SEQ ID NO: 118450 - DNA, 357 bp, Homo sapiens
tctatggaagtcctttgaaaacagaggtgtatgggttttttttttttcttctaatgtgtactctgtaagagtagaggcctactcttggtacttgctgtgttaccagagcccagaacagagcctggcccaagggagtggctccctaggtatttgctgaatgactggataaatgaaggaacaaacaggcactctccctaaattagcagagttcttcttctcaagaagtactattgtgctaagaatgtcttcagttcacttttctcttgggcacaatcttagcaaaaactgggaattgcatcattaaccccaagatagacagacagatgcatacacacacacacacacacacacacacac

SEQ ID NO: 118451 - DNA, 373 bp, Homo sapiens
aaggctccctaaggcctaggcacagaaccgacccatggatacttccatccacataccactggctaagcaagtcacatggtagaagccagcatcaaagggtgggtatactgggttgaatagtgtctcccaaaatatatgtttcttggaacctcggaacatgactttacttggaaaaagggtctttgcagatgtaattagttaagatgaggtcgtactagagtagggtgggccataaatccaatatgactcatgtccttctaaaaagagaagagacaagggaagcaaagacacaaaggagatggccatgcaaagatggaggccaagatgggagtaacgctgccacgagccaaggagtgctgagggttgctgagaa

SEQ ID NO: 118452 - DNA, 718 bp, Homo sapiens
gaaagttatttttaaagacatttttatatatacacacattcaactttcgtaaagtttatattcagctttttatagtacatctgacattgtagaaaagcattttcttatatatagttgaaatatatattcaactttgatttagtaaagtatatgaaaaacataatttacattcagcattttatagtgtatgtttatattcagctttttatagtatatgtgaaatcctagaaaagtattattttcctgaataagaaccaggaagaaactgattaaagagctataccacataatttctctagtactagattatcttacagtcttctacctcttcaagatacaaaagtcatggctgtgaggctatcattacccttttaccaaagttggaaaaggacagcatccaaaataagtcagctataaaaaaaagtaaagtcggccgggtgcggtggctcatgcctgtaatcccagcactttgggaggctgaggcaggcggatcacttgaggtcgggagttcgagaccagcttggtcaacatgatgaaaccccttctctactaaaaatacaaaaactagccaggcgagatggcacgtgcctgcagtcccagttagtcaggaggctgaggcacgagactagcttgaacccaggagacagaggttgtagtgagctgagatcgcaccactgcattccagcctgggcgccagggcaagactctctcaggaaaa

SEQ ID NO: 118453 - DNA, 429 bp, Homo sapiens
aggactcctgtctcctgagcccacagtccgatcaaagagagagccaaagaaataacaacggtgcctggcgagaatgttgggggagccaggttccggctgcaacagggcagagcacggggaaggttccctccgcctggggcaggcagggtaaacctccccacagaggggacagctatgaggagactcagatgccaaataggaatcttttcagccacgtgtcgtgactcatgcctgtattcctttttttttttttaaagacgggtctcactctgctgcccaggctcaagtgcagtggtgtaatcatggcttactgcagcctccaactcctgtgctcaggctatccgcctgcctcagcctcccaagcagctaggactacaggcacacaccaccacacctagctaatctgttcagttttggtagagatggggg

SEQ ID NO: 118454 - DNA, 382 bp, Homo sapiens
tcatgaatgtcaatcatatgctgtctcaagaagaaaaagaaaatccaaataaacctataacaagaaaagaaatttaatcagtaatcaaaaacctcccgacaaagcaaagcccaggaccagatggcttcactggtgaattctcccaaacatttaaagaagaattaataccaatccttttcaactcattctatgaagccagcatttttctggtaccaaagctagaccaagacattgccagaaaagataactacagaccaatacaaatgcatgaatatagaaagcaaaaattttcaaaaatgtactagcaaaccaaatctttttttttttttctttctttctttcttttttggaaacagcgtatcactctgtcactcaggctgga

SEQ ID NO: 118455 - DNA, 424 bp, Homo sapiens
gctgcttttattattccacattgtattcataaatcataacattacattgtaccctataaatatatacaactataatctgttaattgccaatcaaacattttttaaaaaagagtctctagaagcttattcataatgccctcaaccggtaacaacccagtttatccaaatgtcatgcagtaaatatgctagtagaattgattggcatatttacataatggagtattatatagcaatgaaaagaaccaactactgctacatgttaataacatggatgaatcttacagacataatcttgaaagaaagaagccatgccgggcgcggtggctcatgcctgtaatcccagcattttgggaggccaaggcgggtggatcacaaggtcaggagatcaagaccatcctggctaacatggtgaaaccccagctct

SEQ ID NO: 118456 - DNA, 608 bp, Homo sapiens
gctttttcatttctctctgacaatgatttctttgcatggtacttgattttctaaatgcttttttcaatggatactatactctggactcatgcttaggtcatatttgtgcagggatttttaaccttagcaccattggcatttgggacaagatatttcttgttgtgggggctgtcctgagttctgtaggtgtttaacagcatctgtgacctctgcctactagattccagtagcacccctgccaagccacccaagttgtgttaaccaaaaccatctctaaacattgccaaatgtctcctgaggggcagaatcacatctggtcgagagtcacttttttagaggggacttcagtatgtgctgccatagaaaactgtgatttgttatgttagtatttcttggagagagccatgacagttactaatcaatactttctagacttgtctttttttttttttttttttaaggcagagtcttactctgtcacccaggctggagtgcaatggcacgatcttggcttactgcaacctctgcctcctgggttcaagcgattctcctgtctcagcccctcagttagctggaattacaggagcatgccgccatgcccagctaat

SEQ ID NO: 118457 - DNA, 183 bp, Homo sapiens
cgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccct

SEQ ID NO: 118458 - DNA, 350 bp, Homo sapiens
taagcctcgacacacaagagaggtcatgaatatcattactaatatttctatataataattagcaagaatttaccctttgccaagccctggaattttaacatgcacaataacctcatgaagttggcatcgccatccccatggtacagaaccaggattcagagatggtgggtaactcacccagggttacctagttagcatcaggggccaagagaagagataaccgggctaagtaggtaatggaaagtgatctcttagctcagttttcatatagaaatttggagaaaggcagggactgaaatgtgaaatctctctgcagtggtggttttgccgctcgaagatgggttttcccc

SEQ ID NO: 118459 - DNA, 384 bp, Homo sapiens
gtagcacttaagtgcagcttgtaagaaattgctgtggttcatcagtagatcaccacctttggtgctcatcagaatcattttgtaaggatttaaaaattttttcggctgggcaccaggtggctcacacctgttatcccagcacttggggaggtggaggcaggaggatctcttgagctcagaagttcaagaccagcttgggcaacatagctagatccctgtctctacaaaaaaaatttaaaaggtagctgcgtggtggcttgcacctatagtcccagctacttgggaggctgaggtgagaggatcacttgagcccaggaggtggaagctgcagtgagccattagtgcaccactctactccagcctgagtgacagagcaagacccta

SEQ ID NO: 118460 - DNA, 367 bp, Homo sapiens
ttcaccttttacctatctgttgcacagaacaccatgaaacgtactgtgaggatgctggtctaggtatgaatctttgtgtaataaagttggcttccacatagaagcgttattggaaatctcagttactgtaaggtagcatcagaggtactggaagaaaagaaagtgacatgatcttaggtagcagcatgtctagagacccaaagttcactccatgtggtggtatgtcagaatttccttccttctaaggctgaatgaaaccttgaggacatttatgctaagtgaaataagctggttactaaaactgtatgattccacttatgtgaggcatttagaatagttaaaattgtagaggcaaaaagtagaatgg

SEQ ID NO: 118461 - DNA, 652 bp, Homo sapiens
attggccttattggaacaatgcaaatgaaaattaggaccggcatgaacatctgtatatacgaacaatcattttattgtagagctttaataaacattactgatctgtagggtgttacttttcttcaacagaaattattcattttttatcttttttttctttttttgctaactgttctgcttgggaattgtagtaagacactgtgttaacttttaatgcagttacttagaacacttctctctcccaaaacctcctgcaggttagccctaagaagcttaccatcattctcatcactgtaatccaccagaggagaagtaaacatggctttggcccttggaaaagtgatttcaactctaactttgtgctaggacattaaaaaaccacagaaagaaagtcagtgcaattatcttgtaggcatacaggctgccaccaagtgtggataatgtctgaccaagctataaatcagcagagcatgacaggccaattcccattatcaagaccctcatggggcatcatagtttcattgtagtggaattttgttattttcagaaacttcataaaattatctagttttcaggactatagatgacatatgtggcatccagttttctggaggtcgtaagaaggtagaaaagacctaccgtggaagtaata

SEQ ID NO: 118462 - DNA, 347 bp, Homo sapiens
tgtaatatttatgtataagtagcagtggataaggtatttaaagaatattgtaatttcagtaattctatttgtgataatctatttttatgaaatactcctaaatataaaaaaagttacacataagaaaaaataaaaaaagttacacgtaagaataccttttactttgatatgtcgatattcattgacttctgcacaaagtgagagaaaactatctcactgtatctatatgtatgagaatagaagtcttcattttaaaaatgtttcctgaatgggatagagagataaagagagtccttgactttgagcaggttagaggaaatacacatgagaaatggtgaataaaagga

SEQ ID NO: 118463 - DNA, 338 bp, Homo sapiens
gagcctgagtctagaatttgtctcctgagttaaaggacatttctggccatggaaacgaagagctcctcacaaaacttcaaagtggcagtttgagaacaaggagaatttttagaggatccttaaactggtcatatttgtaactggcgtctgcactgtatagacaaagtactgagtggcagatttcaggtggctttcagaggtctgatttgtgttcagttacacttttgggtctcacatttctacatcctgcttctctctaattccagtttctacttcatttttcaaaagccctacacagttttccagtaacttttccctgatgctgccctcccacagag

SEQ ID NO: 118464 - DNA, 773 bp, Homo sapiens
tgcacaacatgtttctaaaaacaaatgggtcaatgaagaaattaaatgggaaatttaaaaatatattgggaaaaatgaaaatgtaaatacaacatactaagacttacgggatacagcaaaagcagttctatgaggaatgtttatagcaaaaaaaaaatatcaaaaaagagagaaagatctcaaacaacttaatgttacaactcaaggaaataggaaaaagaacaaactaagcctaaagctaggagagaaaaaatacaataaagatcagagcagggataaagaaatagagactagaaaaataatacaaaacattaacaaaattaagggttgatttttgaaaaaataaaattgacagattttagctaacttaagagaaaaggagagaagggtaaaataaataaaatcagaaattaaaagagaagacagtagaactgataccatggaaataccaaagatcataagagactattataaacaattatgcaccaacatataggacaacctaggagaaatggataaattcctagacatataccacctaccaagaagctgaacagaccaataatgagtaagcagattgaattagtaattcttaagatctcccaccaaaggaaagcacagccatggtagtttcacagctgaattatagtaaacatttaaagaactgatatcaatccttctcaaactcttccagaaaaccaaagaggagggaatactttcaaaccctttttatgagtccagcattgctgtgataccaaagccagacagtgatg

SEQ ID NO: 118465 - DNA, 403 bp, Homo sapiens
gacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaagggcctaagtcacaccaagattcatgctggataatttgtcatcgacccagactgtggttctgcactcgccagtaaccagtt

SEQ ID NO: 118466 - DNA, 497 bp, Homo sapiens
ctcctctctcacagagtaaagctgtccctggccttggcaaatgcagcgtctcacacgaaaatcaatcaagaaggacgtcactcctgaaacaaacttctgctaaactcgaattcacaataataatcccctcatccaatagctgaaccatcatttccacatcctgaaagctttcctgaaaagcaacatgggaagaaaaagtccttatgacagttcctcactcgccttccaaggccaggtgcctttctagaaagatgagctctgctgagcagggcgtccatcttacaacgctgatttccagcgagaggcctcaaggatccaaaagcaaagcattcctgaagctgagttcaacccttctgccccctggggctgtgagtctgaagctgagcctccaactcctgggctcaagctcctccaactcctgagctatgactacaggtgcacaccaccacgcctggccaattattttcttcttttctttctgtcgtgagatagggtct

SEQ ID NO: 118467 - DNA, 444 bp, Homo sapiens
aaatccaaaagatgtagaaagatatatacaatttgcatgagagatattatgatgaaaaatattaaaatgagaacattatgatcccatttttgtataacacatgcacagaactcttaaactgagaatgaaaaattctagaagcctgagtgtctgcagttctggttctggtcacaagatggtgcttgccaggtttactaagctttgtccaggcaaatatttttatgaagtggacaaagcaatgaaatatgttttgtattagccgactatgagacagcatgtagagtgtgattgaaattccattcaaaatattataaatatctagaagaaaaatccccaccaataactgacatgaagactcacacagaaatcataaaaaatgctgctacatagagtctggcccatagtagaaacaagtcaattgttctttcccttctctcttttctc

SEQ ID NO: 118468 - DNA, 733 bp, Homo sapiens
ttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaa

SEQ ID NO: 118469 - DNA, 382 bp, Homo sapiens
gcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtgaacctgcccgcactcgcggttggccatcgtagaagcctggataagcatagcccgtgtgaatctgtgaacctgcccgcactcgcggttggccatcgtagaagtgtggataagcatagcccatgtgaatctgtgaacctgcccgcattcgcggttggccgtcgtagaaggccccataagcatagcccgtgt

SEQ ID NO: 118470 - DNA, 641 bp, Homo sapiens
tctagtatatgtcttttttaacagatacattgttagctgtcagagatctagagaaataaagctgctcggggttccatgtcatatttttcagggagacctattgaacatattgacatccaagtcctgaaattgtttctgtttagattaaatgaattggggagctatattctggatctgatcaatgacttgtaaaccttcctctaagtggcttacataatttcagaataattggaaggtgtctcaccttcaaaatgaaagataaaatgtgagggaaatacttagctaaactttattgttctttagcagttaaaaattcaatgtgtgagtgttgggtcagtgttatgtttctcctcctggattgtttttatgaattgttatctcttctgatcccttcattttatgtccctagcaatttttattacactttctcatattctctctagcctcttaaatactccctcgtttttgtttgcttgtgctccgcaattctgtggagttatgatttttagcatcctgcttctccttggcccagccctcagatagtcctgcgtgaggacctgggtgagggttagagctcacactgctgacagatgcttactttttctatgctttataggcagatatttctcttcatcttcttc

SEQ ID NO: 118471 - DNA, 224 bp, Homo sapiens
attatttcatataacagtttgtaatttgcaaatccctttaactttttctatctgtcttactttctcatcacatggaacaagcatatcatatgttttcttccttttgtaagtgaggaaatttaaatttagaaaggttacatgtcttaccttaagacctacagagttggccgggcgcagtggctcacgcctgtaatcccagcactttgggaggccgaggcgggcgg

SEQ ID NO: 118472 - DNA, 595 bp, Homo sapiens
cagcgtatagctaatttttttcttttatttcttagtttttctcctgcaggaaagattgtgaaatattactgaactaagcaccaaagggatatattttttttcttggacctgcccatgtaagaccttgtgacatattgctgggccctacacctagatgatgtgagttttctgcccgtcaactattttatgtgactctcctctcttatcttcactttgtccataggttagcttttaatatacctttgggcctgggtcatgctaatagaagcaagagtgacttattgttgggcccagcacacaggggatgtgattcttctgcttggttcctgccgaaatggtcattgtgacatatctatgggtcagttggctaaatgacaggactctttttatctttctggagcagtccacagtaggaaatttgacatatcgctgggcccagcacatatctgatgtgactctcctctcatgccaaggccttgcctactgtagtgattgtgccatatagctgggcccagctcctacgttatctgactcctgttttcttcctgagccctatgaaaagattgcattattaaatatttctgggtcttttacc

SEQ ID NO: 118473 - DNA, 363 bp, Homo sapiens
ccacacccctggggccctgctctgcatttggggaactgaggcagggaggggtccacacctctctggtaaccaggtttgcagagtaccagcaacctgcaaagcccttcacttgtccacagtccggagaggcgggaaggaggcggccagagtgcacccccgcagccacatcactgctgtagactccaggatggccacgcgcggtggctcatgcctgtaatcccataatcccagtactttgggaggccgaggcgggcggatcacctgaggtcaggagtttgagaccagcccggccaacatggcaaaaccctgtctctactaaaatacaaaaattagccgggcgtggtggcgcacgcctgtagtccc

SEQ ID NO: 118474 - DNA, 165 bp, Homo sapiens
cgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctg

SEQ ID NO: 118475 - DNA, 731 bp, Homo sapiens
agggagacatgagacattaatcaatatgtaagaagtacattagttccagaaagaaaggtggagactgctcaaatcaaggctcccaggctcaaagcactgggggcttccaggtcacagataggtgagagacagatggttgcattcttttgagtttctggtaagtctttccaaaggaggcaatcagaatatgcatctatctctgtgagcaaaaggatgacttgaatagaatgggaggcagatttgtcctgagcagttcccagcttgaagaggcccaagatactttcctttcacatttaccccattttctttttcaaaatcttttggagaaagcattttgcaagaaaatgagtatctggtctcaggtttcatctgatctctcattgctagataagtaggtccggaaagctcatttttagcaggttgtaaagtctcatgcagtgtgaagagaaaatagggagaaggaaggaagagaaaaaaaaaacagcaaaagaacaatcccagccctggcggggtggctcatgcctgtaatcccaacaatttgggaggctgaggcgggtggatcacctgcggttgggagttcgagaacagcctgaccaacatggagaaactctgtctctactgaaaatacaaaaaactagccaggcatggtggctcatgcctgtaatcccagctactcaggaggctgagacaggagaatcacttgaacccaggaggcggaggttgcagcaacc

SEQ ID NO: 118476 - DNA, 872 bp, Homo sapiens
gttttgttgggggctgtagcaaaaccatcctgacatggatgcttactcagagtcacccacttccttgctgaatccatgggtgtctgatgtagtgctgctacagaccttttccttttgtcctttcctctgttgctgtggatttgatcatctcacataggacccaaactgtcaccctgtgctcaaagacttaaggcttcctttctctcattgctagcccctagggagtagagtttcttggtctccttgctaaaaaccagttcctttaggaaacaaaccaaaacaaaacaaacttataaaaaggaaaatatctcttaagcatggtactaaaatttatttaaattaaatagatttctgtggacttacctgggaatgaaacaatttataaatattggtccaatgagatactattttctaaatttcaaaaaactaatttacaaacttaactgggaaattttatttttaccaggaactgtttgaagtcagattctggtttccagctagtcttccatttttataaatttatgtacatttatatataaatataaatcataaaaacaaaggtaaaaatacacattataaatatgtatacatgcatgaccttttgccattataatatatattcatatatatatatgtatatacattgtacatatacaagtatataaggcaggtgagaaggataacagtaagtaaaaaagcttgtgtacttacgccatgctaacataagggctagcaataaggctcaccgggacactgtaataggatacttgacactaaaagtacatatgactacaacataacatcggcgagacgctgagaagcacggacccaaccaagaaaaacagacacacacaagaacacaacgaacccac

SEQ ID NO: 118477 - DNA, 303 bp, Homo sapiens
catgattgccgacgctgcattcagaagacagacaagatgcgattcctggttcagaggaactaggtctgctccgcaggtggggaggggaggtcaggtgtggcaacatggtgacaatatcatgtagcaggttgtaaaacagagctaagagtcatgggccatggaacacaggcgggagctgcagcctggactgggcaggtggtgcatgtggggttgcgtttgttgttctaaagggcagatgggcttttaccagcagaagaggagagaagctcatttaggttgaggcatgagtaaagggatggcgat

SEQ ID NO: 118478 - DNA, 174 bp, Homo sapiens
tgctaccgggctggcgggagctgctgttgaacccatgtcctgtcaccagcagtagatgctcactcagaggccagcccaggggccacttggcaggggtggactctgcctctctgctcacaggggacgagtcctcaaagccatctccagaatgaaataagaacaacacaaagctgg

SEQ ID NO: 118479 - DNA, 781 bp, Homo sapiens
cagagttataaaaagagaacaatcatttttatatccaaaaatggaactgttcgcatctgtattatttcttccatagcactgaccatgtttgaatctccttacagcctgcgagatccccctttctttctttgttcttcatgtgagtcagcaatgcctgggagtagttttgctttttcacagatggtttgtttattaagcactctacacagttgtgtcaaggctgtgattccactccaggaggagggaagatgaaataaaaacaaaacaaaatagtcaaatgagaagactaacccacttgggccagagagactggaaagaggagggaaaggaaggggagggaaagggagaaaaggaggaaataaatcagtgattgagtgaggcaaacaccttgagatctctcatggctttcccttttggctttcctaagagctccttcatctttaaatgggcgatctcataagtcagtggtgtggatttcaataaattataaatattaagtgccttatgcagtaggcacacatgttatggaattaatcgttttgtttgacaatgcttaataccctaattctctcacccagtaaaaccaacacacacacacacacacacacacacacacacacacacacacacactctctctctctctctctctctttcctttaggggaacggtttagcctcaggttataaaatataaggattccatttccttctatggttttgtactattcatctcttttcattctgtattaatatgtatgtctaaagcctaagagaacttac

SEQ ID NO: 118480 - DNA, 514 bp, Homo sapiens
attatgtgatgaatcacatttatttatgtttgttaaaccaaacttgcatccaggaatcaatattgcctgcctgaccgtggtggattagcatcttaatgtgctgctggatttgatttgttagtattttgctgaggatttttgtgtctatgtttatcaggatacttagcacaagttttcttttttctttgtatctctgccaggttttggtatcagaatgatgctgacctcatagaatgagttagggagaagtccctcctccttgattttttggaatagttttgttggttttgtaccagctctttcttttatgtctggtagaatttggctgtgaatccgtatgtcccagggctttttcttgttggtagcttattacagaatcaattttagaactcattattggtctgttcaggatttcagtttcttcctggttcaatcttgggagatggtatgcttcctggaatttattctttttttttctaggttttttagtttgtgtgcatagtggtgttagtaa

SEQ ID NO: 118481 - DNA, 513 bp, Homo sapiens
agaggctgcctgcattccttgtcatgtggcctgctccatcttcaagccacaatagctcattaaatatttctagtgcttcagatttctagctttctctttttccatcaaccaaaaatctttctgcttttaaaaggttcatgtggctaatctccctttctttaagtcaactgtttcatataacataagctaatcataagagtaaaacccatcatatttacagtcccagggcattttagaattctgcctgctgcagcttcattggtcaattctatcaactgtagttacaatagccaaaacaattttgaaaaaaaagaataaatttgaggatttataccatctgatttcaaaacttgctatatagctacagaaatcaagacactgttgtattggcataaagataggcatatagcttaacagaatagaatcgacagaaatagagtttatatttacatttgaaggttttacatttatagtcaatttttgacaaaggtaccaacatcgttcaatagagaa

SEQ ID NO: 118482 - DNA, 382 bp, Homo sapiens
ctgaagtgcagtggtgcaatctcagcttaatgcagcctctgcctcatggatttaagcaattctcctgcctcagtctcccaagtagttgggactacaggcagatgccaccatactcggctaatttttgtagctttagtagagatcaaatttcaccatgttggccaggctcgaactcctgacctcaagtgattctcccacctgggcctcccaaagtgctgggaatacaggaagaattaatacccaaggggtgctcctagaatattatttttttaacaaggctctggtttggcatttaccttcctgcgaactttgccctgggcatttctttctctgtttctttatcaacatagaaacttactctcttaagttggtttacctcccg

SEQ ID NO: 118483 - DNA, 455 bp, Homo sapiens
gcacgagatgtgaatggatagctaagtgtcactggacctaagaagaggatcagtagcctgaccaaggaccgtgtggagaattcagagcacgtggccccactgatctatcattttagattcaattccccatccaagctgccaagagcttttaagattctgtttcttggccgggcacggtggctcacacctataatcccagcactttgggaggctgaggccagcggatcacgaggtcaggagatcgagatcatcctggctaacacggtgaaaccccgtctgtattaaagaaaatacaaaaaattagccgggcgtggcagcacacgcctgtagtcccagctactcgggaggctgaggcgggagaatggcgtgaacccgggaggtgcagtttgcagtgagtcgagatcgtgacactgtggtccggcctgggcgaaagaacgagactccgtctcaaaaaa

SEQ ID NO: 118484 - DNA, 437 bp, Homo sapiens
gtgctttgtgatgcccaggtgcaaggattgcttgaggccgggagatcaagaccagcctgggtgacagagcaagaccctgtctgtacacaaaaaagagaccctgtctctacaaaaagaaattttctcgctctgctgcccaggctggagtgcagcagcgtgatctcggctcactgcaacccttgcctcctgggttcaagtgattctcctccctcagcctcccaggtagctgggactacaggcatgagccaccacatctgtcctctacaaaaaatttttttaaaaattagctgggggtgatggtatgcgctggtagtcttagctaccttggaggctgaggcaagaggatggcttgagtccaggagtctgaggctgcagtgagctgtgattgcacaactgcactgcagcttgcatgacagagcaaggcccagtctcaaaaa

SEQ ID NO: 118485 - DNA, 311 bp, Homo sapiens
ctgtctctttactaaaatatcctattttgaccctttctttgaattgtaactagttttgtaattacacagttatatgtctatttttgcatatacaatgttaactttttatcagtaaagcctcatggctcaacttgtagatcaacaaccatagatctacagttgttgtgatatgcaaattgtcactgcctcttcctttgtcctttcagcactaacccagcatttttggaaggaacctggttttctgagaatagcaatatgtttcaggccattctgatgttcccttactcccacacatggaattagcttctttg

SEQ ID NO: 118486 - DNA, 473 bp, Homo sapiens
taaaatacttacattaataattattattaattatctgacaaatgctaatgtatcagattaagcaggcagagataagagttgtaaggaatggatcaaatgacaaataaattttagtttgttatgggagggagctggaagtgtagaagaaaggaagggcttggtatacttctggggaactcaggcctgggaagaaccggagtgtaggatcaacttgatgggtgggacaaaggggagtaaatagccaggggtagaaccaatggtagacttcatgattatgcttaacgtgaatcttgatacttagattcttttctcagggaggtgatattatctataaagaaagtggaaaggcagataagaaagatcaagtttgttgagcttgaaggagtattgagaatccagtcaaagatatttaagagggagtctgagatatggaatagagatgtggcaaatcattgatttattcgcctaaacat

SEQ ID NO: 118487 - DNA, 728 bp, Homo sapiens
atcgtggctaagtagttactgctgggccggaaggtggtagtcgtacgctgcgagggcatcaacatctctggcaatttctacagaaacaagttgaagaatctggctttcctcggcaagcggatgaacaccaacccttttcgaagcgcctaccacttccgggcccccagccgcatcttctggccgacagtgcgaggcatacatgctgcgccacaagaccaagcgaggccatgcctccctggactgcctcaaggtgtttgacggcatcccaccgccctacgataagaaaaagcggatggtggttcctgctgccctcaaggtcgtgcgtctgaagcctacaagaaagtttgcccttctggggcgacaggctcaagaggttaggtggaagtaccaggcagtgacagccaccctggaggagaagaggaaggagaaagccaagatccactactggaagaagaaacagctcatgaggctacggaaacaggccgagaagaacgtgaagaaaaactgacaaatacacagaggtcctcaagacccacggactcctggtctgagcccagtaaagactgttaatttctcatgcttggcctggcctgcccttcctccgtcgtcgccctggaatgtgcgggacccaggggcagcagcagtccaggtgccacaggcagcctgggacataggaaagggtcttagttactgccttctgacgttacttgaaagcgctcggagaattg

SEQ ID NO: 118488 - DNA, 637 bp, Homo sapiens
ttagaagacaggaataagcttcaggagtaagcattctgaagagagcttggacgttgttggcaactggcggggacaagctgagcccatggagatcacagagcaggcgcccaattaatgtctgttgatgattcattttttcattcaacaaacatttaatgaggcctacaatgtgcaccggattaggcactgtgaatacaaagatgagtaaggcactgtccttgcccttaaggaatttaaagtctggtagacgagagccatagacacggacaatgataatacaacctgctaagtgctaggacacttagcaggttgtattatattccatccgagtaggatttcttcagaggagcaccactccaggttgctgctggatccatgaagtcctcccaggcaccagggtctgctgttgtttttgtcacgtgctgggtgtcccaagatctaacaataatagctgtaattaatgtatagagtgcctatgacaaacactttacaaatatcttcatggaaactctgaaaattaatagttatattagaggaagaaactgaagttcaacaagtttaagtcacacagccagcaagcagttgaattaggtttcaaatccagttttgacaaagtctaatgcatttttctgttttc

SEQ ID NO: 118489 - DNA, 322 bp, Homo sapiens
ccggctccagccctgcacccccgacccccggcctcaggtgcagctccgcagccatccccggaccagggcgggcacttggcctgttgctcagcgcaaccaccctcgccctcccgagccatgcacagggagacaagcgtccggccccggccccccaggcctccctgcagcaccccgtaatgtaatgcactggggcgggggaggcgggggaggcggcggcggcggcaaccgcggaggcgcggcggcagccgcactgccccaatctagacacatccagaagaggaggaaaatggctccgagcagggaccgcctgctgcactttggg

SEQ ID NO: 118490 - DNA, 427 bp, Homo sapiens
ttcagatggagggtgtgttaggaagtaaggagaggcggataggcaaggtacattttgcatggggcaaattataaataatttgtggtaagagaatgaattctagtgaattaaagagggtcaatttttttttaacattcttcctatttcctccattaaatttggaatgagctctctgactgctttgaacaacagattataagaagatgctgtgccattttccatgcccagaatttaggagcctgctagcttctacaacctgttccttggaaaacttgctctaaaaaacctgccaccaccattctctaagagcccaaaccacatagagggtcacatgtagacactccagctgacagccctagcagagccccagctgagctctcatgcaaagagaacatccacggccaccacgtgcaggagccctcttgga

SEQ ID NO: 118491 - DNA, 700 bp, Homo sapiens
ggcgtccgtctgccgcctcaccgcttggccccgcccctcgccacctgcccggccaggcgcgccggggccgtcccagtacgtcgccctgtttacgctggctctttctcccagtcttttttcgttttaagatgtgagaagagatgggattcttcaatcaaggccacaagcgggaaatcagtctgcaggaccgatgccagcaggctcacgcaccgagaacggctactccgcccagctgagaagcgcggggccctgacgcgggcgcgctcctcgcattcttccgttgggctgggaggctggagggcaggcggcggcggccgcgcatgcgccgggagcggccggagctgcgggacgcggagggccgactgcgcctgcgcgctggttgcctggttacggcgtggccgcgggcaccgagcggcgccggaagttggtcgatggctgccgccagtccctggccagcgtcctggggtttccccgacgcatcctctactgtcccttcgctctgcacagaggcccgggcagggaggggcggcccggccaccgcgcggagccgggtgtccgccgactcgcaagggggacgcgcgggctcctcgtccccaagctccgccctgcgcctttgctgcgccgggccctcccaggcccaccctggccccagccctgctgtcctcccggggaggtgcggcctactcggttcgttcccccg

SEQ ID NO: 118492 - DNA, 313 bp, Homo sapiens
gaaagacagtgttgtaactgataaaggatgggaggtataaaaatagaaactgaggccgggcacggtggctcacgcctgtaatctcagcactttgggaggccgaggtgaacggatcacgaggtcaggagttcgagaccagcctggccaacatggtgaaatgacgtctctactaaaaatacaaaaattagccgggcatgatggcacgtgccagaggctgaggcaggagaatcacttgaacctgggaggtggaggttgcagtgagctgagatcatgccattgcactccagcctgggcaacagtgagactccgtctc

SEQ ID NO: 118493 - DNA, 211 bp, Homo sapiens
accaactgggtagggacagctgggccggagacaattaagctctgttactgttcagagaagaatcgggctgtgctaagggcataattagcattgtgctcagaggagcagccacccattggaggagcagacaggcctgggctgagaaaagggcctggggggtgccgatgaatagcgaagtgccgatgaatagcgaggtgccgatgaatagcga

SEQ ID NO: 118494 - DNA, 267 bp, Homo sapiens
tgctcacagcagtgcttaaaaaaaaataactattattaatagttgtaatttatatatctatatatttacatatgtagatatataactgtatatttcatatatgatatctactttcttatatgtatataagctttgatataataatataagctttttttttttttttttgagatggagtctcactctgtatcccaagctggcgtgcagtggcacaatctcagctcactgcaaccttcacctctgggattcaaatggttctcctgcctc

SEQ ID NO: 118495 - DNA, 622 bp, Homo sapiens
acaaatttaagctaaatggtggcatgtgagctgaagccatgactactcctggggcttttgcacagaagctatagagcctgagggccaaagttttaatggcacggtggctctaggaaggaggcctggactcaaggtggaattgagtgctctggagccttgaaggtctgactttttcatgaaaaggggctagaaaaacttcaatacttggagaaatagagaggaagcttgacttgactggaaaaaaagttaccagcaagaacttaaacacatgggattgtactatatatggttgtggaatctgtattttttattacttatgaggtatgagacccttcaacctgaaaaattaacgtaagaactggtctagtaccatggaaacctctactgcgaacgcaaagtcattccataggcatatttcaacaacctatacctaacagcactcccacagtgagaatgacctctgaagacgagttcacaatgaaaaactatattcaggaaaccattccaagttggaaataataaaaccatttataagagactataaaaatggtatatttaaaatgattaagatgtcttagtttaggttcacaagaaaaaagaaataaaatgattaagaactaag

SEQ ID NO: 118496 - DNA, 1169 bp, Homo sapiens
gctaatgcttatgtcttcctattcctggtcattttcccttccccaaatgggactcagagaggagagagaaggtagccagctctttgctgataatgtgggaaggagtttatctgtattaaatataatgtgggtttcaaatagctgagtgttcagtctgttccttcctcccccattcccaacctcaccaccccccaccccgacctctgcaaaggggctcaagaaagaacagttgccttgtctgtggttcacatgatcacggactgtgtgggttgaccagacttagatttgttttgtctctttagccaaagtgttctgatgtgaggaatgggggtggaacttgatagagatacatacaatttctttaggtcaaaaaaacaggcaagaaagaactcactaagtcttgccctgcaagtatccaggaacctctcccaccagttctttcatattcctctcttaattccttttttccttctagttctgccatccccttctaactagcttctgttctgttttaatcatccctttctgataggaagggttagtgtcagatatcctgatggtttgatggtggaaggagactaagtagaagactaagcagaagactgggatcttgtagagcagctggtagagggtgtgctccaaatcctcaaagactagatcagaggagagacaggccacacctgctctttcttccagctgtgcctttttagttggagctcctagaagttatagccatacattttaaaaccctctttcccattccagatctccaaatgaattcaactgtttgtccaaccttcattagatagatctctaagatttccctgcatagggaggccctaatccttttcttctggtttctgaaaagagcagaaaactgcctggcgcggtggctcacgcctgtaatcccagcactttgggaggccgaggcaggtggattacttgaggtcaggagttcgagaccagcctggccaacatggtgaaacctcatttctactaaaaatacaaaaaaaaatagctgagtgcggtggcgcacgtctgtaatcccagctactctagaggctgaggcaggagaatcgcttgaactcgggaggcggaggttgcagtgagctgagatcacgccattgcactccagcttgggcaacaagagtgaaactccatccccccca

SEQ ID NO: 118497 - DNA, 1116 bp, Homo sapiens
gctaatgcttatgtcttcctattcctggtcattttcccttccccaaatgggactcagagaggagagagaaggtagccagctctttgctgataatgtgggaaggagtttatctgtattaaatataatgtgggtttcaaatagctgagtgttcagtctgttccttcctcccccattcccaacctcaccaccccccaccccgacctctgcaaaggggctcaagaaagaacagttgccttgtctgtggttcacatgatcacggactgtgtgggttgaccagacttagatttgttttgtctctttagccaaagtgttctgatgtgaggaatgggggtggaacttgatagagatacatacaatttctttaggtcaaaaaaacaggcaagaaagaactcactaagtcttgccctgcaagtatccaggaacctctcccaccagttctttcatattcctctcttaattccttttttccttctagttctgccatccccttctaactagcttctgttctgttttaatcatccctttctgataggaagggttagtgtcagatatcctgatggtttgatggtggaaggagactaagtagaagactaagcagaagactgggatcttgtagagcagctggtagagggtgtgctccaaatcctcaaagactagatcagaggagagacaggccacacctgctctttcttccagctgtgcctttttagttggagctcctagaagttatagccatacattttcttcattagatagatctctaagatttccctgcatagggaggccctaatccttttcttctggtttctgaaaagagcagaaaactgcctggcgcggtggctcacgcctgtaatcccagcactttgggaggccgaggcaggtggattacttgaggtcaggagttcgagaccagcctggccaacatggtgaaacctcatttctactaaaaatacaaaaaaaaatagctgagtgcggtggcgcacgtctgtaatcccagctactctagaggctgaggcaggagaatcgcttgaactcgggaggcggaggttgcagtgagctgagatcacgccattgcactccagcttgggcaacaagagtgaaactccatccccccca

SEQ ID NO: 118498 - DNA, 608 bp, Homo sapiens
tataaagactgctctgagcctcttagcaaaggcagctatcctcagtgactgcctgactgtaagaacatacataaattgggaaatatctatagtatgttagcttattttttttgagcagttcctactccctagcacatatctttgatatgagcaatcctgaagaatagtctactgtgacagagactggctctgttctttctttaaaatgtatcacagctcccagatgccttgcaatttggtgggctcgtgtgactggctgtcaccagcagtgtggaggagggggtgatgtgtgtcacctccaggtggttaagagcttgtgtaacttctccccatcgtgtctgaaggctggatgcagccaaaatttcaatgctttagaaggtagcagaatgattcattggatttgggatgccgaggcgggcagatcacctgaggtcgggagttcgagaccagtcggaccaacatggagtaactccatctctactaaaaatacaaaattagctgggcatggtggcacatgcctgtagtcccagctacttgggaggctgaggcaggagaatcgcttgaacctggaaggcggaggttgtggtgagttgagatcgagccattgc

SEQ ID NO: 118499 - DNA, 359 bp, Homo sapiens
atcacattaaggaagtatgtttccttttattctgagtttaagaagaatttcaaaaatcatttaaaatcattttaaaatcatgaatgatttaaactgtttttcttttcttccatctattgatatgattgttttatttttcacctttattttgttaatgtggcaaattatgtgggttttctgttgaacctctttgcattcctgagataaaactgacttggtcatgatgcattattctttttatgtagctggattcagtttgaaattctttatgcattacaattattaacaccttaaactgaccttttaaaataggctaaaacagtggtttgagttgaggttttttttttttttttttttga

SEQ ID NO: 118500 - DNA, 469 bp, Homo sapiens
aaggcaggatacagtaggttaaaaaggttgtcctgtacagaacacacccacagaaattgcacacatgtaaggaaaattgtggcaggaaagaagcttggctcttttgcctttcttcatttccgcccccaagtttgccttgaacttggaatcttacgttataaacgttgccaaattgcagctccaatcaggaaacagatggttaggcagtaccagaaaacacaaataattgtggggaccatgaacattagttcatgaacattagaaaaccctgatggaaagtttagaactatgtacattttttttttttttggtgaatatcagacttaaataattgcgaaaagaatggtctagaaatattttgctaggtattagaattttgtggtacagtaaacaattaatcaacttctagtttataaaaaatctgctgtgctgtataattcttaaaaataaatttagtcagtgatggatg

SEQ ID NO: 118501 - DNA, 701 bp, Homo sapiens
atcctttttgggaaagaggatctttatggttgaaatccaagcaataaatgtatatgcatgtaagaatgaccattttgtagccgcataataatattgattcagaatcatcattggaatataaaaccatgaagtataagtatgttagggaataggatatttacacaaagcatctcttcacaattacttactaattttaaagggcaaaaggatacctttatagttaaactctggcagatgctaccttaacctagtgatcaaagttactatcaccaataatgggataaactgacgtcacatacctcagtacatcttcacataacatactgagaatgcgtttctgtatcagagaatcatttctgagaatcatttctgtagtattcctgcccaagtgcctaacctgaatctaataatgaagaaacttcagacaagtgaaaattgaggagcattctatgatgcagctagcctctgctctataaaaagtcataaaacacaaggaaaactaagaaatcttcaaggttaaaggagactaaaaccccatgacatctagatgcatggtaatagattataatatgatgataatagatccttggattaccattatggtaatagagccttggctcagggaaaaaaaaattcacaaagggtgttttgggagacagttgacaaaatttgaaaatggattgtatgttagataatattat

SEQ ID NO: 118502 - DNA, 831 bp, Homo sapiens
gattctgtgtgcccaaagaactgtccttggaggagagtttcaaatgtctttcattttaatgtctggccttggtgattgtttaagaagtcccctgaatgaatttttgggtgaactcggggcctagactggctcaggaaatctggcactgagccccatatttactttggccaaacacaatacttgctgtgcagccacattcactatgcactgctcacaccacgcagcttgagagctttgtccctgattcaaatctgctgggtattattcagtctgaaaatttacttttacaccaagcatataaacaaaatgaaatacagtttaagaaatcagctcataacatttacaattaaattcattaatcaaggcagcttatggaaatgccacatgtgaactgtaaactttataaatattcaagtagtgaacaactagacaatcacattggcagctttgtttcagtataagtgatgtagaatattaccatccatcagcttgcagttttgttttaaaacttgttgaaccatgtatatcatcaaaaagaacttttggttacatttctgtttccatatgtttcccatttaccttcctctctagatttatgtgccttcgtactaattagcacctgcactgaattcagaaagcagcacttgaatcaaaccaagtcaagctgtctgtgaaggaaaaaaataccaagttccaagatttcttgttaatggagatgaacagtacactttgttgatgttcttattcacatgtgtcttcttaaagtatgagaatttagtatatgttctttcagtatatgcaaatatatccacatgggtattttcaaactat

SEQ ID NO: 118503 - DNA, 707 bp, Homo sapiens
actcactgctgcctctgcctcctggcttcaagtgattctcctgcctcagcttcccgagtagctgggattacaggtgcccatcaccacgcccagctaatttttgcatttttattagagatggggttttaccatgttggtcaggctggtcttgaactcctgacctcaggtgatctgcccacctccgcctcccaaagtgctgggattacaggcgtgagccactgcgcctggcctgttgttttcttctaaactttttgtagagatggggtctcactatgttgcccaggctcactgtgagctcctggcctcaagtgatcctctgccttggtctcccaaagtgttgggattataagcgtaagccactgtgcccagcctaagggatgcagtgaatattgctaacccatattactatcctataacaagcttcatcaaaaagaattctaatgggctgggcagtggctcatgcctgtaatcttagcactttgggaggctgaagcgagtggatccctcgagcttaggagtacaagaccagcctgggcaacaaagtgagaccctgactatacaaaaaatacaaatattagccgagtgtggtggcatgtgtgtgcagtcccacactttgggaggccggcaggcggatcacgaggtcaggagatcgagatcgttctggctaacatggtgaaactccgtctctactaaaaatacaaaaaatt

SEQ ID NO: 118504 - DNA, 420 bp, Homo sapiens
cgaaagggcgacagccacaattgggcatgttttagtttaagggcagctccgaagagctcccagcatatgacaaaaaatcagaggaaaactaccaatcagattcagggctcactgtcattctcagggtacccactggcaattgtatgttttactacaagtttattttacttacattatatatgggaaaatgtttaagaaattagaattttaacactgaactgctttattagctatttcatttcaactctgatatattctttaataacttttaattatgctttatattaaataatatctacatgattatatcttcccatctctttaacttgtttttaatactttgaacactcaaatttactttctgggagaaaaaagaacgcaaaatgaagacacaatgttttgtgcacgtgaacaaggcca

SEQ ID NO: 118505 - DNA, 687 bp, Homo sapiens
gggcatctctagaaattcaatagctaacttaatgtcaaaagttacatactctctcctcctaacgtcaggactatgttggggatatccactttcatgtcttccatttagcgttgtactggaagttctagctaatgcagtaaggcaaggaagagaagtaaaaggcatccaaattagaaaggaagaagtgaaactttttaattctcagacaatatcattgtctatgcagaaaatccaatggaatccacaaaaaagctactaaaactaataagtgaatttagcaagtggcaggatacaaatcactgtacaaaaatcaattgtatttctctatgctatccacaatcaacaattgatttttaaaaactcatttattatagcatcaaaagatttgaaatacttaggggaaaaaatctgataaaagatgtgcaaggccaggcgcatcggctcatgcctgtaatcccagcactttgggaggctgcagcaggcagatcacttgagcccaggagtttgagaccagcctgggcaacatggcaacctgtttctacaaaaaatacaaaaattagccaggtatggtgacatgtgcctgtagtcccaactgctcaggagtctgaggtgggaggatagtgtgagtccaggaggtggaggttacagtaagctgagatggcgccactgcactccagcctgggcgac

SEQ ID NO: 118506 - DNA, 143 bp, Homo sapiens
ttgtcaacctccagcatcacgaatttaaaatgcaaaaggaaaaaaatactttaagaatagaaaaggccaaatgttggtggcccctggcccattccggcactcccatccagacttgctgcctccatagcccagaccctaggaga

SEQ ID NO: 118507 - DNA, 276 bp, Homo sapiens
acagcttatttacaaggggatttagaaattgcagtgaatacaccatgaggaagatggccttctctcatagaacaatgactcctaattttgtaggattggtacaggagggcgaaggttcacagaaggattgcatattctcaactattgatgtctctttcccttggggatctcatgagttactgctgccatcacagaactgacctcatgggggcaatgctcccaaacccacagcaaccctgaggcaaggctggaacatttactaacgtccagggtaat

SEQ ID NO: 118508 - DNA, 307 bp, Homo sapiens
aagcagtgcaaatctaactagagatttgattccttaggcactaggaaagctcagcttgggggctgtctgcctcatctgagaggaaggaaagtggagatataaacggattaagaggataggagaccaggggacagactggtgtccaaatttgatgcataccacatttgacatttggctaatgaaggttgatggaaaacaacttttactcgattaggatagaaaagttttttaaaaagctgagtgtaattgacatgaattagtgataaatgaccaaaaaaaatacaccactaatctaaaatactttatg

SEQ ID NO: 118509 - DNA, 951 bp, Homo sapiens
attctgttgtcattgaagtctttatgggacattaaagccttaggtctggggtaaaatattgcagcctccagcctctccagcagttacgttcatgccacttctgtgccattggagtaattcatgaatgacactaaggactaatggcttgaggggaagtctttagattataccaaggatcaactgtaaacaaagagaagttttttgttttgtttttaggctccaacttgcctattttattttgtcagctttacccagtttttccacaatatgccaaaccctatctgtaattttgatggctgaactgtatgtatatatgcgcacacagcataaagtgcatattttgttagaactagattaatgccacaatattcagaaaacttctccctgtgttttcaaaaaattgacatattttgtggttagactgaaatgaggtaaatgtacatgttattgtagtactaatggattgttagatatttgctgtaatgttaacagttaatttatgccctgtaaatgaatattgaatatgaaacactgttacagggaaaactgtatagtctgcacaataaatgctgtataggaaacaagccttactccaaataattttttttgctagttcacacctctgagtagttggctctataggtgtgaagaatctagagaatgtataatttcagtgataaactagattataaagtaagtttaattgctgaaaagagtaagctttgccagcttcatatattctcttgttgcctgtttttgcaagacacatttcaggatatgcttttgggagccaatctaatgttacctgtatttgcctctcgtaaaaatcttaagctttgtgatttaaatctaagcaagcaggaagtgacttgagagaccttgtaagtcctgttaggaccagttatccatgatgaataataaggaagaaatttttatatgtgtggggataat

SEQ ID NO: 118510 - DNA, 553 bp, Homo sapiens
ctcggctctaccttgttcgatgctagtttctaaatggtcgccagaaagtccttctaagactttcacagattatattattcacttagctgaagtcgtatcacgatagaagccacttcaccaaggttgaaggatgggagctcaaaagcctcatctaactgttgtcaaatggccccttgatttcaacaagagataacgaacactgtcaccaagagacactgagtaagaagggattctgaagcagtttttctcttttagtcctcatgtcatctgagattctatgagactgcaaattcatcattctaaaaagacctaaggcataaccaagtcagggatttcttttcgtaagcgagagggcactttcttctaagtgaagctggtgtgcaaatttaaaaataaaagggcctttaggataaaaataaaaatgaaagggccttcaaggaattcctcatgctccatgaatcagagcctgaaaaaccactaatctcatccatcctctgcacctttcagatgagaaattcaaagcccataatgcaagtggttgttggcaaggtga

SEQ ID NO: 118511 - DNA, 396 bp, Homo sapiens
gtgatctttttataggctcatttttcttattctgaaacagagacactttatctgattgctcagctgaaagatagtatctggatggacctgctatttgtggcttggtctctttagatttatttgaggaataagaattggagagctgggatgcttgatcatcctcatctaagaccactcgtttgggaatggcctgattatattcactctggtctgtagataaactgtccatggatgatacaccctgtgacttcttcacaggctgatatgctttagcagaaggttgttcctggctacatgaagatgtgggtttttcatgagttatcttagcaccagctttctctccttcccaaaaggatattctgtcactcactcttttgtatttctctctctgcactt

SEQ ID NO: 118512 - DNA, 189 bp, Homo sapiens
tgaatgccatgtttctgttaattggactgtgtcatctcagggaccgttatttattaatagatgctcggagccctggacaagttcatcatgatcaccagaggacttgaaagaggccaagggacagatgggtattgccgagtgtgagggcagtctgcttgaattccaggcacaccctccttgatgatgctg

SEQ ID NO: 118513 - DNA, 415 bp, Homo sapiens
  misc_feature (366)..(366): n is a, c, g, or t
  misc_feature (392)..(392): n is a, c, g, or t
taaattgacaaaaattgtatatgtttactgtctacaacatgatgttttgaaatatgtgtacattgtggaatggtaagtcaagctaattaacatgtattacctcacatacttagcattttttttgtggtaagaacccttaaaatctactcttagcaatttcctttttctatttatttatttatttgagacaagctggagtgcagtggtgcaatttcgcctcactgtaacctccgcgtcctgggctcaagcaattctcatgtctcagctacccagggaggctgaagcaggataatcgcttggaacccgggcggcggagattgccagtgagccgaggtcatgccacttgcacttgcagcctggggcgancagagcgaggattttggcctcaaaantaaacaattaaattttaaaatta

SEQ ID NO: 118514 - DNA, 199 bp, Homo sapiens
aaaatttataatctcagtggggtggaagtggaatgcatataaacataataatcagtattacaaatcagaatttgataaaccctcttaaagacagtgtaaaggaaggatgtttgcagtgtgtcttcttccagaatgtaacttgaatctgtacttggccgcatctctgctgattctgcctgtcagaggcaccatcctttct

SEQ ID NO: 118515 - DNA, 313 bp, Homo sapiens
tacgaatcaggtgataccggtgttatcgatgccactaggtgatgaggtgaggtaatcaaatgacatagaagaggaaggagtccactgccagggtaggtgcagtggagcaagtcttacaatgtgcaggattataactccagcaatgacccctaggctcatgctcattccccaggtggcagtttcagaacacattgctcaggtctcaccctgtaaatgtaggtaccagccttctagttgaccatcagaacacacaacgccaagatcttactccagccacctgccaggacctggagggcaggaggagagttctgcc

SEQ ID NO: 118516 - DNA, 666 bp, Homo sapiens
cagcctcaatttattttatgaagctagtggttctctgataccaaaaccacacaaagataatacaagaaaataatattacaagccaatatccctcagtgatatagacacaaaattttttaacaaaatattactaaatagactgggcacaatggctcacacttgtaatcccaacactttgggaggccgaggcgagcagatcacctgaggtcaggagttcaagaccagcctggccaacatggtgaaaccccatctttgctaaaaatacaaaaattagctgggcatggtggtggctgcctataatcccaactactcggcaggtggaggttgcagtaagcagagatggtgccactgcactccagcctcggcaacagagtgagactctgcctcaaaaaaaaaaaaaaaattactaaatagaatttgccaatatataacaaagaattctatgccatgaccaagtagggattattccagggatgaaggttggttccgtatttgagaatcagtcgatgagatccacacgttaccagctaccgaagataactcacacgatcacatctgtcagtgttgggaaggcccgtgacaagtttaacatctattcatgatttaaacttggaaaaacagagaaggagaggaacttcctccgctggataaagagcatctgtacaa

SEQ ID NO: 118517 - DNA, 469 bp, Homo sapiens
ggaagcacttaggggcaagcaacggtcaccaagcaccacagcacccagaaggtcctgctgaggtcccgctgaccgccccagcgcctgggaaatgcactctgtcaatcaacaccgcaaaacaggctaagatactgtgaaggactcaaactttttttttaaaacagggagagaggttttttttttttaagataatagcatttggtttttcaaatgttcatgaatgatagggcaaatacagaataaattaacaaaggcagtatgaaggaataaattaaaaaaagagagagaaagctctcgtaagcaaaagctgccttccaactacatggaaaaacactctagtgccctaagtaaataaataataaaaggatattgaaacaatacaccctgaaaacgcttgtgccttctctgttctcctgggcagaagcagtgctgacaggtttatgctaccgaggttacagacccagctagc

SEQ ID NO: 118518 - DNA, 412 bp, Homo sapiens
ccaaagaaggttagaatagggcttgtggttctggattagagttagaggcatcaataagaacttatgttcattctttttttgaactttgaatatttctttatgacttctttccttatgtctctgtaaatattgtctgaagttggtagaaccttccccttcaaccccagaagaaatttattgctaattgtcacaataggactgacagctgaattagtgaggagatccacatgcctataggaaaggtgtttttgagcctaccacctgctgttcaggtttgtcccttattaaaaggctgcatactgggctgggcacagtggctcaagcctgtaatcccagcactttgggaggccgaggagggtggatcacctgaggtcaggagttcaagaccagcctggccaacatagcaaaaccc

SEQ ID NO: 118519 - DNA, 475 bp, Homo sapiens
actcattcaagagacacacgcccattcccacacccgctgcacaggaaagagaaagaagtcagactcggaccctgtccccaactgccccaggctgggaaattcaccagcactgcggacagagcaggggataacagcagcatcagaaagacccataaggccataggtttgcagagggaatgcagtccctcagcaaggagcttcagtcggactaaaccagcagaaaaggcggtttccgagtaccatgctcgcacaacagggagcctctttctaggaagtgggatttacaggctgagatgttggagccccacctccctcatttagctgcagaagaggtctgggttggagggagtccagactctggtcctggagttgagtctattcatgttatccatgagaaaacgggggcccagagaggtcaagcaacttgctcagggccacacagctgctcagtggacaagggagactgggagcagct

SEQ ID NO: 118520 - DNA, 374 bp, Homo sapiens
cctgggcactccaccccactgcccagcacatcctgagtgctgctatgggctaggcggcctgggctaagccagctgtgaccaagacacagagtctcagaatcctggggctcccttcagcagggggcaggcacagagaacagaaacggcttatgagaaggtgcaaagagggatacagggaacacagaggcagggcggggatgggggctcactgggaggcagcctccaggctcagcaggacaggggtggaagtgagcccatgaacgcttgtgggactgcattccaggcagagggaacagctggtgccaccagggcagagggacagggcagagggatggagggcctcacatacccctgggagtcctgtggctagtcct

SEQ ID NO: 118521 - DNA, 659 bp, Homo sapiens
agcggccggcggggccccaccgccccgggcagtgaggggcgtagcacctgggccagcagctgctgtgctcaatttctcgcggggccttagctgccttcccgcggggcagggctcgggacctgcagcccgccatgcctgagcctccccgcgctccgtgggctcctgtgcggcccgagcctcccggacgagcgctgccccctgctccatggcgcccagtcccatggaccacccaagggctgaggactgcgggcacatggtgcgggattggcaggcagctccacttgcagccccggtgcgggatccactgggtgaagccagctgggctcctgagtctggtggggacgtggagaacctttatgtctagctcagggattgtaaatacaccaatcggcactctgtatctagctcaaggtttgtaaacacaccaatcagcaccctgtgtctagctcagggtttgtgaatgcaccagttgacactctgtatctagctactctagtggggacgtggaaaacctttgtgtccacactctgtatccggtggggacgtggagaacctttgtgtctagctcaggggttgtaaaggcaccgatcagcgccctgtcaaaacacaccactcggctctaccaatcagcaggttgtggatggggccagataagagaa

SEQ ID NO: 118522 - DNA, 105 bp, Homo sapiens
tcaagatggggaccacagacagactagctggtgagtaaacacaatgctgccatctcttgtgaatctagcctctttcttgcagtgttttcaagatctcaatgggct

SEQ ID NO: 118523 - DNA, 342 bp, Homo sapiens
gtgtaatagtgaacaagacagccaacaagagttgtgaaggaggccgttcagcaagcaatgaagtgctagtgcaggaaggcccgagctgggaaatgtccggagagaccctgtgaagtgatgcagggatcaggaaagcttcctggtggaagcaatgtctgagctgaggctcaccacaaagaggaatgggagtgactgctagagggaaagtgttccaggcagtggaaagctgtggccaagacctgggggggtctgagaggccattgtacatttgaagacaggtggctggaacccagagtgagactctaggaagggaagagagttagtctggagctgcaggcaggg

SEQ ID NO: 118524 - DNA, 686 bp, Homo sapiens
agctttcttttcatacagtaaagccatcctcctcacccttcagtgtgtccatgtgactaacatttgctggtcctgagacaagaaccgagattttagctgaaccaaggaacaaaaactcctgcatcaagagcacttgaatttctgactgctattttgtgtatttcaacgaattttagcctggacaaataaataactatataattataattctattaatatgaaaagttagagtgaattctcctaataatttataattattatatattttaaattatgtaaatctgcatgctgtaatcattacctcttggcagtttttgaaaattcagaaatgtcttcatatctttgtcttgttctgaaagcggaagcaggacaaatgcaaatggtgaattattaaccaacaaggagtacagaaaaaatgtaatagcttaagggaccaaaaatgtagtgagatatggataggaaataaaaataagaaaagaggacataagcagttgacgaatattatacaaataccgagataccagagaagcaaatgagtttctttcaaaatgaccatgttatcagtaaacaaagaaacgagaaaaatacattgaaagtagcacaagctacattctaaaagtcagacgcgaagctatgacaactttagaaatgtaaactgctctcttagtagccaaggttagtttcac

SEQ ID NO: 118525 - DNA, 343 bp, Homo sapiens
accagttatccactcactgacttaggtgcctccactagaattctcagcacgtttttgcagaacctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagt

SEQ ID NO: 118526 - DNA, 977 bp, Homo sapiens
tctactgttttccaactcattaatttttggttttaacactatcaacttttttcattccactttttttgtttattagctttggaaattggatatttagttggtatatttttcatgtttattgttatggtaactgctttagctgtatcctaaaatttctgactatgaatttccaagagaaagtaccatttttccttttgattgctttaaattaatgtctgattttaaatcatgtaggcagagaatgctgtttgtatatttctattctttggattattgaggtcttctttgtggcctaaaatgtcacttttgtgaaaattcaatgtgcaacttgaaagaaggtatttcctcttaatagtatatagaatttgatagatacctatgagatctgccttattgattatgttatttatgtcttttacatctgtagtaatatttgttaccttcattttcttggattctgagagatttgttaaaatctccaatactgtgttttgtctgtttattctcacatctcctatagtttctccttcacaaaaattgttgatatattatttggtaagcaagtattaataatagttacattttcattatgaatggtagtcttcaacattgtaacgtgttattttatttttaatgctttttgatgcaaatactactagtcaaacactgaggttgtactgaaggaaactgaggctgtttatctgaaatagtattacagaccttaaattaatacgtagcatttttaaactaagtgtcttgtactctttaatgatttcagctcagaacctagtggcagtaatggggggagcgattggcatgctttgtcagcgcttgagtaaatagcgatcagctgggaaagacatgcctaactgtatttctgaaggatagaaagaaacctagaataaatgtaaagttttgatcttcatatttgcaaataattattcttctgtaacaccaagctaagaagaggtaagaac

SEQ ID NO: 118527 - DNA, 283 bp, Homo sapiens
tagctgtcacaacactaccatctccccaactcagactcaagccaaatatcccctagtcattctgtactcccagatgcccctcactggcttttactgatcagaaacctatacaagaaaatatgaagagaccagccaatcgcgcctgtaatcccagcactctgggaggccaaggcgggtggatcacttgaggtcaggagttcaagatcaacctggccaacatggtgaacccccgtctctactaaaaattctaaattaccaggcgtgatggcacatgtctgtaatc

SEQ ID NO: 118528 - DNA, 449 bp, Homo sapiens
tatgttcaaagatcttccctgaggacataatgacatagcacctataattaatggcatgcagtggtacagatcagaaatataaatctcagtcccagccttattcctgcttaagtcttatgggattctttctggaaatcaaaaattctaccagagtatgtctagtactcttccttctcttcatactgcaataaaagtgtcctaagatactttttctacatgttagaccttctaaacttaaaaccatcttaaaactgatagcaaaagaatcttccagctgttagaaaaaggaggaagttaagcatttatcagtggttgtcattgttggcacacacacaaactgtggttgaattttaagtctggatccttaattatggcttaatgtttatacattaaggtttcactatgatgcagcactgaaataaacagttgtgtaatagaagattgcatat

SEQ ID NO: 118529 - DNA, 407 bp, Homo sapiens
cttttgtccggcctgtggacaccaggaaactcccaggatgcccttccagtcctcctgtacagccagaccctggccaggaccagacacaacaaattaagcacttaaggcattaacgactagccaagtgttgaagattgaggaggaaggagaatgaaaagagggaattgaaagaaaagcagaaggtccaacccatccctccttccccacgaccagaggagaaaggaggcccgggccaagtggccgagttggttcgtttattcattcattcattgattcattcattcctcggattcctatttacggaagagggaatcccagaagtccagcgcgggccggaacttcagaagtcccgggggaactcaaccaagtgccactgagagggaaaaaccccacccgagatccgcgga

SEQ ID NO: 118530 - DNA, 438 bp, Homo sapiens
gaaagaggtcaaggcagtagcttctctggggtagatgagatcaccgtgggagacagtgcagggtgagaatggaatcttatgtctaatcaaggtatagggacagatggggaggagagccagaaaaacaggctgtgaggaacatgggacaagaggtgccacagaagcctggagagaccaagtatcaacaaaatatatcaacaaaatgatctgataaatacagcagacaggtcaagataaacacttaagttttcacttgatttggcaattatacactgcaattttttaaagaacagttttgatggagtggtaagacatgagcctaactgcagactgaacaaaaaccaggagctgagactgtgcacaagataaagagatacttttctttcaagaagcctggttgcaaggtcagggaaattatgcacttgtaagaagaggatg

SEQ ID NO: 118531 - DNA, 644 bp, Homo sapiens
atcttttggtgaatatatatacacatttctgatgtatatctaccaagaagaattgttaggtcataggttgtgcatgttttccactttagtagataatgcctatattagtttgctaggactatcataaaagcataccgcaactgggtggcttaaacaacagaaatttattttcccacagttttggaggctagcagtccaaaattaaggtgtgggcagggtttgttcctcttgagagctgtgaaggaattgtcttttccagggctctctttcttgacttgtaggctactgttttcttcctatttctattcacattgtcttccctctgtttatgtctctgggtccaaatttgccttttttatatggacactagtcatattggttacattggtgataccctaatgacttcatcttaagtaattatgtctgcagtgaccatatttccaaataaggtcacattctgaggtactgggggtttgaacttcaacatatgaatttgggtgatacataatacaaaccataccactgctaaacattttccaatgtaatttcaccaatctttacttgtatcaacagtgtttaagagttccacttatatctcatcctcatcaacacttcattttgcctatctttattttcattttaga

SEQ ID NO: 118532 - DNA, 730 bp, Homo sapiens
  misc_feature (171)..(171): n is a, c, g, or t
  misc_feature (181)..(181): n is a, c, g, or t
  misc_feature (187)..(188): n is a, c, g, or t
  misc_feature (191)..(192): n is a, c, g, or t
  misc_feature (213)..(214): n is a, c, g, or t
  misc_feature (277)..(277): n is a, c, g, or t
  misc_feature (300)..(300): n is a, c, g, or t
  misc_feature (302)..(302): n is a, c, g, or t
gatgcggatgccgtcacgtcgttaatacctacgattatacggaacccttgtggacgtcatcgccgacagacgttccgaagcctctcgaactactgtcggaccagcgtaccgactggagcgttccggtataaatcgctagtcgtatagtacggacacgtacgtgcagtgccncactgtagcngagagnnggnngcaccatgtgctgttctgacnnaatgtagatcgcgtagttactagactctacacctgtggcccgtctcgttttaatacacaagcntacgtgtagacccctagggacanancccgcctgagccgatgatgctcaattcttctcgactccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaactggggaagccggacgacgacaagcccactgaggaggagaaggggccgctgaagaggagcgcgggggacccgccggaggacgcccccaaacgacccaaggaggcagcccccgaccaagaggaggaggcggaggcggagaggg

SEQ ID NO: 118533 - DNA, 632 bp, Homo sapiens
  misc_feature (88)..(88): n is a, c, g, or t
  misc_feature (98)..(98): n is a, c, g, or t
  misc_feature (104)..(105): n is a, c, g, or t
  misc_feature (108)..(109): n is a, c, g, or t
  misc_feature (130)..(131): n is a, c, g, or t
tagcaggctcgtactgcctgtggtgtgtgcctacgagtagagttccggaataaatgctatgtaattatcgagcctacgtgcagtgccncactgtagcngagagnnggnngcaccatgtgctgttctgacnnaatgtagatcggtggtctatgactctcactgagccggtcgattttttacaaaggatcagtgacccgaggacaaccgtgtgacgtgatgctaactctaacgcggcatcgcacgagaaatgcctctttgagatcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaactggggaagccggacgacgacaagcccactgaggaggagaaggggccgctgaagaggagcgcgggggacccgccggaggacgcccccaaacgacccaaggaggcagcccccgaccaagaggaggaggcggaggcggagaggg

SEQ ID NO: 118534 - DNA, 583 bp, Homo sapiens
agcgggtgtgggccaccgtgaggttcggcataaagcatgtatttcgacctacggtgcatgccgcatgtgcaagagcggcgcacactgtgctgtcctgccaatgtatatcgtgagttataccccactggccgggataaaaaaacgtattaacccagcacaaccgttaccgattgtgtaactctaactcgcatccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaactggggaagccggacgacgacaagcccactgaggaggagaaggggccgctgaagaggagcgcgggggacccgccggaggacgcccccaaacgacccaaggaggcagcccccgaccaagaggaggaggcggaggcggagaggg

SEQ ID NO: 118535 - DNA, 553 bp, Homo sapiens
gcccaggcggggtccgcagaaccagctatgtcggcctacggcatgcccatgtacaagagcggggacctggtgtttgccaagttaaagggctatgcccactggccggcgaggatagagcacatgacccagcccaaccgctaccaggtgtttttcttcgggacccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaactggggaagccggacgacgacaagcccactgaggaggagaaggggccgctgaagaggagcgcgggggacccgccggaggacgcccccaaacgacccaaggaggcagcccccgaccaagaggaggaggcggaggcggagaggg

SEQ ID NO: 118536 - DNA, 439 bp, Homo sapiens
cctggaaggcattgtgacccaagaaagaagtcttcctggctgctccctgggaatcctgtccccaagagccctagatcctgacttctgctctgagggtcagggagtacacatctgcagaaactgtcaaagccacgctattcctaccactgtcttccagcaacgctgacctgatgagagaattctaagccccttaaacttagcactccacgtttggatttagattaattcaacatagccctggaatgacaaaacagcatttatgctacaaatgaggagcccgaagcccagagacaggagtgacttccctaaggatgcaggacattctggtggcaatgcaaggctagaatccagagtcctggttcaggtctttttgtttcaaatttaaacaacattcattcctacgaacatgtatgagcacctattaagtgcgatgcattct

SEQ ID NO: 118537 - DNA, 516 bp, Homo sapiens
agtgattgctcacggtgagcaaaaatacaacttttgaccgttatgatgctcccagtcacattgggatcacatttaaataattcattacaaactcatgagaaaagtataacaccttggagaatcagaggaggagtccacaggggcattgtttaacctgggccttgaagaatgagtaggagtttaccaaatagaaaataagtcaagaggagttagtccaaaggaaattggtcaagtagagagagacaggaaggacgataatgagtaaggagagcagcaaccagactcttgtggctgagatggagaagaaagaataaggagggagagacaggccaagactctggtaacgaacgcaggaaccggttggcaatggtaccaaacagtaggctaagaaatcaggactttttcttgtctgaagtagaggtcactgaagcattgagagctagtgaacaacaacacaatcactaacttagaaaaagccttctggaggtaaaaattgagtggaagctagtcgtgggt

SEQ ID NO: 118538 - DNA, 756 bp, Homo sapiens
accccacggtgtgtaaactaaagtttgtgcccgcccaaaaagaggtgtttgccccaagagccccggcacgtgtgttttgagccccgctgtgtggggacacacaaatgtgtgccccaaccaccttctggaggcgtgaattaagggatgcttcttgggactagacacacgggcgtagcttgtgattctgggccccaaccattactgtgggttgttaaagccttcccgacagggttgttggggggactttgaaaggccccttttttgagaacaccacaggggggggggggaacgggaaaaaaagggccaaccccagggaagcaataaatagagaagcagcctcacaaagtgctggaagagagaaagcaatgctctttccagaggaggaacacggaaaaatcagccttgtgggtgaacaggaggagagtcacattcgccagcaggcagcaccctgtgcaggcagtgggagaaatctgagcttcagcagcgtccggagcaggatttgcacgaagtctcccgtttcaagttttatgtctcctggagtcctggggaaggcacccagcccacccacagctcccttctcagagccctaagaattgatgagaaagcccctcactaccacatgcaggacacgcagaaacttcagatgagtggactggtcacgtgatacagcaatgacaaaaacttcagtattggcattcattccagctgatggcattccaggagcttttaatgaattaaagccacatttgcctgaag

SEQ ID NO: 118539 - DNA, 857 bp, Homo sapiens
accgcccactgacagcgtgttccaatcagaggcggagaggaacaaaagaggcgaggtccgggagacccatacagggcggtttccacagagaccccagacgcagtcttggctccaccctcaccgcggcccagggctaatactggacttctttccttatcgctgtagaaaaaactagataagcctgctagattctgaccgatttcactctgacattggaaagggtcctacaaagaattaggttccaccgttataggtgctagcttacagcagcggttcttagacttttggccttaggacttatttacaagactcttaaaaaccgttgaggagcacaaagaccatttgctttttgtgggttttctctcatttttaatgttttttttatttcaatagttttgggtgtacaggcgggttttggttacatggatgagctcttgagtggcgaattccgagattttagtgtacccgtcacccaccagtgtacactgtacccaatatgtagtattttatccctcaccccgctcccaatctcctccctacctggagttcccagaatccattatatcgctctgtatgtctttgcatcctcataactgaacatgcagtatttggttttctattcctaagttacttcacttagaataatggcctccagttccatccaaagttgctgccaaaagatattatttcgttcctttttatggctgagtagtattcaatggtgtatatatactacattttctttatccactcgttagtcaatgggcacttaggttgggccccatatctttgcaattgcgacttatgctgctataaacatgcgtgtatatgggtctttttcctttgggtagataccc

SEQ ID NO: 118540 - DNA, 314 bp, Homo sapiens
agatctgaagtgggaaggccggccaggctctcccaccatccagaggcaaaatgaggtctgggtctgtagagaacatccccagtgaagggtaagagaggagagtccagctgagatagacgatgggaaggaaagagagttttggaggtttcttgcagatgagagcagatatattttaatgaggatgaagatgatcctagtgttgtaaatgttaaggatatcttgaatgtgtttacatttggtagttattaacacacgtctgcaggtaaacatgatttttctggttatcctttgcctttaggagagaaaaagaggca

SEQ ID NO: 118541 - DNA, 714 bp, Homo sapiens
gcataggctccataaaagactgagacctaatcacaagactacaaaatgttcccctcaatcaggctggagtataataacaggagattacagctaaaagaactgcaaggctcaaattctatttaagaagtagtctctaggggaaaccaaagacaacagaagagataaaaacaagaacactaggggaaattataccctctgaaacctgtagctacttcaaacagtaagcagcctaactcacacatacataaacataaaatctaacagtaaaggccaaattacctcaatcccttttatctacatcgtatccggcttcccacaaaatacgaagcatgctcaaatgcaaaaatcacaatctaaagagtcaaagagtcagaaccagactcacatatgacagagatttggggattatgagagtctgaatttaattattaatatgcaaaggtggaaaagtaaacaacattcaaaaatatgtgtgtaatgtcagcaaagacatggaaatgttaagaataatttttttaaatgggagaaatcaaatatactgtaacagaaatgaagaatgctttaatgagctcatcagtagactagacacctgtgaaggtcacagaccagaggcataggctcaataaaagactgagacctaatcacaagactacacaatgttcccctctccccatctcttaacaccatagcaattagtcaattagaagatatgtc

SEQ ID NO: 118542 - DNA, 378 bp, Homo sapiens
ttttagaatcacagggtatcacttagtctaatcctggctttttatgtatgaaaccaggaaggcctttgataccgaaaggaatcttttggctatgtggtaactgaatacaataaattatttttagctcatttaaaaaatttatatcatactagatcatcttgaagttgctttttgtcggtatctactctctattttacttttcctgttaatcaacttgttgctactttctggatgcttcttgtctcctgctcctttatcttaccactaacttctccctcatcttgtcactgttgccatgtaaaccccataagagtagatttacttagaaatctggattgatgggactggtatggatgggtctgctatccaaaagacttt

SEQ ID NO: 118543 - DNA, 534 bp, Homo sapiens
ctccattttctcacagggtaactatactcgagactaataaatatacttatctcatagggtagttgcatttaagaacagctgttatatactgtcattaacctattgagtagatgttattggtatctctattaatatcttgtgactctgcaattccatttctaagatgttatcctggggaaaatatcaatgatgtgcccttctactccccgcaaaaaggcacaaagatatttactgcagccttacttaatataccataaggcaaaaacaacctaagttgttttcacagcagctccttgttttcacaaaaaactgtggtatgttcacaaggtaaactctatccagctattgaaaatccaaaatcagagtacacaatgcactgctaaaggattggggaggggtcactaagaacaaatgtgacatggatatgggaaaggaagggaaaggaagggagaggaggaagagagagagaaaatgaatgaataaatgagaataaggatatgatcacactttccttttattaggaacacaggtgtg

SEQ ID NO: 118544 - DNA, 520 bp, Homo sapiens
gatgggacagcacgagccacttacaggggtagcaggcaacatgagcccagctgggaacatcaccgctcggggtgcagtggggggccctccttctcaccgcatggcaatgctgttggttctgctccgacagtgtggaccacggacccaggcttcctgtctcatggcctttatctgcccatctagaaattctgagggaggctgagcaacggccaccaacagctcccgcccagcccagggtccagaatgcctgtgcccacctccaacctcactcgggtgctccgggacaggctgtccctctcctggcctggaaggaggcctgttcacagaacccagggagctgggcctggaaggaggcctgttcatggaacccgtagcaggagctggactctacggcgtggaccagctgcctgttgttgtaaataaggtgttactggaactcagccatgcccatttatgaactgtctatagctgcttttgtgagcggtcgttgactagctgtgatggagactctacggcccta

SEQ ID NO: 118545 - DNA, 355 bp, Homo sapiens
tttaggggcttggctagtggaaagattgctattctattcacaatgaggcagtggctagtgcagctcttctctgatcagcagagatcattgggagcctaagtttagagtcactgttttggggacaagggtgctctgcctaagtctctgtgtgctcaaatggaggcctagtctctgcattgggctgcctccagcctcacccttagaagttccacctcctaggctgggcacggtggcgcacacctgtaatcccagcactttacttcgggagggtgaggcgggtggatcacctaaggtcaggagttggtgaccagcctgactaacatggtgaaactctgactctactaaatacaaaaaa

SEQ ID NO: 118546 - DNA, 246 bp, Homo sapiens
gtgaagggcaaccacaggttccaaggaagacaagctgaaacaatgcaaactggttttatattagatacgtgacttaaaatatctcaatacagttttctccaaaaaaaaaaaaatagttagccgagtatgggggtgtgcttggtatggcttgagcccaggagtgagtttgaggctgcaccgagcaatgactgtgccactgcactccagtctgggcaatggagtgagaccctgtctctaaaaaaaaaa

SEQ ID NO: 118547 - DNA, 231 bp, Homo sapiens
atttctgtctctgctcgacaccgctctctgtgcctcccttctttgtccctctgtgtcactcgccctcacctctgctgctgttcctgccagcctgtctgcctccccgcctcccctgctccttccccgtggctccctctccccacatccctgaggactcacttacctggggtcctccgggcggcccaagagggttattttcccccagtgctttcaacatgtttaatttgttgc

SEQ ID NO: 118548 - DNA, 244 bp, Homo sapiens
cccaaagtgatgggattataggcgtgagcgactactctggctgaaactttataattctcttaataaaatgaaactttctaattctcttaataaaatgaaacccttaataaaacaaaaccctgtaattttaaacactacagaaacctgctgactcttgaatgtagtacatatctcttcagattttgtcacgatgaatttagttctaggtacctgaacagaaactttaaaattctcttaataaaat

SEQ ID NO: 118549 - DNA, 610 bp, Homo sapiens
tcacccagagctaaatagaatgagcctaagaactacaggtctttgatctacctgtgaatcctaaaagactgctgttaattcattgtttgtaaagggagtggctctaactgaaagcaccacaggaggtccttttccaggattctttcatcccagggccctcccaaatgcctgtgtgggttttcggtgctttgacaagttcattggaccacacccttcccaaagcaccagagctaggcttcagtttcagctctgccagtgttttcccgtgtgacccctgcaaaagtctgtgtcctctttgcacttcagttctctcatctacacaagttctgtgaaagtttctgcctcaacgaatttgccaggtcattgtaagaacaaaccctggagccagtttgcaaattgtaaaattgtttctcactcttaatctagtgcaccttccaggcaatgtcagaaaagaaaacaagacctagactatatagaaagaagtgagctttgttaggattttattagtttggtgaatgcaatacattttgtgcatttatttgtttgctgaaataaaaacatttgcacattgttctgcttataaatgtatatgctcatggtgctcattggt

SEQ ID NO: 118550 - DNA, 395 bp, Homo sapiens
ccaccatgatctttcccacctcagaacattcaaataaactgttttctgtctagaagaatgctcttcctatcctcctctctttggccctaccttgtcacttcggatgggtacagtgcccctttccttttatatcacccagcaacattctgcaccgttcctatgacacattcttattcaacatttgatgagtggtatgtcatctctcctagctggtaaggcccaacaacagcagggaccaatgctaaatctaaacctttaaaagatctaaaatgaagtaattaacagttcaggatcaagaaaacacgctcctaagaaaacctaaaatacaagttgtacagcaaacaaattggtttaagtaaacgtcaatttctctctgcacttaaaaaaaacacaat

SEQ ID NO: 118551 - DNA, 412 bp, Homo sapiens
gcaagtttagagtaatggttcccaaattaggctgcttattaggctcccctgagaagcttttaaagttacagcttccttgactccctccccattacccagaatcaaagcaatagttgatggagcctagaaaactgaatttttaggccgggcacagtgggtcatgcacgtaatcccagcattttgggaggccgaggagggcggatcacctaagttcgggagagaccagcctgaccaatgtggagaaaccccatctctactaaaaatacaaaattaggcatggtgcatacctgtaatcccagctacttgggaggctgaggcaggagaattgcttgaacccgtgaggcagaggttgtggtgagctgagatcacgccattacattccaccctgggcaacaagagcgaaactccgtct

SEQ ID NO: 118552 - DNA, 392 bp, Homo sapiens
aagaaacttcacaattaaggaatttttgaaatatttcatgacgtagaaagcacaaaggataaaatgttggaagttgactcatacttacaaaggtacatgacaattctataaggcatagaaaaagatactcactctgtattataagttatatactgagaagaagtcaagaactattcaaggacgtatgatatggttcaggttttttgcaaaatacgtagaggtaattcatcgttgggtaattgacagatggctttctgtgttacgaaagatattttgcttcaggctagcagtaaccatcttaagcattgtatatagctttttaagactgtttaaaaactatcatgggttaaggggctgatttacattctttatgctaaacttgttagcctcaa

SEQ ID NO: 118553 - DNA, 743 bp, Homo sapiens
ggtgattagaccatgagcgctccaccccccatggaggggaggtgcgattcatgctgttataaaagggctagctgggctcctttttccgttactgccttctgacctatgatgacgcagcaaaggtcctcgccagacgccagccccttgatcgtggacttcccagcttccagaactgtgagaaaagaaatttctgttcattataaattacccagcctcaggtattcggttatagcagcacaaaacagactgagacggcttgctttgtgggtatttatttttttgagacggagtctcgctgtgttacccaggctggactgcaatggcgcgatctctgctcgctggaagctcctcctcccggattcacaccattctcctgcctcagcctccccagtagctgggactacaggcgcctgccaccacacccggcaaagtttttgtatttttagtagagacggggtttcaccgggttagccaggatggtctctatctcctgacctcgtgatccgcccgcctcggcctcccaaagtgctgggattacaggcgtgagccgctgcgcccggcctctttgtgggtttttaaggatctgcctctgagctttcaacgtgcgcccactgttctgcaacttggtttgctcacccaatgtaaagctgaatggtttcagattaagatatacacaagtgggattctaccatggaattctgccatacctgagatttcttgagggaactcttgttttcatactt

SEQ ID NO: 118554 - DNA, 432 bp, Homo sapiens
cctaggcaacacggtgaaaccctgtctctatgaaaacacaaaaaattagccaggtgtggcggcgtgtgcctgtagtcccagctactcgagaggctgaggcaggagaattgcttgaacccgggaggcggaggttgcagtgagctgtgatcgcgccactgcactccagcctggcaacagagcaagactcaatctctaaaacaaaacaaaacaaaacaaagccagacttggtggcacatgcctgtagtcccagttacttgggagggctgaggcaggaggatggcttgaacccaggaggtcaaggctgcagtgagctatgatcacaccactgcactccagcctgggagacagagcaagacctcgtctgaaaaacaaagacaaaaaacctcgaactgcaaacttaaaatgggtacatttattgtattaaattatact

SEQ ID NO: 118555 - DNA, 568 bp, Homo sapiens
tcaacagaaaaggagaagtggtagaaacaatagcaaaagaaaaatggaaagttggaggatatgctttagtaactacattcacatagaaggttagatatgctttagtaactgtattcgcttgaagctggcattgcagcacatgactgtctgctttaaggccttagctacctgctgacaatgctagtccccttttctttacataactgtcttctcatccttggagtcttagctcgagtgtcttgtgtcaagctgtccaccctatttgaggagccctctgtcctctacccctactctaattctttctcaccacctgtttgttttcctcatagcatatgtatgtgtgtgtatatatgtgtatgtgtgcgtatgtatatatgtgtatgtgtatatgtatatatacatgtatgtgtgtgtatatatgtataacacacacacatacacatatatttttggccccatagtaggttgtgagatctgtaagagcaaggattacatctgtttggttcaccatcatctatatagtgcctagtacatagtgcatatttgttgatgagttatcttggtggct

SEQ ID NO: 118556 - DNA, 603 bp, Homo sapiens
tggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcat

SEQ ID NO: 118557 - DNA, 622 bp, Homo sapiens
ctcggaggagagttactcctagtgatcgattcggatttgtgacgctgcgagtcccagttagtgtgtacgatgacaacaggtagtgatctatgagtcatgtattcctaggcattatcgcatgtgtcgatggaagtagttgttggatgcatctaacaaatatgatcatatccggggagaatgcgtagagtttatggagatagaaatcacagaataggtcgttcatggaagtcgagtgagaggatgtctcatgaagatgtgtcgtaagcgcatatcggtatctaaatgtatagtttaattctgatgttttctttaattttctctttggatgatctgtccaatactgggattggggtatttaagttccctatattactgtattgcagtctatctctccctttagatctattaatacttgctttttatacttggggctctggtgctgggtgcatagatatttataatagttatatccgcttgctaaattgacacctttatcattatataatgaccttctttgtctctttttatagtcttgactggtagcctattttatctgatacaagtatagctactcctgttcttttttggtgtccagttgcacggaatatccttttccacccct

SEQ ID NO: 118558 - DNA, 826 bp, Homo sapiens
cgcgctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccacccccgtctccagtctgctcagaaatccaagcatccatgagggcagactctgtcttcctctccatctgcactcgtccagcccctagaaggcgcacttcacgtgttctgctgagctacatgccactgctggacgagggccaaagtgtgaacgtgtgtcgaccagcactggctacacagcccctgcaaccatgctgccttctgcaactggcccatcacggactgtcgcgatcgacggttcctttctgagcgaaccgacggccgcctgaccaaccgtggcctgacctcacccgcgcctgcttacgcctcctgccatttgcgcggccctggacagggcgaatgcccagcactagtgcgagtctgctcacttccacattcacggtggcccttccaccgcgcaccaaggaagctcgcagtggacacatgaacaccggtggacccaacggtgaaccatgcccagtgccattggtcggcagctgcctggctatggcccaccccaagagcgtggtg

SEQ ID NO: 118559 - DNA, 626 bp, Homo sapiens
gtacaactagaaagaaggtactattagcatctcactgttatgggtggggaattggagtctcttaggtcaagggaagagtaggtggtaaaggagcaaggattgcaaatgggccatctggccccaaaacttgagcatgtggccaccgagcaatgttctctatagggtgcatggcagttttggggctggtacttcctgaaggtccaccaaaggctggagctgagcagcagctggtctggccaatctcctgaccaaacccagccaagcatccttgctgtttaaagatcaaggatgacactgcatgtcatttatccattcagttcattcatttatgaatgcccagtgattagaacagaacctaggacataggcctacatattcactgggaacttcctaggttctgtcctagtcactgggcatttagcagtgggcaagacaagtctctgctctcatagcattctaaattggggagccagaaaataaacaagtaaaaagaaaatgaacaagatgatgtctcataggaacaagtgctttgaagaagccataagggtaacctggggcagtggtgctgctggtttgcctagtggtggtcagggaaggcctccctagcatgtgacatctgagtggag

SEQ ID NO: 118560 - DNA, 1441 bp, Homo sapiens
gagcccctaacctcgccccacctcccaaaacttctccccctgccgtcgggctatggtaaaggggaaaggacaggactcaggaccttgagggaggcattgagtcagagggcagagaggggtcaaggagacccaggcgggaggcgcggaagcatacagtctgcggggacaaggactgaacggggtagtgggagccaggtccctggttcccttcacgcccccacccccagcctcagctctgtctgggtggaacgaatgtctgctaatgaactaaacaaacaggtctcttaatcttatcatggagctgacccagagactggcacagatatccaaagtatcataattggcaggtcagaattaaaactacatacatcatggtgactttatagctgaggcaaagtggagctcaagtgttactttcccagtaagcaaatcataatgaagtatcatgctggtgactaatttaactaacattgtccaggaaattgctgttgtccaggaagagaagagttgagccgagtgtcaactactaggcttctggcaccatcctgcacaagaaattgataatgcacgtatcaccatcacgatacgagagcaactcgaagaatcttaacgtataccacggtaaacacctacggcacccaactcagtctacagcaggacacccaaaagttaaattcactttggctgtggctgtgctccaggcttttacacctggtgaacgtctagaataactgccacagaaaatacatctatgacatttaatcactgagtgttcgagagaaggcaaagcccggacaccaagtaagccaggtacccctgaggcaaactccagaggcttccctgggccgtgaaaccagccaaagaaggcaaaattcacccaccctccaaaagacgtttgcgttcccacgcatgttctccgccctgagatagcttagaacacagctctaccaacgacttttcatttccattaacctattcctgattctttgattcaaggaaccttgccatccttagctctttggattatttatgaggtctgatttataatacaaaattatacagtgtaccatagttaaaaccttgaaggaaaaaatgcattttgtatttcttcttcttggagaggcccaaacacccctccccagggttggaaaggagagtggaggtagggtaatggaactccctctcaggcctctgaatatggagaaattaagaagaatgggatggggttgggggacagaggtagtaagcaaacaaatgacttatttttaatctagagttacccatttggagagagatacagggttatatcctaacggtacctttttaaaaaataagtcataagtatgctcatgccctaacaagttagtgaatttttccagtaaaattaaaattaaatagaaagccatggtaaattacccatttcatttctccttctagattt

SEQ ID NO: 118561 - DNA, 320 bp, Homo sapiens
ctttgcaccaggatgctgtttccaccagacacagctgctgactcactctgcagctctctgctttgctctgtggtttgtaaaccgtttagtttttttttcccccttttttgctcagtctgtacccctttgctaccctgtttctctccctttcttttaacaatattaggagattactttcctctgtaaaattaaaggagtgcctctgtcttcttaaaagccacagccgctccctttcacccacagggttctctgtaggtggacaatgctgcttgccactgttttttacctccaaatatgttttattttggtaattaccctaa

SEQ ID NO: 118562 - DNA, 818 bp, Homo sapiens
aacaagggcagtatagagtcaaaaagcaacactggaaaagggagagaaaagagcaaaacaaaattaggctggagtgggttttttagtttagtttagtttagttttgttttgtttgtgcattaagaagcatagcaggcttcaacatgacttgctggctaaaagttctaacatgaagagtcttttcaagcaaataccccacagaattcctcttatacatcaaatggagtatcagaatcctttggtcataaccttaatatcagacaattatatgtggatatttgtaaagatacattttcaacaattcaattaaatacaatggaccaaaatctgatagattccaaaaagttttgcctttcccttttcatcaaatcttacgtacctgaaattctcttgcatagggctgttcacttacactcagactttaagctcctttaaaggcacctgtgctctaagagaaaggatttcaatgaaaggtatgctaagactcgggctctgccacttatttaggcctgtgagtaagggcaagccaccgacctgtttatgctctgattggcttatctgtataatgaagttactaatacctaccacgggagattgtaagaatttctaaaattcaatgaatttgaactattttataaatgctgaagttgcactggggttcacacctggaatcccagcactttgagaggctgaggcaggaggatagcttcaggggaggagttcaagaccagtctggtcaacataatgagatcctctctctaaaaagaaattgaaaaaattagacggatggtggcacacacctctagtccccaccactc

SEQ ID NO: 118563 - DNA, 402 bp, Homo sapiens
attacaggcgtgagccacgacgcccgcccggccagaaaagtaacttttgtaggcgatggggtggcaatgaggttggagggaaggagactactttagtgacccaggcagggatagtgagagccccaaccagatgtttctgtgtcgagtcattacctgtcctctggctgcctgaggcccaacactttgtacagtctctaaagtaatcaagactgctccatggtaactttcttttgataattcttttatgctcaagagtgggctgagttaatgcaagacattttagagatgtcgtatgccttgtgattttctttttttctttttttttttttgagacggagtctcgctctgtcgcccaggctggagtacagtggtgtgatctcgactcgctgcaagctcctcctc

SEQ ID NO: 118564 - DNA, 386 bp, Homo sapiens
actcagtctcagtttcaacctctcttggagaccagggagggtgcagaccagattcgaaaacccagggcatcggcaccccaagggggctcgtggagcatggacgcgggcgcgtttctgcctggggtctggagctccgggaatctgcattgcgaaggagctcccagtggtggtgatgctgtgagttcgcgggctcggctccgggaaccgccggcccaatcagccctggactcccggcgccgctgcgtcatcctcccagttagtgggcaggaagcacagggacatgacccggtgtctggatgcggggatgagggatgacccgcgaggacatcagctctgtgacaggcacccacagtgcaggccgtggttggtttgctgggagggaggga

SEQ ID NO: 118565 - DNA, 434 bp, Homo sapiens
cccctttgctcacataaacacatattttccttatttattttaaaattaggtcctttagggcaatacagtaaatatctgtgctccaaaaaaatcaatcctgtcacaccaatgtttaacggactttgaaagaatgcagctgtatggaggaaatgaattctgttctctgtcaaaattgtaaaggactgcttgttttaacagctactgaagatggaagcatttatactgcggccatacggcttgtcaaaactagatatgttcctgtgtttaaaatatttgggattttccaaaagttaccattttctcttgatccttcttaaggagtactaggtttctgattacagttaactcctacttcactgttaaactgtctctgaatagacttaaaatatttagcccatttagataaatgattgagcgtcgttgttacgcattcc

SEQ ID NO: 118566 - DNA, 674 bp, Homo sapiens
tacttggaagaagggctgtaacctttagcttcccccagtttagcccgttggccttgtctaggctggtctgtttctgactcttcttttcctcatctaatatagacctacttttcttttattggaagtaggaagaggaaaaatagacaaaggaagagaaaaatactagattaaggctcagatattgtaggcatgagacctggaaactggagactccttttgggacagagttgtagcagcaagcccaactatagaagaagggaactggggcctgttggtggcatggtgaccagagattttggtgttgttttggtgcaacaacagaccagcatttcttcctgatgagagacaattgaccatggagtggttctggccagtctatggagaatgtgcagcaaaggttttcctgtcatctgcttcatcttttgatgtcagagggcctaaaactccaccctgggattatgctaacactgccattttttgtacacaggacccatgaagaggcatgaagctcaattgcacatgtgcatgtttttccttttgtaaatattaatgactcctcctataatctgttgaatatgtacacttaaccactcaacttaccatacgtttctgttcccttttcccctcccttgaagtatctgtttttggcttctgaccagagactacacttccca

SEQ ID NO: 118567 - DNA, 103 bp, Homo sapiens
taatgtcaatcaacaggaggctgataaaattatgaaacatccacactacagaatactatagtgatttggccgggcacagtggctcatgcctgtaataccagca

SEQ ID NO: 118568 - DNA, 729 bp, Homo sapiens
agagaaggctgagttgaggtggtactgaatttatgacaagcattcagcattttctgtgacaaatatctgttggacatcaattatgtgccagacactgttctaagttacagctcagctaagacagacacaaagccttgagctgcatctgagtgagagcccgagcacctgccatatgttgagtgcttgctatctgccggcacagtgcagaacacctgtgatgttaatcctacagaaaattgtagaaggcaggtgctatcattaactttacttcttcccaggtgaggaaacaatttcagagcaagttcacctcactgatgtgacaatgtacttcaatggactttatggggaacaagaagacatcttctcactagggctacaaagtgcatagaatgcatgttggatgctctgttactgtgaagggagagtcacccagataataaagccagcattgaggtcaagaggaacagcatcgattgttaatatgctgtctgctttcaacccccaaaggattattttcagaatgaaatgatctgtggtctttaaggggtggggatgggaggagctgaagaactctcgatccttcgaagaggtcccagtggacttgatttctcagtggaaacagagggatttccttctgcagtgggaaagagacacgaagtgataaaccgagcaccctctttgaagatttcccagtatatttgtccctagaggagtgcgcctccgggagat

SEQ ID NO: 118569 - DNA, 853 bp, Homo sapiens
agcataattctttcaaaaatagcttcttaatgaataccacttcaattttaaaacctatggttgaatcagaaaacaataagaatagttctccttccctattcttccttttccttctctatgtaaaatatggaagataaaattttactttccaggagatgttgaaagcatttaatttactttatgcttgacaaagaatagtcagcttcaaatgaaagtaacatgtaagtgaagtgtgttgtggaattgttacttcttacgatacaatgctcagaatttaactgttttggtttatagtatctttaaagtgtatagtagcccactgaaagcaggtaactattgagatatagaaaggatgtcctcctaactgatccctttttttactttttctggggcaaaaaagatatcttggtgtatttacacttgtttctttctctgtacaaatatatttttaagaatttgtgttgtttttccagttaaaattcctttacagaaaattcagaaaaataaataagaaaaaactcatttatatctcctgatatctcttcaggtttccagaacatatgttttaagtcctcttttgtgtctttaatttctctttctgtgtgtgctagctacttctctgtacttctccagactgttccagatgggaaactgaacatcttcttgagatcttccttgccttttcctattcttactccccaagggggaaaaaaatgtgtggagaacagacttttatcaccattttggggaagtagaaatgggatttcattacagccatgcaatttgtatttctaccttaaacattctcatactctaaaacacattttctggtttcccatgcattatggagaat

SEQ ID NO: 118570 - DNA, 581 bp, Homo sapiens
ttcactggatccaacaagttcaaagctaaactgatcacctctccttacaagcctatctttcaaagccctgagaatggcactaccatctactcagttgctagtagatctaaaaatatgatatgatatatactgtctaatgcagaaggagatggagacaaccaaaccatatagcctaaaattagatgacaataacaagtaactattattacaagaaatgtaaatggtaactattttgaaaaaaaaaaagactaaactatatcatacctagaagaacctaacctaaaacaaaaagatacacaagagttaaaagcaaaagaacagaaagaaatgaaaataaaaagaaatactaacataatatttatttaacaagtattatgtgtcagacacaaagttaagtaagttgttcaaggtaaaataattaagtagaagttaaggttttaatatcatacaaagttgtaatcaaagcaaaaagatattatattgaccaaaaggcttgttttataataattagggatgctctacactgaagataaaaccatcctgggccgggcacggtggctcacgcctgtaatcccagcact

SEQ ID NO: 118571 - DNA, 394 bp, Homo sapiens
gattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcgatgctgggat

SEQ ID NO: 118572 - DNA, 379 bp, Homo sapiens
attactctgaaagttacaatttgaaattgggtagaaaatccttaataacattactgactcattggtaattaaatatggagcttccatatttaattcaagtaattcccaaacttgaaaggaagaactactaatgaaggtttttatgcataagataatacactgtttactaatgttcaaaccacacaaatacttgtgaagctacaaaaatttagtcaatatatttaaaatctattattaaaatatgttatcagcccagctaagtggctcacacttgtaatccaagcactttgggaggctgaggtgggaagatcactttagaccaggagtggagttttgacaccagcctggtcaacagagtgagacccaggctctaccaaaa

SEQ ID NO: 118573 - DNA, 349 bp, Homo sapiens
agttggtactggctggcaagggagcctctctctgggactgtgtgggcttcctgacagcatggtggctaggctccaagaacaagtgttccaagagacctaaacagacagaaactgcaggcttcttctgacctagcatttgatgtcccagagtgttacttctgctgcatttttttttttttttttctgagacggagtcttgctccatcacccggtctggagtgcagtggtgtgatctcagctcaccgcagcctccgcctcccgggttcaagcgattatcctgcctcagcctcccaagtatctgggactacaggcatgtgccacaacacccggacaatttttttatgtttag

SEQ ID NO: 118574 - DNA, 256 bp, Homo sapiens
tgtatataaatggatggttggatgaatgaatacgagtgaatggatgaatgaatgaatgggtaaacagataaatggatgagcagatgaatgaatggatggatagatggttggttttatgaatgaatggatagatggatgaatgggtggaaaggtgaatgaatggatggatgaatgaatatgtggattcacaatcactttctatcctgacccctccccgacccacaaggctcttccaggcaaaaccccagttctcagg

SEQ ID NO: 118575 - DNA, 302 bp, Homo sapiens
aaaacatacattacataactctacaataatgaattttagatatatctgaaataaattctctatcaaaagacacaagttgctaaaactctctgtgggaaacaaagcaggcaaaaacaaccaattgaaaacaggcaaaaacttaccgagagaaaactattggagatttttccgtgtaaaactaactcttatctattttctgtagcacccagaaaacctctcttagtgtggagggcacaaattctatggaaagttctttccaggggcaatagcaatccaccattatcagatctgccatttctcaa

SEQ ID NO: 118576 - DNA, 301 bp, Homo sapiens
cttccttccagtattgttttacattcttattaattctttcaatgatgaaacggagtacttcagtaaatgttcctgagtcttcagatgtgattggtgactgttactaagagaaccagattaagagtcacaatgatttagccatgtaaccttggagggacataaactggagacaatttaggattggtaagcacagggtgattggcttatggagagagcaaacctgaaccatttcaaaaaggggaacctgcaataatgttcagcgatgtgctgtgtgaatatgacactatatggatttagtacc

SEQ ID NO: 118577 - DNA, 908 bp, Homo sapiens
tcttttgggggtgattaaaatgttctgaagttgtttgtgctgatggttgcacaattttgtgaaaccaaatggtaaaaaccattgaattgtgcattttaaatggatgaattgtatggaacatgaattgtatctcaataaagctgttatttaaaagaaaaaagtcaggaattactcaggcgacactgaagaggatgtgtacatggcttctttccatggaaggagacaaaccaccttgtattattgaagagaaagactctggtatcccagccttctactcttactatatacacagtttctattttggtcctttttaaagccttcttgttatagttagtgagcaacagttaagtcgaaaaccacagtgaggccttggttacagcttacccttgttttcaatcaacaaaaaatatgactaatgtcactgtggctcgactcaaccacatatgtggattcaggaggctttggacatgtgctagaggctgctggggctgaccagctggaaggacagcagttagctgaacttaggctccaggaataagatgttggtgaagcctgggaaaatgtcttccgtgagctgggggtggaaagttgttgtggaagtaaccctgaaggaaaaaagagttctctggctggcttggcccagagatacaggctggaaattagtaagaagagcagattttgaggccagcatttctctagctaacttctagcccagcgccccttttccatcctactatttcatacatgacccccaagggaagccatatcaggttcctagagttgggagaagagagactcagggggaacctgtactgaagtgactgtggcagaggcagggtgaggctgaagagcaccagaacatgagacatttccccgctgtcacttagtaacaagggccctgtgatgat

SEQ ID NO: 118578 - DNA, 438 bp, Homo sapiens
gtgccaccatgatcctgaatgtgggaaagagaatacagaagactgtcagccacaatgctgagggggcacagtgcaaactgccctggggtttgctggtgggagaaggaagaggtcagagccttagataactggggcggacggattaaatatatttaagaatcgggccaggtgcggtggctcaggcctataatcccagcactttgggaggctgaggcgggcagatcacctgaggtcaggagtttgaggccagcctgaccaacatgtagaaacccccatctctactaaaaatacaaaattagccaggcgtggtggcacgcgcctataatccaacctactcgggaggctgaggcaggagaatcactagaacccaggaggtggagggtgcggtgagagcgccattgcactccagcctgggcaacaagtataaaacaccatctc

SEQ ID NO: 118579 - DNA, 353 bp, Homo sapiens
aggcatgagccaccgagcccagcctgttgtctcttattttggtctgttttggtcccttccttcatgggcttgtgctcgtgattctgaacgtttgactctaaccacaagtgaatctttctcctggtgactcaaataaaagtatgatttttacctgtggaaaaaacttttaaaataaaaaataatgaattattcaatccatagaattagaccgtcttaactcttactttagtaaacaaatctgaactggtaggaggagataaagattttccaaaacacacatgcctccaatgattcagattctgcaattctcaactgaattagaacgttagaataacctgggtgcttttaaaaaa

SEQ ID NO: 118580 - DNA, 920 bp, Homo sapiens
gcttcatttagtcatacttgcaaagtcccttttgccatgtaagttaacagtttcacaggctccgcggattaggacgtagacatttgcaaagggggaaggtagaattattctttccaacacagacagtagcaaaagcatttgtgactcttaattgtcagaactttgcctctctagcactaattctctttatttaagatggataaatccatgtttgtttatatataaaatagtttgcttctctttttgtctcctgtcatctaacactatatatattttttctgtatactttaattcactctatctcttgctcattttagttgcccaggctggagggcaatggtgcgatctcagctcacagcaacctctgactcccgggttcaagcgattcttttgcctcagtctcccaagtagccaggattacaggtgtgtgccaccacggctaactaatgttttgaatttttagtcgagacagggtttccctatgttggccaggctggtctctaactcttggcctcaggcgatccacccgcctcggcctcccaaagtggtaggattatggacgtgagccaccacgcccggccaagactattttcttaagtaaggtaaattgggtggttgtaggaagaaaacatggcctgtgggtcctagaaaatcaggaacctggaactgacagtctgctgtgactcccacccctccctctgcggaggtggcatggattcagagaggaccaacctgtggagaatgggatcataggaaaccctgaaaaattactgggttccttctgtaatctagaagcaggagacacttgaggaccagaaggtgccatgcagacagaataatgagcttcttggtaacctgtagtaacctgtgtccactgatgaccaatagtctatggcttgaagatcatccacaatctcctg

SEQ ID NO: 118581 - DNA, 366 bp, Homo sapiens
agatgacagtcacaaggtggaacaaaaggataattacattatcatcttagactatgagaagttgatgggaaaagaatgtaaaaggtaaagtgattacataagtaatatactaatataaaatatatgataaagatatttaaatatattgaacagaagaaataaaaataccccatgggcttgaactgcacaagtccattgacatggattttcttctgcttcagagacatgaagactttcctctttcactcagcataaagaggatgagaatgaagacctttatgatgatccacttccacttaatgaacagtaaatacattttatcttaagattcttttttttgagacagggtcttgctctgtcacccag

SEQ ID NO: 118582 - DNA, 429 bp, Homo sapiens
tcttgactcaggcgctggttaccaggtggctgtgagcatttacccgtttggggcctcagctcccccacctgtaaagcagctaagtggtcagtgttaaaatcccactcaattatctatagtgctttctctcagaaagcagagtgttactcttcatggaggagaggaaatggcccaagcgtgccgcagccttctctgatgattaaatcctgaagagtacaaatgttcctgcaagcaaatgacacaggatgaagaatgtgaagttgaaatgggttttggctcatggctgaaggcaggagcctaaatttgttaaagaagcacataaataaattaaaagcatcatgcgtttttatttagcccaaatgcatttcggttgctagtgctttttgagcgcggttgccgtgcatgcgtgtgcatctgttggtcactagt

SEQ ID NO: 118583 - DNA, 446 bp, Homo sapiens
aaggatccctgcagtgtgctgggctgtctgctttggatgggtcgttttatttatttattattattattttgagacagaatgttgctctgttgcccaggctggagtgcaatggcgcgatctcagctcactgcaacctctgcctcctgggctcaagcaattctctcacctcagcctcccaaatagctgggattacaggcgtgggccacaacacccggctaatttttgtatttttagtagagacggggtttcatcatgttgaccagactggtcttgaactcctgacttcaggtgatccacccgcctcggcctcccaaagtgctgggattacaggcgtgagccactgcgcccggcctctagtatcctttataataaactggcaaacattaagtgtttccctgagttctatgagccactccagcaaattaatcaaacctaaacggggataa

SEQ ID NO: 118584 - DNA, 433 bp, Homo sapiens
tcatgccggacaccaggaccctgacggcacgcccgcactcctgcttagtgaggaagccagcatcgtgcagcggctgctggacagaaggcatactcgttagtccgtccttgtcagctggggctcgctgcagcctcggtgagggcccagctgggaatgtccttgccctcatctcctccctgtcacttctcccaggtaagagacagtaaggtctccaaggtcccttgtttaggtcataggagcagacagcaaagatgcaaacatccctcgtaccaagcggcaagaaagaaatcatcctcacactggtcacactgtccaaccacagcagatgatgggcgcgtctgtggacaacctcgagaccacgtagggcgctgtcattacgtatgtcattgcttcttggctacactgtgtcaatgttttctggctacactgagtc

SEQ ID NO: 118585 - DNA, 328 bp, Homo sapiens
aaaccttgatgtgtcctgtttcattgtgctatccaaagacctacaaacctccagagagagcagttagttgctaataagggctctcataatttccatcaagcagtagtttcacagatgggcatccaccttgctcccttcctggagatcaaagtacatactttattattttatattatgttccttaaaataatattgtacccttcttcatttcaggggaatgaaatggtgttttatcgattccttaaactagaaaggtcgtagtgtgttgcagatatttccagagtatttttctggggattgaaagtgatagaactatgtattagggctt

SEQ ID NO: 118586 - DNA, 451 bp, Homo sapiens
tgagtcttagctatgccattgactaattgtatgaccttaagcaaactgatatccactctaggttttcttatctataaaacaagactggggatttccaaagtctcttccaggtcttaactctacatgaaccctaggatctaggcaccataaaatccatttcccactttttagatgacttccagagtcaccttaattatatccttttgtgcctccgtgtttactgctcaaccaacatcaaacttgtggagagcaccaatgagttcctggtaataatatcctctagaccataaataccacatgtccaatgtgtccgtaccactgattcttcctagtgtattaatcattataaaagcctagatataagtgtgctggggaggttgatataaagccaccaattgagaaaaaaccccaaacacatagtttgcacagtgttgaatccacggtgggcatt

SEQ ID NO: 118587 - DNA, 877 bp, Homo sapiens
aataggagagtggtaaagtatctaggtctttattgttttgttttggtttttccaggtattaacaactaccactctaagttgacgtacaagtgaaaaacaacccaaattgactgttttgggggaagaaaactcagaatgtgttatttgaaaagtttttataaataagaacaaggcttgttcatcgctgtatctccaagacacagcatatagtgcctggtataaagtagctattcatgaaatgttagtgaaggggtatagccctttagggttaccaaaaccaatacccttgacatatatgctattttcagttgtaggatgtggatggagttctggcagcaggagggctgagcctggagcctcctgggccttgctctgtgatgtgggtagggagtcaccagtcatgagcacaggtgcagggaccccagtctttctctctgcttcctaaggtctcctctcctattccccatctgctgagtatcacggcctgagaggccatctgaagcaaataggaagtctccgtacagacccttgtgagacttatatggggagatgccttgaaatgttcccttctgcagacactgagcagcctagcattcttatttgttaggactgtaattatgaccacctccatgtgcagttcatcaggttcctttgcaaggtgaggcacacatgcatcccttttaaagttagagggtttgggaaaggatgttctgggcttggacactgctggaggagtctggcctgggcaatctggcctgggcagcctcctgatggggagaggagcccagcctaaagaattctaaggcccaagggtttgtgctgttttgcttttgtttattaaagctgcacaaactgctttactgtttacagttcacca

SEQ ID NO: 118588 - DNA, 304 bp, Homo sapiens
tgcggctttctgagaggtgaagttacttgacaggggtaagtggggagagaaaggcagaggggaggagaaaggagcctgcacctactgagtgctcacaaagtgccctgtgctctgcccatgggttacctcaattttctcatttaagtcccttgctgaccctgagaaacagagattatcatcctcatttgatgcttcaagaaactgaggctcagacaggctgagcaacttccccaagatcacacagtgatttgcacccaggcccatctaaagcattcataccgcgctgccttgcatggaggaaggg

SEQ ID NO: 118589 - DNA, 353 bp, Homo sapiens
cctggggtgatggccggagaggaaggctggagaggaaggctggggagggcccaccgtgggtattaccaagaaacccctgattcctgccgcagaggtctggtgcgatggggcctttgggagagcactgagctgggggccacaaggagattccatccccattctgttgtctgcacgttcactggtgcgataaaaaccaaagatgaatctcaggcaggcctgggggcttgtctcctgagagcacctgcaccccggcccccaggcagggctgggtctcagcccggcttcttgctggggactctgtggggcgggagctgcactgggccccccctggctccctgcactcaggccccttg

SEQ ID NO: 118590 - DNA, 796 bp, Homo sapiens
actgttgagctgctcagtgcccagcttagaggaccaggaaaaggagtcaccggccgtatgctggaggcttgagacacggcacagaggcgcagctcgcctcgctatggttggtggtggcagtggagattgcgattgcagcgcggctggaaggtcctttaggttgtttgagggacattgatcaaggaaaccggagaaacttaaaatgctcttccgcttctttggaacagtcacagagaaaagtgaactcctttcattcttgcagtaatttttcttgctgatgggaacagttcaagtcaagtgacatgtgaggaacattttgtgtttaacgtaaaccttcctatcccaactacattgaaacagtaatgatgcaacaagattttgaaagaacaaagaggaactacagaatcattgcttacattgacaccggccctgttgtcccaatggatgggttttttttggatgaacgtcaaaattgaccctgctgttaaagcttgaaacttggatctgttgtatctgagttctctcctcaaaaaaagaccttcaggaagtatcagataactgaaacataccagatcacagcaccacatgcctcctgcccctccctaatttctgttctcttatacattgttaaatttttttcctgcccctattagtcaagcccatggatttgagactgagcttccagctcctgggccgcagcaccaggttaaagctttcttccttggcagtacttgtcacctcagtgactggctttttctccgatgagcaggaggacctggacgaaacccctagtgtt

SEQ ID NO: 118591 - DNA, 469 bp, Homo sapiens
ggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagaggtgcgcatgtgcgagagtgggcggcgcggcctgggcgggggtcgggagagggagtcgggctgctggaggggctggggcctccggggccaccgctcttggaagggggccatctctcatgccagggatgtgcaagat

SEQ ID NO: 118592 - DNA, 633 bp, Homo sapiens
aaccttcactaatacaactcttcttagtactccaatcaatacccctgaatcatgaaatgttctactctgctactgggaacaggaactatttctggccctgtgtgaactccgtaaatggttctctctaatccttttgagtggctccttccctgaactaaggggtttcctcacatgggtgcactgatcagtactcaaccgaatactcgagtgggctccctgggcatctgcaggccagtgttctcttctctgtgcatctcttgcctctttgtttctctgcctgtgaactctagctgccccagctgccctggattttcattttacctcttcaatgaggagagactgctggggcctgctgatgttccttctccccgcaccgcggtctggaaactttctccgagcattaaatcagagcaatcatagggctctatttctcaggtctcaggattcgctgttcttaatcaccttagacctaataacttcagagtttgacatattttctccagttttacagttgtttcaggtgacagggtaaatctgagccccattagcttagccaatcatgtgtggacacaaatgtaagaattttaagagttcagttttgacctgttagataagtagttgagtatacaaatc

SEQ ID NO: 118593 - DNA, 290 bp, Homo sapiens
cctggaggcagagcagacatcctcatatgacccctaagggtatacaaagccctcatctgatccctgcttctttccttacctccccacctaaaagtggatgtgggttgatgacaactagactctagcagccactaaggaggtaacagagcagcctggtcctagtcttctaacctggatccctaatgtctttatttctcagttggctctcctttttcccatacatgtttcccttgggccccttctccagcctaaccattcctttttattgttgcacagcatgaaaaacagtg

SEQ ID NO: 118594 - DNA, 159 bp, Homo sapiens
agtgagactccatctcaaaaagaaaaaaaagaaatatgcttatccctttccttctgccattttcattttgctaaaaacctcaaacccaagtacagtcaatatgttctgctaaaatttaggaaaggaggtgggaaccacacctttttttccttttcacta

SEQ ID NO: 118595 - DNA, 621 bp, Homo sapiens
ggtggcgtgggtggcggtggtggcagcgccgggatgccgcgggttttagctggccgcacgctgactctcaggggcctgggtccctagttccccgcggccctccaggcgttcatcatcccctcctcaaagccagactccctttgcagtatggcattctgtgtatgctggggtcttcctgttacagcaggacgcacccacataccccacctcgtccttcccccatcattatcccctgccctctgaggtggtgaggcccatcggatctttgtatttaagtggtgagccatataccgagcatgtgtttgtgggtgaactgtgctgggactgaggttcacttctctgttcaaatcagttagataagggcattctgtttagtctgtaaagagatattgagaaatgtcttgagtcaaaacgtgaaaactttcttcaactgatgatatggagtctaaacacacacacagagtcgagacacagtcacacaaatctagacacgagtctagatacacacacacacacacacacacacacactctctttgctccttgggatcaactgtgtgcttctcgagggcgtaatacactctgcctggtcagtcagagatggtggtacaggggagaggtc

SEQ ID NO: 118596 - DNA, 722 bp, Homo sapiens
cttccacttaatgaagagtaaaaatattttccctcccttatgatttttcttaatagcattttctttcctttagcttccttattgtaagaatacaataaaacatacaaaatagtatgtatatgtgtaacacatataacatacaaaacatgcgttaatcaactgtttatgttatcagtagggcttccagtcaataacagggtattattagttaacttctggtggagtcaaaagttatatctggattttcaacctcacagggtgtcaatacccctaatccccacgttgttcaagggtcaagcagtgtactttcatttcagaggtggagaaagctctgctattatcagccacaggaaacatagtagaccatcattcacttcaatttggtaagtcagcagtttttaccacatcataggtttcaaggggtgctggcaacagtagttgctgttaacttgagcaggatagagaaccttggcagaacaggttcaaaaaacatcacacagtcctggaattggtaactcattattttagcatagtagataccaaagaatagatgtaagccttacagacctaagttctgctacttacttaattacatagccttaggcaagtcactgagtctcagtttccttatctataaaatggggtaacaattaccttgtagggctagtcaggcacattatcatgaaaacttaatagcacttagcagggagcatgctataagt

SEQ ID NO: 118597 - DNA, 440 bp, Homo sapiens
  misc_feature (251)..(251): n is a, c, g, or t
  misc_feature (254)..(254): n is a, c, g, or t
cttatggtgatgatgtgagagtacggtcaaacagtggtgtggtcctggtgccgggtagtggtcagattctctttattcatcttcggagcagttggaagtggattcacatgagggttatggatagagtatggttaacaatcttcccagggaaacgggttgggtctgatgcggagatgggggtaggcgatgaactcgggtctctcgtgctctccgtggtgcgacttcaggtacacattcagcatgctgactgncancccggggagcgcgacgaagaaggtgagagtcttccacatgcatgcacccaggcctgggtgcgaatgtctttcagcaaagtcctgctttataggctcttgcatattattcttcatctccaccttgggaataatgagctttttcctttctttgagatgtatctcaggaggtagaaagcaccatcaaga

SEQ ID NO: 118598 - DNA, 157 bp, Homo sapiens
actcagagtcaatgcccccaccggtgaccctccatttaggggatccaagttctctttttcgccaatgatgtagctgttagagaactctagcttctgtcagagatctccaattagattcccatcttgcacagactcgggttggctgttacaatcgaag

SEQ ID NO: 118599 - DNA, 309 bp, Homo sapiens
gaaagactaaagtaggctgagtgcagtggctcacacctgtaatttcagcactttgggtgaggggagtattattggaggccaggagattgagactgagatgcacaagatggcaagacgctgtctctacaaaaaaaagtttttaaaatcaggcaggcatagtggtttgtgtgctactgagactgtggtggtggtctcatctactcaggagactgaggcaagaggatcccttgagcccaggagtttgaggctacaatgagctgtgatcatgccactgcactccagcctgggtaacagagaaagactgtctcc

SEQ ID NO: 118600 - DNA, 533 bp, Homo sapiens
gcacgagtgatgtcagaaagaaaaacaattgcaatatcttttgtgtactatgtcacagaactgcagccagggaaggggttaacatgttattctctgcaggtaagtttcctctctctctctctctttctcaatccattctttaaagggctgggtaaatcattggtggagctgggcgggatagcaggcagagggagggtgttcaggctgcattttaggggaagctgcaaggacaattggggcaggagggtccacagagttacccaaggggaagaaggacattgatccagctgcctctgtctgtggggtagcttctcaccatgttcccttctctatcagcttttgtcttctctggacactaaaaaaacaaacccaaatatggtcaaatagaagaaaaggaaggcaaagaaaaggaggaggaggaaaaggaaaatgaaagagaaaagaaagaagaaattcttttaaaagaaaaagaagctagaaagttacaaggtgaataaaattaaaacactgccagaaaaaaaatgtaagaaaaa

SEQ ID NO: 118601 - DNA, 154 bp, Homo sapiens
cgctccagatctcaggggtcctgagcctgctccgcaggtgaggtggcggagggcggggggcgggggcacagggtctgggcctggggtttcctcggccggggaggaggctcttccatggcatgagcacagcctagcagttctctgaacaaaaccc

SEQ ID NO: 118602 - DNA, 655 bp, Homo sapiens
aattattgatttgagatttttctgctttttcattgatggaattctgctataagcttccttcagagcatggttttcaattaatcctgtaagtttttttaggttttgtctactttttcatttatcttaaaatactgtcttatactacttgtggtttcttttttggccttttattattttggaaaatttttgctaatgttcacatttttaggagtttcccagatttcttcttttcattgatccctaatttgcttttattatgatgagaaaatattctttgtattattttaatccttcaatttaattgatgtttgttttatggctttgcatagtgtcttagaaaatgttctgtgtgcatttgggaagaatacagattctgctgttgaatggcgtgttccatatgtatctgttaggtgtatttggtttctaatgttgttcatattttctatttccttgttatcttgtgtctagttgttatacccattagtgtaagtggggtattaaagtctccaactatcattgctgaattatttcatttctgtcaagttttgcttcttgtgtttctgtactctttccctgagtgcatacatgtcaataagttttacattttcccgattaatttaccctttgtcgttataaaatatccttatttctgtta

SEQ ID NO: 118603 - DNA, 247 bp, Homo sapiens
gggctggggtttctggctgggagtggggaggggctgcacggtgatcggtggctactccacctccagaaagagcgtgtggcttctctgcctcggggaggatattctgctctcttgtgagttttgcaagccacccgagattctctcttgaattgctgtcaagaaatagagaccggcgttgtctctggccctcgctggggaagcttttctgaggttttgtttttttaatttgagacggagtttggctttt

SEQ ID NO: 118604 - DNA, 403 bp, Homo sapiens
acaaacaaacatatcctagctgtggccactgagtaggcctagaaataatgacacatcagtcacaataagcacatcatatatccagatcttgatttccaaataccattttttcctcactaatagtaacaatactcctcgaagaaaagctgatttgaggggtgggccatacaaaatgagcccagatcatcttgttgcaccagaaagtaaataggtactcaaagaattctggagacatatgaaaacacagaagccagtttgaaagagtttacacagaccaaatttgggatgattttagtatcaagataataacagtaatgagttacagaccactaaataagaatatgtatatgaatcattcaaataaataattgaacaaataaataaatgggatgtggagggagga

SEQ ID NO: 118605 - DNA, 774 bp, Homo sapiens
gccttttctttcctttggatgcaagcatgcttttcacaggaggtgatttaggagcagtttgttaacccatttaaaaagtgaattagggcgaactatgccttttctactggccaaaaaagaagagggagggctggatacataatctagctgccacactcccaaatcctatcacggtaggtctttttacaaactaggaacagaattgctagatcagttctccagagaggaatgtgccataaaagaaacagaaagtaaatggctagcaggaatcactgtctaagaatgggactgtgaaagggattacaaaaaccttgcacaattaatagcctaaattcatttaacttaagcataaccagcaatttaaaatcttttcccttgtgtcttctcttcaagctccgattcggtgcacttttcatactaaactctctattccttctatttctaatatgcctttcggaggaaataagaactaaatgtatgctgacagatttccacagatgggaaatgtatggagagaagcagaacaaactcaaggcaaaaatgatagtgttttgttgtctgtgtgtttttgaagaagtatcctttgctccctcacatgtggaatacagaacacacagttttaaaagcaacagttgtattaggcctaactcagtagttacctcataaagtattcttgcttttcatgtaggggcatggatattatttcagcactagtgaccaacctttttttctctaagtaactctgctttaagataagaactaagaaataataac

SEQ ID NO: 118606 - DNA, 483 bp, Homo sapiens
aatactcagaggcaatcatccactcttgagtgtactctttccagttctgaataggggtgggttggatggggctcaattcctctcccacttccaccttcccacaaaaagaataaagaacaggagaaccagcccatgctacctgcaggttacataaacattctcaccacccagcaagaactgcctccccaaaacccaagtcagtactcactgttttctctcagtccaacaatccatccgactcctcctgaggctagctgccaagaggagactgtctgcagggtttgggattactaaaggcaaggtgccacatattgtttgctgctggcccctgtctaaggcagcctggctgagaatgtttatgtaacctgtcgggctagtcggggccccgactagcccgacagggcaccatccttaggggagaaggtctacagttatcattatttaacttcattactttcagtctggacgactaggctagtcaga

SEQ ID NO: 118607 - DNA, 167 bp, Homo sapiens
gtaaaattgaattcactgactttgatctaaatagttagggttgtgaatattagtctaggttttaatctaatccaaggaatggttacttctctttagtttttcctttctgattataaaaatagagagttgtgctatgaatttcaataaacagcctggttgggagaaca

SEQ ID NO: 118608 - DNA, 443 bp, Homo sapiens
gagtacatcttgagaagttttattggtttcttaaatgttttaatcatcatcatcttatcatttttgtggtttaggtttttgttagttaacttgataacacatctttgaagaaaggattctatttatttgataatattttctgggattcagtttaatgcaggtttaccaggtaattgagcatccagtgaagggtgacgagtcatatggctttaaattgaatcttagtgattttctactaagaatgggtactagatagaaactcctccagatgatttgcttttgacattctttccctctgtttcaaatgttttactcatatttcgaaattacatgtaggtgaagcctgtaaatttttcagatatcaaagtctttcttgaataaacgactaaatctcattggaagcattactataatataataaatgaaagttgtacatttttcaa

SEQ ID NO: 118609 - DNA, 473 bp, Homo sapiens
aagtataaataaattgaaatagaatcttccctgctgtttccctcgagttccattcctgaatgctcctccagagttggtgtcgacagaggcctccttatggctccctgcagcaggtcgtgccgcacctccgcctccgcctccgtcccccgagtctccatgtgttcgcggcagggaccgccggctcctggtgaggccgcgtggcgatgcgctgggtggatgtgcctggctggtggatggggcgttttgacggcacaggtgacgcagcctcaggcatcctgtgctcacgtgcccgagtgagcattgacaggggactggctcctgaagtggaattgttggccttcacacgggcatttagacttgttagtgttgaactcagtatgtgcatcttgtacatggaagcaaaattctagaaaaatatccattatgtatcgggagtaatcattttcgttttcatatttccaagcctttgaacc

SEQ ID NO: 118610 - DNA, 326 bp, Homo sapiens
ttaatcctagttctgccacgtctttctctcaatcacccaggctacaaactctagagtcctcatcatgtggttgtgaagaccttctaatcttctgatgctacatcttgataattctcactgacacctggactcttaaaataaaggtgatgtctgcctgtaatcccagcactgtgggaggctgaggcgggtggatcacgaggtcagaagatcgagaccatcctggctaacacagtgaaacttcatctctgctaaaaatacaaaaaaaattagctgggcacggtggtgggcgcctgtagtcccagctactcgagaggctgaggcaggag

SEQ ID NO: 118611 - DNA, 433 bp, Homo sapiens
ccagactagctcgacagctagcctgacagccccgactagcccgacagccccgactagccctgacagctcccatttactaatttgatgctcacacaggtgacgttttttagggaggccctacatcatctgggcccgacgctagcacctccccgcttaggtacttgagccccctggaggaggctgtgaacagtcatggcagggaaaggagacgcaagacaaaacgacattattacggtgcttttccatttttctttttgcacaaaaacagtccatttattcaagtgttctccagcacaagtacattagaaaggagctttattatattcttctgggcacaaaaaaaaatgtgatgaaggcggaactgacagactttctacatctgttgtacgcattgacctctttaattatttcataaacagctatgtcacgagca

SEQ ID NO: 118612 - DNA, 394 bp, Homo sapiens
acgattagtctaatatggacctctgggcttctgggtagtaaagtcctggtgaggaaaccaccagggcatcagtaagtgccagatgttgggctaagctcactgtccaagcaggcctcaccctcacgaccccatataggcatcattcccatttcaccataaggaaactgaggctcagcaggcttaaacagctggtccagggccacattgtgagtaagcggcagaaacaggatgtgggccgaggtctccacttgggtaacctagctcgagatttgctgcttctgctgaatccagccctgagcctggtgccctcccagggacaggagagcctgaagtcacatgggtcctggagttgagacccaatgtctttgtcgacgcggccgcgaatttagtagta

SEQ ID NO: 118613 - DNA, 384 bp, Homo sapiens
tgtatcaattattttgattcagccatgatgagggaactagtaagatgttaaagtcacttaatatgaaaatttgaggaggtatttataggcaatttaataagggaatattaagactgttgggttacatacagaattagttaataccctacaagaaacataaaagagtaggctttgggttatattttcctctggctaaaaattacttgcatctcagtgggcgtggtggctcacacctgtaatccagcactctgggaggctgaggctggtggatcaactgagtttaggagttcgtgaccagcctggccagcatggtgaaaccccgtctctactaaaaaataccaaaaattagctgggtgtggtggtgtgtgcctgtaatcccagctg

SEQ ID NO: 118614 - DNA, 467 bp, Homo sapiens
ggtggtgcatgcatgtgaacagaatattgggcaactgtacaaacaaggaagcagctctttatgtcccaataatgagacatccttcaagatgcatcattacatggagaaaagattgaaaactctgtatagtagctactgcttgtggggaaaagagagaaaattatatgtgcactatattccacactattaaatgaactggtgacattaatggccccagggaagagtggccaagctggcaggctttggaacagtgctgagagggagacttgcactgtggactcatttttgaaccttcagaatttgagccttgtgaatgtatcactgtattacattttcacaaaaccttcacaggaataaaacactgcatctctgaaatgagcaggataccatgatagaaacaaatggagaacataaaaacatttgcaaattaaaatacaggctgccccagtccatccccaccccatgtc

SEQ ID NO: 118615 - DNA, 757 bp, Homo sapiens
cgtggtggctcacacttgtaatcccagcactttgggaggctgaggcggtcggatcacctgaggtcgggagtttttgagaccagtctgatcaacatggagaaaccccgtctctactaaaaatacaaaattagctgggcatggtggtgcatgcctgtaatcccagctactcgggaggctgaggcaggagaattgcttgaacctgggaggcagaggttgcggtgagccgagattgtgccattgcactccagcctgggcaacaagagagaaactccatctcaaaaaaagaaaaaaagagagacagagagaatgctgaatgttgtgagcatttccttttaagggcactgattgttgatataagttgttcttgaatggtgacataggtgccaagttgcataaaagaggaacgtggttcagcaaaaattgtacttctcaaatatgccaggaacctatgccagtgcaacagcatccctgcacctgggaaccaggataagaggtgggggccaagggatgcaggcagaaatacgctgcatctgccatctgacagtgggtaaaatatacaatgctccattgtaaataaaatagcaatacatgggctggacacggtggctcacgcttataatcctagcactttgggaggctgaggcgggaggatcatttgaggtcaggtgttcgagaccagcctggacaaaatggtggaatcccatctctactaaaaacaaaaaaattagccaagcgtggtggctggcacctataatcc

SEQ ID NO: 118616 - DNA, 767 bp, Homo sapiens
aaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttgg

SEQ ID NO: 118617 - DNA, 704 bp, Homo sapiens
aaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtaatcccagctactaaggcaggagaatggcttgagcccgggaggtggaggtcgcagtgagctgagatcgcgccagtgcgtcacagcctggggcaacagagtgagactctgtctta

SEQ ID NO: 118618 - DNA, 404 bp, Homo sapiens
cagttctgtggtcttgagtaagacacatggcctctcttggcctcagtttccctatgtataaaattaggctagaattgggctagaacatttctgtgaatcccctcagccccaaagcattgtaattctctattatctccgtcttcttgactgtctttctaactgtctatcagagatctaggtgacaaataaggagaagtgtgaatcaaagacgtcagcagatgggatcctgaggcttgtgtgttagcccgtgtcttctgcttttcctatcttgacctctctatgaccagcaaggaagtattactttattgtgataatgcttgttactctaatacattccccaacttcagctggcagtttgctgacctaagaaaggaaaattccagcattcaacccttctctctcct

SEQ ID NO: 118619 - DNA, 252 bp, Homo sapiens
acactttctacatcttgaaggcaaggaatctgaatcttgaagagattaaatgaattgtccaaagtcacgtgggggtttgggagaaggaaaatcatgaacacacattcttctactctggagaagtggggaaggtgacctgggaaaccatctgaaagggagcaggatggattctataaaatatagagtgttcaatgaaaacaacctgatgctcctcccagtaccatcacatttttctagctgcatatccttagg

SEQ ID NO: 118620 - DNA, 327 bp, Homo sapiens
ccaacatagaactgatcagatactttatactataattatttatctgtcttttcactagactataagttctttgagggaagaaactagacctgatccatctccatcccatcattagggtctgctaccaagtaaacacttgatacgtgtcccttaaatgaatgaatattgtcaaggagttattttctgtctctcccaaaaacaactgtactgctgacttgttattttgagtaagtaagtaaagtcttgtttggaaaacctcagatcatatatattttgccctgtctccataccagatggaattgtatctccgagaggcatagacacagg

SEQ ID NO: 118621 - DNA, 165 bp, Homo sapiens
acatctttatattattgtttctttttctctagggaactctaatacaatctcttgttactgaatcaaggtgataacttaggttcttactctgtgtctcttatattttcttttagagagggaggcacataaaataaaaattggaacataacatttacttgcctaata

SEQ ID NO: 118622 - DNA, 801 bp, Homo sapiens
agcgggtttgggaaagagaatatggaattcatatttctttaaatcattcttttaaacttttaatttttatgtagttttagtacatcttatttgctagtactgtgtcatctttttggctgtatttttcactggctgccacctggccaaatcaccacttgggttataacagcagcctctgactggtctccttccgtctgaccttggcccctgcactctactctcaacgtagctctcagagtgatggaactcagaacttgtcactcctgctcaaaaacttccagtttcacccaggggaagtatcaaggtgacatgaggggacaggaaatattgtccctaaatgttctaagagtggatctcccatgtattcaagcaatcgaggggtgtttaatgagctccatctacatagcaatgatacagcatagctctgctggggctctctgctctccccttctccacaaaagggaaggacaggtaagaacaggcacaataaaatagaaaccagacagaaagaattgggaacaaggagacaagacaagaatcatgctttacgtgatttaatcctaatatttttatgagaggatggctatcatcatttcattttaaagatgaggaaaatgaagccgggtgcggtggctcatgcctgtaatcccagcactttggaaggccgaggaagatggctcacctgaggtcaggagttcgagaccagcctggcagagagatggcagagatggtagagatggttgctgcaaatgccattatttcattcctttttatggctgagtagtattccatggtatgtat

SEQ ID NO: 118623 - DNA, 987 bp, Homo sapiens
gtgacattctcattagggagtttcctgaggataatctcttccaggagtatccttttaaaaaattagatacctaattacatttcttttttgcatttttccatactctcctcgttttccagcggaggtgtgagaatctggctaggggacagagagtagcttggcttttgcaagtaatctgtatcagagagcatgtccattcctagtataaagggaggaaataggtatagtaggaggatggttactgggacgggacaggataaggaaatgggcagtttcttagttcctcctatgttagatcttagaaatggcttcattacttgctttaaagtgtgtgaattttcagaacaggcaatatatgcacattaaaaagtaagtataaaaacaaccttaaagtcaaaaagaaatgaggttttaattgtctgcactcaagtgccctccatttgcacaaataatggacagctgactgtatatcttatatttggcatataagtagccatttgaaggtttaaaaactgaccattaatgtgaagacaggctcagcatctcccttcagctcttcatagcagctccctcctaagactcgtgccaaagtgaatgaagtaaggatggctggaaattcctaaggaactcactccaaaagcagttctgctcagagatctgccatctgctggctgcagaacagtagaagagctgggttctattgtacaaaaagtacaggtcctggacctcagtttggtctgtagtgtggctccacttatattccaggatatacagttagattgtaattttcgaagaactcactgttggtgtgtaagaatcttcatccaagaaaaaagcatgtgtgtaagtttgtgtgtgcctgtgtgttcctttgtacaagtgcttatacattgcatgggaagtagggctggaggaggatgtgtcactttctagggtggggagtattaacccctgcttttggcaagagcctgtttgcatcaatagaaa

SEQ ID NO: 118624 - DNA, 829 bp, Homo sapiens
gtctaaccttttaaatcagttttttaaagactggatgccatgattttctttgatctcactctgtcacccaggttggagtgcagtggtgtgatcttggctcactgcaacctctgcttcccaggctcaagggatcctcctacctcagactcccaagtagctgggaccacaggtgcacgccagcatgcccgactgattttttgtatttttggtagagacggggtttcgccaggttgccgaggctgatgcccatgattttctatgtgatactgtcttctccgtcatcaagaacattttttaagattactcttattatgtctctgggattaatctccaagctgctgattacatcgtgcacgtttgatactgtcactttcatgatgttaaccaatatcacgaaaatgaaaatttcatcaggaaaagcaactcagtcccaagagtttttcagtgagctcattctttaacaaatcgctcctgtgcaggcattgacagctgtgtcatgacagctgcctgaccatagtaaggtgtcatcaattataaaatgcattccagttttcagagatgttttgaaagagatgatggaagattcagaggtagagaatagataccaaatctatagactatttatatcccttaataaaatgctaggaaaaaacagaaatcaaaattataatagaaaataattttaagccaaggaatatttgaaccctaccgatcaaaagtactcttcaagaagcattatttggctctgggtgtctgaggtgggaggactgcttgaggccaggagttcaacaccactttgggcaatataatgagatctcacctctactaa

SEQ ID NO: 118625 - DNA, 775 bp, Homo sapiens
gtgcattcctcactttgattacttcaaagtctattattttgttttcaattattctgtttttctggcactggagaaaatcaatttgttttattttctcttattcatgcactcaattatgctcttcgggcacatttaatcactttgatgtttccattttatggcccgtctctaggcacttcagctgcattgctgccaatgggcaagcaggactaatttgcatgtcacaatagacttgaaattctaactcaatttagaaatctttgtgaaatctccctccaaaatgtgcttggagctgcaaagagggcagaaggaatgttggcaaaccagggagcctgttaaagatactttcctttctcaaaagactgtgagctccttcatgacccgaccatggcttggggaagtccctgtccaggtacagcagaaaaccatgggatgggaggtctgcagaccctcctctggaactctgtggtgagaatcctgcagcagctgcccctcagtggcaaggccaaggaggctaggcccacttaccctggcagaaaatgacccttagcactgctggatttggtggctgtgctcaagacagcacctgaatctcagttgtctaaagagcctccaggtagactgacaaagttgtcaacagttaggcattccaaaaccctgagtggtttaccttatttttcctaataatttccaaccttccttctaccccttgatcattttagaactagaagctggagggaaatgagcaatacaatcgctttgggcatgtacttcg

SEQ ID NO: 118626 - DNA, 258 bp, Homo sapiens
gaggattttgatatgtgttattggattgacagaaacaagaaaatggggtggggtgaatacagctatattcaaaggaaaggaattttattaggaaggcatgtgccagagacaaggtttctggtgagcctttgaggatgcaaagaacgcagtggagccgaggagactatttaggaaaggagagcatgaggaagaatgcagagctggagacaaccactgggctgaagctgagtgatgagtggagtgtgaggctagactgga

SEQ ID NO: 118627 - DNA, 177 bp, Homo sapiens
tctgttggctgccatccaaggtttctgaaaatgcgggagagtacaaagtgttaatatacctaactctgcatttaaagctgacttcaaaatttgtggcatatttggcctcaagtcgtttgttaaatttttagaaaaataaacgttataagttgtcctctttcaccccgaccgcagtca

SEQ ID NO: 118628 - DNA, 260 bp, Homo sapiens
tgaacagttccactggggaggctggagaactaaggaaacacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttct

SEQ ID NO: 118629 - DNA, 912 bp, Homo sapiens
gttccaaacaaggtcacattctgaggccctgggggttaggccttcaacatatgaattcgaggggacacaattcgacccgtaacagcttctgtctccccacacatccgatgtgcttctccctctgccacgcttaggctggggtctctaccaggcacctcgacccgagtcctcactcaggccggctctgagcctcacagctctgtctgtgggagctgccctagttttccacggacctttattaggtgacatgggaatatcgagcagtgccccagaatccctgggttttgacacagtgcttcctcctcacctgaggcagcattcccaccctcctgcagggatctctccgaagagattcctctgcagagatctctggcccgcggagctcccttctccagcggtcagctcggcagtgagcggccccacatggccagagggcatctctgctcctgtgtttgggaagcagacccacgttccccagaggaccgggagccaggactgccactcctgcgaccccaccttaccagagtgggaaagaaaaatccctccatagccgattagctgtcacggccactctgtgtaaggactgcagaggcgtggcaaggccgtgactggcgtccgtccacagaagccctctcacaggcatggccactccagttcggcattctggcggtggggaaacggctcctaggtcggtcccaggttagaagcctgttctgccccccacaggcctgcatctcagtgttaaggggtgcagtctccccgctgcaaccattccaccagtctgttaggcctcctgcttctaggtgaagggcgtggagtgagaccagtggaactgatggacacaagcttatcgccacactggttttcctctgaaacaaggccctggattacaagtgtcatttgtggaatccc

SEQ ID NO: 118630 - DNA, 234 bp, Homo sapiens
aggctgatctcgaactgctgaccttgtgatcctcccgcctcagcctcccaaagtgttgggattacaggcgtgagccaccgcgcccggcccccaacgtttctttttaagcctgtcatatctcacattaaatgtgtaagtctctgaactgtagggctttgaacaaaggaaagttccatgagaatactatatgatgccaatttctactgttaggaacgcgataacaggtaagaaaac

SEQ ID NO: 118631 - DNA, 268 bp, Homo sapiens
tggaagcccatctgcaacacactgcctaaaattagacacaactaataactatttaactagactggcctattctcaggactaagagactagttccatggcttataagacaattcaccaactcaatttctggactataaaatttctttaaaatttttcacaccgaggaatgctggggctcagaagacaataccctaaaatgaaggcctcagtagcagcctcagaagcagaagtttttctctgaccctctcctgtcctcctgttgcagttc

SEQ ID NO: 118632 - DNA, 860 bp, Homo sapiens
aaccctttacaggaggaggagcacagagacaggcaggggcaggagctggggcaagctcttttaggctctggccccacggtggcatctaggggtgggtgcctgcagctcccgaagccccattgggcatgctacagtgctcttttagcttgccatatgcagatgggttaagtgttaaccagctcagtaccttcttggtatttgggttcttgtccagcatccaggaagaattgggtcacacatggacttgaaggatggtgtattcgggattttattggatgatggaggtggctctcagtgggatggatggggagctggaaaggggatggagtgggaagatgatcttcccctggagttcggctgtcctgtggccgatctctctgaccatccccagctgaatggctcttgacattcagatgctccttctcttctctccttggccacgctgctcttatgctcctctgcacattctgtttgtctgctcatctgcctgtggaacctggggtttggggtttatatgtgtacaggatagcatggtgtggcaggccaaaaggcaacatttgggtgcaaaaacagggatgcctgttcccatttagggccacaggtttccaggcttgagggtggggccttagctggggtactgccttcttctacccagcatttccctgtctcctgtccatatcactagggtttttgtttttgctgagcccacacagaagtaggatctgctagggttttatctagattgggctactgaatgttaaggattcctcagaatgttaatttgctttctgcaggtgacaactgtgtggatcctgcctggcaggcaagcagcaaattacttgatatggtagtagatgatg

SEQ ID NO: 118633 - DNA, 667 bp, Homo sapiens
gccaccgtgcccggcctgtgaatgaatgtctttaatacataaagagccttcacaaaatcaatatacaaagattggccgggtgcagtggctcatgcctgtaatcattgcagtttgggaagccaaggtggaaggatcgctggaatccaggagttcaagaccatgtctgtgaatagagtgatacctgctgtctctataaaaataattaaaacaaagctgaaggagaccttgctatgcagccccctgccgcttgtgcacccttgtcgacccacacgcaccttcaggagggcggcgcacacctggggtagtcacagtgcaggactctggctcaatagcgcctttgcattggtttggaccttcgggagggcggtacacgtctggggtagtctcagtgcaggactctggctcaatagtgcctttgcattggttgggaccttcgggaaggcagtgcatgcctggggtagtctcggtgcagaaggactctggctcagtagcacctttgcatcagtttggaccttcgggagggcggtgcagaaggactctggctcaatagtggctttgcatcggtttggaccttccggagggtggtacacgcctggggtagtctcagtgcaggactctggctcaatagcacctttgcattggtttggaccttcgggagggcagtaca

SEQ ID NO: 118634 - DNA, 585 bp, Homo sapiens
gagataattccacttcatagggaacatatgtatgcatttgttttagcctagtggtagggagagcagtagataaaagtagagataattagggaaggggaagaaatggcattatagaaggagaatgcttatttcatgggttcagtagatgtttatgggacttttaaaaattgataaaacattttaaaaggtggtatatgatgaaaagaaagtctgctttccaccacaaactcccagcctttccttaccccaaccccccaatccaagcaaccatattcaatcacatatgtctaggagaaatatattgtatctttcattcttatctttggcatatgaagatctttttgtatttagcacatatttcttacttttttaaaaaagaccgcatgccttgctagtgtagatgaaccataatttattcattttccgtaatttattttaccattttctattgacagatatttaggttgtttttagccttctacaaacactgctgtaatgaacaatacatatataagtctttgcattagttagtatctatacagaatgtattttcaaagtgtgactgtaagattgagactgaagtta

SEQ ID NO: 118635 - DNA, 311 bp, Homo sapiens
gtagagatggggtcttgctatgtaaggctggtctcaaattcctgggctctagcaatctgcccaccttggcctccccaagtgggattatagggcatgagccacagtacccagcctgtatcttaaacttacaaatttctgtatatagatttattttatgtataaaaatatatattaaaatctacacatataaaactgtccacctatataaaataaaataatagtataatttttattttatttttttgagacggagtctcgctctgtcacccaggctggaagtgcagtggcgcgatctcggctcactgcaaact

SEQ ID NO: 118636 - DNA, 339 bp, Homo sapiens
caaaagcatgatcagtagtgagtggctccataatccagaaagcagtgattgaggggtagctgtgggcacagcccagaaccagagaggcagtaaggagagagaacattcaaggggacaggatcttaatctggacatggaaggcactttaagacagatcaagatcaggagacagggtgttcgctatatgggggaaatcaataatgaactgccaaggaataaggatttatttgtcagagtttctcccaggaaacctccgccatctttcccccctcctatagtttcagaacttacagagaagctgatgcaggagtcagttagggatcaatctatcatctttat

SEQ ID NO: 118637 - DNA, 342 bp, Homo sapiens
atctttttttccatttattttttccttcccaggaaaagaaatccccttttagttggcgggaatctattgttagttttccttctctaaaatagagccctcttggcacatccagcagagaactgcaaggcaaacagacttcagcatgtttcatgtcggtgaatgcagaagttagctcactggcttcaatagttgagaactccactttctcccttcatgactgcatgtgtgccttcctgaagctgtgcacttataaaaatgagggttgacctatcgaaataggaacggaccattctttcattcagcgtatggttcagagtttgagttcaattagacagaggtttt

SEQ ID NO: 118638 - DNA, 374 bp, Homo sapiens
tgagctgagattgtgtcactgcactccagcctaggcaagagaaccaggctcctcttaaaaaacaaacaaacaaacaaacaaacaaacagagatgaccagcccaaaggtaatgaacagacaagggagttgaaagttaccaaagagacacacggatcaagtctgcagaagacagagcgtagagtcctggattagatgatagaatccagattcaatgagggctcagttagctagaatgtgagtccaaactgacaagaggaaaatttaaaggaatacaattttacctgcttttgcttttggtatcaccatgccataggcattgatggaagacacttggcctgggagcaattttatgtgaaaaatatcttggggtttcg

SEQ ID NO: 118639 - DNA, 287 bp, Homo sapiens
caaagtgcaaaggtgagctgatgtgtcagaagaaggggtgaaatctgcagcacttctgttcaacatgcccaagaggaaaaacaagcaacagcgacagcaccagaagaggaagattcctcaaggcaaaactacgtttctctggagtgcccaatcctctccaatgtgacttggataattctcaataatttaagcaacttggagtcctaatgttttttgccagagactaatttagagtttgccaatggactgtctctgaccaatgaagaagtgaggggtggtctcctggg

SEQ ID NO: 118640 - DNA, 601 bp, Homo sapiens
cacataaatgattgaacacttactttaattcagaaacatgcagaactcaagatctttgctaatctctacggagggtgaaggaggaagatgaagtttaatccactgatgagagtaagtacgctgttagggcttcattttctgctttctgatagatcctattgatggagaggaccacagtgacaatcacagtggaacacttggctcatccggagtagctttaacacacttggtgtgagctgcagggccactagagaagtgacagccacagacactgtctcccatgatgattagctggcctggaacaccagctcttccttatctattgttggtatggcacaagtacaaaatatataatatgtatctttgatctctaactttcccaatgagaacagagtgacccagaaacattgtgtgaaatatctaaagtctcatacttggttcatggagaggagggaccagattccaacttctgggctgcaattgatattattactttcttatgatttccacagttactgcttttgttattatttcttgctttttcagatgagttagtactctgcacagacaaggtagagccgagctcggctctaccttgtct

SEQ ID NO: 118641 - DNA, 277 bp, Homo sapiens
gcggcgccacgttgctgtccggaagtacgaggagatgcgggaggaagcttccaacatccgccctcaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcggtgagtgtgtttgagggacaggcagagaaggagaggggaagagagagaaaggtatagagagggac

SEQ ID NO: 118642 - DNA, 1853 bp, Homo sapiens
  misc_feature (1029)..(1029): n is a, c, g, or t
acagtttctgcccccgttgtaccacagagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaggctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagangcccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaaggtgaggcactagtgggtgggcacagcaagaccctgactacagcctggcaccctcacctggcccagatgcacctgcccacagccagatatcccccagcctagatccatctgttccatcacaggtacaccctcacctggcccatatgcacctgcccacaggcatagatcccccagcctagatccatctgttccatcacaggtataccctcacctggcacagacacacctgtccataggtatctatcccccagcctagatccatctgttccatca

SEQ ID NO: 118643 - DNA, 708 bp, Homo sapiens
acagtttctgcccccgttgtaccacagagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggtgggcggccaagcagtcagggatgggggatcctggggtgggggtggggtggaaggaccatgaggatcccttagcaactaggggacaccccagccctccccaccgcgttcccacctctctgtgccaacctacccaggctccatagtgatacttccttctgcctctaaagctttgggaaggacc

SEQ ID NO: 118644 - DNA, 506 bp, Homo sapiens
cccccacccaccaatctgagctataactttcaccgccccccggcctctgatgcaagctgcagctctctcctggctcatctaggttgtaacccccacctccccttacctctgacctgggatacagccacgatcctctaacctcaacttgaacatcagctctcctggaagcccgccccccatcccttattgtgaactgtagataccccccagccagcgctgtagacactgcctgatcctctcaccgccacagcaggccccaggaaagccttgaccacctgggctgtaagcaccccacgcccaccctcccagccaggtttctcagtccctcactgtcctcagcactgtcccctccaggctggcaggctcctacgacgtcagcggcttctgcgagaggaaccgagacgttctcttctccgacctcatagagctgatgcagaccagtgagcagtgagtggtcccaggcatggggacctccggctacaaccccccaaggggatggagggagg

SEQ ID NO: 118645 - DNA, 427 bp, Homo sapiens
agtcaagcaccaggtggaatacctgggcctgaaggagaacatcagggtgcgcagagccggcttcgcctaccgccgccagttcgccaaattcctgcagaggtgaggagccctccacccccgccctcgccatccccttcatcagaacgcccagccaggcctgtctgctatgagcactcccacaccccagccctccgccctcaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcggtgagtgtgtttgagggacaggcagagaaggagaggggaagagagagaaaggtatagagagggactgagagagagagagag

SEQ ID NO: 118646 - DNA, 2969 bp, Homo sapiens
  misc_feature (1029)..(1029): n is a, c, g, or t
acagtttctgcccccgttgtaccacagagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaggctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagangcccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccctggagatcatgtctggagggggcacccacaggcctccccggggccctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttttcccaggaaactacgtggagaagatctgagctgggccctgggatactgccttctctttcgcccgcctatctgcctgccggcctggtggggagccaggccctgccaatgagagcctcgtttacctgggctgcaatagcctaaaagtccagtcctttggcctccagtcctgcccaggccctgggtcaccaggtcactgctgcagcccccgcccctgggccctggtcttcctccaacatcacacctgctgcccattctccatttctgtgtgtgtcaaaggggactaacagcagaatctacctcccaactgccatgtgattaagaaatgggtcttgagtcctgtgctgttggcaaagtgccaggcacagttggggaggggggggtccttaacaagcgtgactttgctcattctgtcatcactaaggcaataaacctttgccaggtgaaaaaa

SEQ ID NO: 118647 - DNA, 1135 bp, Homo sapiens
acagtttctgcccccgttgtaccacagagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactactattaaactgtaacttgtctagtaaattgtcaaaaaaaaaaaaaaaaaaaaaaaaaaaaaaaaaaaaaaaaaaaaagacaaaaaaaaaaaaaagggggcggcggcgcccacccaaaaaatttacccgcgggggggcccagaagttgagcggaacaccccgattttgtggtgaacagagggggcccccaaagggggcggcgcttataaaaggagcgcagaagaagcacgagggcccgcgactttaaaacaagagcgcgctcggaagtgggaaacaacggccgcaaaccgggggcgcaacatggggagaagaaacaccctatacgcggggggggggggacaaatagggggcaaaaacgccaccagg

SEQ ID NO: 118648 - DNA, 950 bp, Homo sapiens
acagtttctgcccccgttgtaccacagagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtgcgccccctgcccctaccctaccctgtgcctcctcgcagacccccagggctccaggctgtagcccccaccctccagcacccaggctggaaagagcctgctaggacccttatccagggctgtagaattccactgtcccccgcctcaatccaccccctactaaccagaac

SEQ ID NO: 118649 - DNA, 414 bp, Homo sapiens
cctaagggtgtcatgcccctgagccagcgtttgcattgctgtacagaaacctcccacggacacatccagcttctccaggcctctctcgtcccgcagaaacccttatagacatcaacagtgtccctccccgcaggatccccctctccccaaatctagctctcctggggcccctgcctgctgtttgcaaaggttccataacctttccaggcagctgcagcccgtcggcagagttgtaacagcagctgccatttcatgccagacacttggcaccgcattatctcagcgaacaaagctcaatgcccctgttttggcagcggggggtggggggactgagatgccaggacataaagtggtggaaggcaggattcgaatccaatgctgccttgtttcaaaccagggctataaaccaggacg

SEQ ID NO: 118650 - DNA, 278 bp, Homo sapiens
tgtttacacctataatctccctctcctgttttcctagtttctattcaagtatttggggtaactgatatttcttaaaacaatatgtattcttggaaagagatgtttctagaatccccttcttaggtgacttattaggaaaaattataagaataagaacgagaatagagaagaaaagtaattgaagacatccacttcaactctaaatccccctaggagaaaaaaggctagcacttatttaaatgcccttcttaggtgacttattaggaaaaattataaga

SEQ ID NO: 118651 - DNA, 589 bp, Homo sapiens
ccatgctgggggctatatgagaataggaacagggtgagagctgaccccaggagccctcgtccaccctctggcctcacccctgggaacagggaagcctccctgtcctggctgtttggagagagagctccacgcagggcgaagctgggacctggagccctccgcaggatacggcccgctggttctcagcctctgccggccccagacgcaccaacctggagaaggtgcattaatgggtcggagagcgtgggtggacgggccaggcagggagagacggagccctgtgcgggctcacagaggaggccttcaactctaaggccttacccagcaaggagacactgctctgccgtgggctccggtgtttgcctcctgagggagggcaggagccactaggacccaaaggccggaagccaggtccaggcccttcacagggacggccggggtgcagtgatcagggcctcggccccgttctcagaggccacccatccatggtgcacccctccctgtggaaggccagaggccccatgagatatggggatgcagttcccaccccagagggtccaccaccctgtgagctgtcactcagagcagg

SEQ ID NO: 118652 - DNA, 550 bp, Homo sapiens
gcacgagatttcctgaaagccctgagctgatcctttttcaattagccaactttcagctgagtctgttaactctacttgggtttttcatttcactgaaatttgcttctagctccagccctcctgtaatcccttctatattggcatagctggctgagcagggacgcttccatcccctgcagtcacttaagattactgcccatggagacttcccacccaacagtcaagttgccatgttgctatatgtcgtatatttccagaaggaataccttgaatgaacattctagagctcattgagatgagagacatgttaaaacaatatatggtggctcccagcacttcgggaggccaaggtaggtagatcacttgaggccaggggttcaagaacaacctggccaacatggtgagaccctgtctgtactaaaaatacaagaattaaccgggtgtggtggcccatgcctgtagtcccatctactcgagaggcagaggctgcagtgagccgagatcatgccactgcactccagcctgagtgacagagcaagtctctgtctta

SEQ ID NO: 118653 - DNA, 389 bp, Homo sapiens
tgatagctcattgtggttttaatttgcatttcctggattagtgatgttgagcatcttttcatatacctgctggccatctgtacattttctttggagaaatgtctattcaaatccttttttcgttttttaaccaggttatgtgttgttctgcttttgagttatagaaattccttatatgtattttggatattatttatcagatacatggcttggaaatattttctcccattctgtagattgccttttcactccattaatcatttcctgtactgtgcagaagctttttagtttgatgtatccatgctcttcttatattacccctgctcagccctggagttggtcatttctccaagaagccatgactccttagtggacagtggtacgtggaa

SEQ ID NO: 118654 - DNA, 298 bp, Homo sapiens
ctcagaatcaacaaaaaattatcctacatggttgcaacgtattcaacatttcaggaatttccctgtaacaactgtaacacagttaagcaacaggtatgctggaggttagttaatgctgtgttttccagaattaaagatataaatgcatttctcaaatatatacactacattcctttaaatcactgtgggtgcgacggcttacgcctataatcccagcactttgggaggctgagatgagtggatcacaaggtcaggagttcgagaccagcctgaccaacatggtgaaccagatctctac

SEQ ID NO: 118655 - DNA, 401 bp, Homo sapiens
cataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaactgtaagtaatccctgggcctgtgcttcctctgggaggtttctgggaagaggaggaactggataaggcagggggagcattcatagtagggcaccttgggcagggctgtgtgtgtgtctggctcatggtggtgctaggatggcatgaacttggttcctacatctttggtccacatgggccccactggccatgcacacaggtgtgtagagtaatgtaaatatggcagctgggaaggtgcaagta

SEQ ID NO: 118656 - DNA, 481 bp, Homo sapiens
tacttttccacagggttcagttatcagtggtcaactgtggtccaaaaatattaagtgaaaaattgcagaaataaacaactcacaagtttccaattgtgtgacgttctgggtagcatgataaaatcttgagccatccaactccattccactagggacatgaatcatccctttgtctagtctggatacaggctgtggatgcagtagtgaatccacactgtttgcactctccgcctgttagtcagttatctagtgactagatatctaggttatcagaccaactgtcccagtattgcagtgcttatgttcacatgaccattattttactttataatggccccaaaatgcaagagtagtgaggctggcaatttggatatccccaaagagaagacgtaaagttctccatttaagtgaaaaggtgaaagttctcaacttaataatgaaagaaaaaaaattgcatgccaaagtcacccaggtctacagt

SEQ ID NO: 118657 - DNA, 607 bp, Homo sapiens
ctcatccctcaggtctcgttgatttgtgccaaatgagggcaattactagacatatggacacctcctctacctaatgaaaagctgactccctcattcagtcatgttttttatccaaatatgttttaagtgaaccagcaaaaccatgcagagccacttcacagagtatgcagtttgtggactgaaaatagagggatcaggagctgaaatccagcccatgctcagcactctgagccacgtgtctcagcatggatctacatccacctgaaagaagggcatctcttcctttgcaccaagtaacctcagcttgccaagtcaagtgcctaaagggctgttttctcctacggcacatttttcaacattcacatcaggtatcctattgtctacccagtgtcataggactatttgacctgtgaaatcacatctccctgggtctcattttcctcatctctaaaatgaaaagacgggcaaaataaattctaaacctccttccatgttaaaaactctaaagaacaaacaacctaggcttccctggctctttcagagttacggtgtaatctgccaaagaggaaaaataacgactagacctcgagatcctagcggcttccta

SEQ ID NO: 118658 - DNA, 240 bp, Homo sapiens
gcttaaactatagcctgctacatacctaggccatatgatatagcctcttattcctaggctccaaacctgtacagcatgttattgtagtgaatactgtagacaattgtggtacagtggtaagtatttatgtatccaaatattatctaaacatagaaaaggtacaataaatgatacacctgtacagggcacttaccaatacagaagcatgaccatttatatagaaagttttaaggaatctca

SEQ ID NO: 118659 - DNA, 417 bp, Homo sapiens
agagccggcagggtgtgaagccagattggaggctttctgcagagtcaggcctcccaaatcctgggatggagtcaaggagcttttggctgtcccacccttttggtagtgccccggtcactcttcctcctccaagtccccatatccaagcctgtcatatctcttcagctctaggggcctgtctgtgacttccaccctaagggagctggcactttgtgtcatgctacattgtccacatcaccgattccccctccctctctccccttccttcttcctccctgttcttttttttttttttcctttgcaacggaatctggctctggcatccaggctggagtgcagtgacacaatgtcagctcgctacaacctctgcctcccagattcaagcgattctcgcctcagcctcctgagtacctggga

SEQ ID NO: 118660 - DNA, 327 bp, Homo sapiens
cttacagatgtagggcatcatatccataggagacattcgccaggcataaggatcctctggagagacacatcagcttgaggaatacagggtggtggctctgtccagccaccctgccccatctcctaccctcccatccattctgcattgggtgcctcctgcatgcagagtcctcctccaacagcaaatgcctcccagatttgctgaagggcctgctccagggtctctgtggagacgcccctgggacccttgctgaccaccctccacaatctgcacccccatcctgtgcccccttcgttttttttgtcccaccactacctggtggtgaga

SEQ ID NO: 118661 - DNA, 2797 bp, Homo sapiens
  misc_feature (500)..(500): n is a, c, g, or t
  misc_feature (951)..(951): n is a, c, g, or t
  misc_feature (1085)..(1085): n is a, c, g, or t
  misc_feature (1088)..(1088): n is a, c, g, or t
cttcgaatcagttattttataacagtatatactaaacatcattactccttttcaaacataaataacgcaatacaaattggacaaaaaattcaggaaagatctgggatcaaaaaggaggtattgaaacatcacatgtactccataattatatacaaatattttgtacccataatatttaaaatacagaaaattaaaaggtacattttcctcaaagtgcatgcttcttttgctatgcaaaactgcaggatatggaaagaagtgtattaaaacactaaatcactttatgtggaagataaaagggatggtacccaatgtacaacttcatgtagtgcactgatatattcaatataaatgatgtattaacttcaagataacatgagaaagttaaattatctaacttatttcaaactaggggatagtatgttctcattattagaagccagaattctgcttatccatttctattattagaaaaaaacataatttttattcttgtcttngaaatagacaccttgatataattctctgtaaatgtagcatgatagtctgtttacagagtttatatcattccaagactgcacttctaaagtgagaaaatattaaaggatataaactcactcctctctacaaaattccttattttttatgcaatggctttaaaatgtatggaaggggagttatggaaacaatccatacctggaaagcattctatccatgcctttgaaatggttatctagtactagattcttatcggtgcctagctatgtaatgtgtgtagcttaagatttttaagaaagaaggataaaatgctcaatataaatttaaaaagcacttttattggaatattgagtcatgtatttgctttctgtaagtccttttatctataaaataatagttgagaaaggcaaatagaatatgtggaggaattaaaaattcagttgtagggtggtnaatgaaaaccaaatttttcattcaccacattaaatgtaaatgggtattatactcaatttaagcagcaaagttgctcctttttttttttttttttttttgagacagagtctcacactgtcacctgggctggagtncantgttatcatctcgcttcactgcaacccctgcctgctgggttcaagccattctcctgccgcagcctcccatgtagcttcttaagatgtgaagatttttaaattaagatgactcttgggatgaaccatttggtgttggttaaagacttttactgacatatttttaataatttttttaacttttattttcaggtcaatggcacatgcgtaggtttgttatgtaggtaaactagtgtcacagggatttgttgtgcagattatttcaccacccagctattaagcctagtacccattaattgtttttcctgatcttctgcttcctcccaccatccaccctcccagaggccccagtgtctgttgtttccctctatgtgttcatgtgttctcataatttagctcccatttgtaaatgagaacatgcagtatttggttttctgttcctgccttagtttgttaaggataaagacctccatccagctccatccatgttcctgcaaaggacttgatctcactctcttttatggctgcctaacattccatggtgtatatgaaccacaaaataaagatggttcttaacttttaaattaagatttttaaattaagatgaatcttgatttttaaattagtatggttttaagatagttttacagatagattagataatctatctagagatagatagggagagatatctatcaatacatatctctatctagatatagatagatggttttctatatagacctatctatctatatatgtatacatctatatatgtctacacatatctctatacacatatatatatttatatctacatctgtatttctacatgtatataggtatgtatatatctacatgtatatatgtatatagatagatatatacataggtatctgtatatatgcatatacatgcctatctatctttatctacatgtattacatagatagggtaattactgataaatcctttggtcttctttgtaaatctctgggctaaagacccctccagtattatacgtgttctggtctagattgctcactcaccggttctcctcactatctagagaagatccacttagcaggcctccccttaaagaagggcaccttaactggactcactcctcccatagtagactgcacagtacacaagcagaagaggagagctcagtaataaagtcaccataaaggataatttttaaatgaataaagacatcagaaaatccagtattggctagcacatatggctatcagcaagctcaccctacaaaaaaatagtgagaaaacagttcgaatattggccgtttggggcacatattctacaaaaaggaaaagttttgaaatgtatatatatttaatttaactctttaaaatatttgtaggcaagcccagtggctcacacctataatttcagaactttgggaggccagggcaggaggattgcttgaggccaggagaccagcctgggcaacatggcaagaccccatatctacagatggttttaaaaaattagccaggtataacacgatgaaaccccgtctctactaaaaatataaaaattagccgggcatggtggtgggcgcttgtagtcccagctactcgggaggctgaggcaggagaatggcatgaacccgggaggcggagcttgcagtgagccaagatcatgccactgcactccagcctgggcaacagagcggagactccatctca

SEQ ID NO: 118662 - DNA, 665 bp, Homo sapiens
  misc_feature (1)..(1): n is a, c, g, or t
  misc_feature (21)..(21): n is a, c, g, or t
ncctttctcctacgatccttncctcttcacgccaggagcccttaaatggagtacccacagggaatggagctctaggctaagtgctttgggattacaggtgctttgctcttgtttggaggtccagacatatgcttgagaagcagcttgggatactcaagagaggcctgaactggtaccctggaggccaggatgaaaacccaggcctctccatttactttcttgggccccagagtccacatttgggattcactgtctaccagggcacctctctgggtggcatctaggagccggaggcaggccagagtttcacccaggctggagtgcagtggcgcagtcatggctgtctgcagcctcaacttcctgggctcaggcagtcctcctgccttagcctcccacagtgctggaattacaggcacaagcccccgtgcccggctttcagctagtttttgtagctcatagtgattattcttggagccaataatcgtgcatgcatccacatcttgaaattacatggtgtcaccttgaccagtctgttgacatatgcagattaggtatttatgagatccagagacttataggggaggggtggatttcagggaaaagggaacctcttagagaaaggtagggagtgtctgcagttctgcctgtgaggagggtaccaggac

SEQ ID NO: 118663 - DNA, 249 bp, Homo sapiens
attttaatcatttcctgcaggatatgaaataaagccccaaacactcttatgaagcctcaaagctctccagtaactttactaaccaagtgatatgtaagtcagtttcataaatttttgaatataggcatcaaatcagttccaagagctcagcagcagaagattgcagcagggacatcccactgcctaggaactgaggacatattttagacatctattaaagcatatccggatttggctttggtcagtcag

SEQ ID NO: 118664 - DNA, 342 bp, Homo sapiens
aaacgtttattgtctatgttattactttatgtgatgttgcattaaaaaactcatttttgactgggtgcagtggcttatgcctgtaatcccagcactttgggagtccaaggcgggtgtatcacctgaggtctagagttcaagaccagcttggccaacatggtgaaaccccatctctactaaaaatataaaaaattagccaggcatggtggcgtatgcttgtagtcccagctacttgggtggctgaggcaggagaatagcttgaacccgggaagtggagattgcagtgagccaagatcgtgccattgcactccagcctgggtgacaagagcaagactccatctc

SEQ ID NO: 118665 - DNA, 143 bp, Homo sapiens
aatgggcccatggggttgggtagcagagattcaaggatcctgctctacccatggccctgaatgtgaccatcgctgttgagcaatgggccatcccagtgggtctcctggggcctggttggggggcggagttgtttccctgggat

SEQ ID NO: 118666 - DNA, 201 bp, Homo sapiens
gtccagataccctctagttggcaaacaagtgacaatatgcaaattatcagaagccacaaagatttcacatgcatgtccacgcagatgccctctcacatacacatgtccagataccctctagttggcaaacaagtgacaatatgcaaattatcagaagccacaaagatttgcttcggtggggagcctgaacaaacaaggaac

SEQ ID NO: 118667 - DNA, 417 bp, Homo sapiens
taatacattatcaaaacattatcctgaatcaagttctagcttcttttaccctaattttaaaaccagtaaacctttggacaccagaatttaaaattgattccgtaattgttttccttcttaaattgtatcttctaagtatatatggctttaataaaatgaagtgttttaagttgatgagaaaattttgattttggattgttaatatgttacaaagtatatttgttttaaattttttaatgaaaatagtttttataagaatgtacagataggctgggcgtgttggctcgtgtgtaatctcagcactttggaaagccaaggtaggcagatcgcttgagcccaggattttaagaccatcctgggcaacatggcaaaactctgtctctacaaaaaatataaaaattagccaggcatgatggc

SEQ ID NO: 118668 - DNA, 747 bp, Homo sapiens
gtgataaggttaggctgcataggatgtaccagctgactggatgtggatattaaaggcaatgggggtattaacaattatttttaaaatacagcaagaatttaaaaaacttttaatcaatcaaaaattccttatttaagaattatataaaatatcagtaagtgaaaaacatttaaaattgtattttatcagggattataacttaagtagaagatacatgttaatttcttaaaacatttcatttctgtgctaagctctttcaaagcactggatggtgatctaaaggtcaccaaattctttgtcccaaattggtaattttaaagtaaacataatttcaacgttaggcctattttgttatttgctgagaaatgtctcaatgtcaaccaggcagttctcctctcttattaaagtccatgctcagaatgcctgtgtaacctatccttagtgataaacaaggtggcagatagatacatgataaaacaagtttgccatgtgcctcaatgtggctgacatttatacttctcagaccttgctattttagggaaggtatcagtataaccagggcattctttttcctggaactaaaaatccttaataatcagtcactattataaacagaatgatttacatacaggaatcaataaacagttgcttttggttaatggttatctggagtaggaggatagttatatttcaaatagaatagaaagctttattggaatacttacatgtctttttagtttgaggacc

SEQ ID NO: 118669 - DNA, 114 bp, Homo sapiens
gggaaccctgttgcttgtcggtgtctgtttccaagacggcagaaagcctgaccatcgcggggccctggcgggagcgttgccatacaagtttccttccaccagggggagcacgtg

SEQ ID NO: 118670 - DNA, 543 bp, Homo sapiens
ttattattatactttaagttttagggtacatgtgcacaatgtgcaggttgttacatatgtatacaagtgccatgctggtgtgctgcacccattaagtcgtcatttagcattaggtatatctcctaatgccaatactagtttttttaatgaactattcttttagtaacctattcttcagtcttgcttgtcctgcacgtcacatcaactctggtataaggtacggggaatatattctcccttctttttgaaaattgtttctgcaggctgggcatggtggctcatgcctgcaatcccagcactttgggaggctgagttgggtggatcacttgaggtcaggagttcgagaccagcctggccaacatggtgaaaccccatctctactaaaatacaaaaattggctgggcatggtggtgcacacatgtagtcccagctactcaggaggctgaggcagcagaattgcttgaacccgggaggcagaggttgcggtgagccgagatcgcaccactgcactccctcttggacaacagagtgaaactccgtctc

SEQ ID NO: 118671 - DNA, 626 bp, Homo sapiens
gtggcatgtgcctgtaatcccagctactcaggaggctgaggcaggagaattgcttgaacccaggaggcgaagattgcagtgagcagagattgcaccactgcactccagcctgggcgacagagcaagcctggggaaaaaaaaaaatagaggtcacatcgattctaagccacctcttcagagacaaatgaaatatgcagccgaagttgtccacaaaataaaacgaagtctcaatttctattgttgtgtgtgcacacagccccaataatttaggacagattttcctaatcataggacagaaagaatccaggcctttgataacaaatattagctgtctgccggatcaatactgtagtgcactttaaggaaataaacagcatgcactcctaaatattttccatgcaaattttgtgtaaaaaacaatcaccttctaaagatatttttattatatgaggaattcgcgtttactgtagaatatgtggcaaattaaataagcatacagagcaaaataaaacactccacccagaggcaaccatctctttattatttatataaaaagacatataaagagagaactatgctacacctgagacagtattttatataccattttgcatcctgcttttttc

SEQ ID NO: 118672 - DNA, 385 bp, Homo sapiens
ttccttgccacctcccactcagaggctgaagaaccagatactttcttagcctcccttgcagctaaggatgactacgtgacctggctttggccagtgagatgtttgctgcgggccttctgaaaaagtatttgcttttctgagcagaggcacaaatagctgatgttgtccccttctttctttctgctttgaatatagtcaagccgtctggagctgtgacagccatcttgtgaccatgtggggatgagcacgaggaagaagacaacatgtgaaggaagaaagtcagaaagagcccaatttcttgatggcatcattgagcagctgaacccatgccacagttcctgttaacttaaaaaaataaataaagccatatgtgtttaagccacta

SEQ ID NO: 118673 - DNA, 658 bp, Homo sapiens
aacagctataatgtgatatgaaaatatttttgatatatgttggtgagaaagttgcagacactgataataagactataatttgttgactacattcaattagaaatgaataaaaataaaggtttaatttttcccatcaaagtccaaagagcacccctaaattctattcacagaacctcaggggaggaaatcttgtaccagagagtccattaattagtataaaggatgtaagaaataatatttcattggtgaaatgaattctgttaaaaatatgtgcaatggctagaaattttgtccatgtatgaaggtacatgcttgcatgaataaaagataaaaatctggcaagccagcccaacagttcagcatgttctggaatggcatctaggcctcagactttgtgtgatcctataaagagccagcttgccagatgtccctagtgataataaatgttattttcagccactacatgttgggggtaatttgtaacacagcaataaataaataaaataaataaatagtatcacgtaatagaagattttcctgttccaaccagaagataggttgatcctgttaccataatattaggccaactatttcatgtggattttttatgtaaaggacttgctggagttcctaaagatcagagcatgtattaggttgg

SEQ ID NO: 118674 - DNA, 275 bp, Homo sapiens
acagaactcagatgtttgagaattgacaatcaagtcctcctggacctagaagcataagaattctgttagattagctcttgccacccctgtcagaacttaactgttcatagatttatgttattgacccactttcttcaagagcagaggcagtttttcaggcagtgctgacgccagaattggaaaagcagattctcatttaacaaacatgacctcagtaaaaacagccatgttgttggtctccatttgaaggcagaggtagggattgggagtatgtg

SEQ ID NO: 118675 - DNA, 552 bp, Homo sapiens
  misc_feature (28)..(28): n is a, c, g, or t
  misc_feature (94)..(94): n is a, c, g, or t
  misc_feature (153)..(154): n is a, c, g, or t
ctcgacggtgtctgcaaatagtagggancaataaatactcagtgaatgaccaggaatggtggctcacacttgcagttccaacactttgggaggncaaggtggaaggattgcttgagccaggagttcaagaccagcccgggcaacacagtgaannctcacctctaaaaaaataaaactagccaggcgtagtggtgtgcgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgctgagtgttaaggcctgaaatccaaggcttggagagcctggaattctgatgtccaagggtagaagaagaatgtgtcccagctccaggagagagacaaatttgcctttcctatgtttttattctatttagccccccagccagttggatggtgttcacccacattgagtgcaaatcttccccacttagtcactc

SEQ ID NO: 118676 - DNA, 456 bp, Homo sapiens
caacacccgacggggtggacaggaagagaggaaggaggaagagagggagggagaaagtaaagaaaaactttacccctagagatcaaaggttaaaacttagctcttccctggaattgtctgatcttgattcaagggcataggaagtgtatggctgctctcattttataccagaaaacagcagagtccctgattctttgctctaaaaccactataaaaggaaactggatctaaaatcctgtttcaccctgaattgagaatccatctgtgcactctgagcgctcttcctcaccccatccttcaccgaacagaaaaaggaggcgggcagtccagtgctttgcacatccctaccacaggaccacactactgctaaggtgtttaaaaaccaggatcctcatttttgctcattctcaaatggctgcttcttcagacatgacccaccccgtcgggtggagccca

SEQ ID NO: 118677 - DNA, 471 bp, Homo sapiens
tttgaggcactaagaagaatatagacatcacttttaaaacagctcctattagagcaacatgaattctgtgaaaactgaaggaagaacaaacatcaaatttatgatgaagcttgagtagaagaatagtaaaatcactgatactttacaaaaaaactgtatgaggacaatgacccaaagaaatcaacagtttacaaatgaataactcattttaaaaatggatgagatgatattgaagaagcagcccacagcagcagatcatccacatcaatctgcaagggaaaagttcatctggtttatgctcttatttattttccttttttaaaaattttttttcttttttttttctcagagattatggttctgatcatgccctagttgaagagaacagataataaacagcagaaaaaatagctgacaccatacatttcaacgggtccagcttatacatttctaacagaaaaattaaagtgg

SEQ ID NO: 118678 - DNA, 843 bp, Homo sapiens
cgagcctggatttccagcctctctattcaggtgagtgctggagaatggctgttcttaagtcaggttttatttttagttcccgctccagctctgtgtacgcaaatcgcagggtcaggaggcacaccctgggaggcacagtgcatgctcatgcttttggtaacatctgattcactcagccccagacccagcctaaacaggtcctgagggagattgttagatctgcctttgaattaaaacctccactgaggtgagaagctgtggtgtaacgtttgattaatttacctatgatttctgatccgtcgtgaagtaaatcagccttgatggaggaattgtactgatggaatattgaggaaatgccaggtctagttagagatttagagaccttcccccatccccaactctgcacgcaggtgccacacatttgtacacacttgggggcatcaagagaagggcacacagagggggcacatagagtgggtgggagcctcaggccccatccttgttgccgacggttttaccatcacattcatgactcactcttcaagtttaacacttgaatcttgaaaggcccttggaaaggatgtaagatggtttcattttgtaatagcttctctagtgaatagttttagagacaagttctggggtcttgaatctgaatactctaagagctaatgggttcatttggtaaaaatgtatgctgttgcttgagaaagagggcagagtttattaatcaattcttccttctccctcagaagacaaatgtggcagcagtcacacacactctcagaaacaccatcaaatttgtatcctactgactttgccacagtcacacttaaaatgaca

SEQ ID NO: 118679 - DNA, 609 bp, Homo sapiens
ttcacactgggtcgagtcagtggcacgatcttggtctctgcaactccatcttccaagctcaagcaatcctcccaaagtgctgggattactgctatgagccacatcactagacctaattctcacttacaaaatgagatacgtataacaaaaaaatgaagagaacatctctttaaatgaggtctcaacttatttcctatcatacacatatgcttagggagtaggttaaaaatcatttaagattctcaactcttgttttgaaaaacacttaattaaccttgttaaatatcaaactttacgaccataatcataaccttaagggaaagagcgtcttttcctttggcccatttgctcacggcaggcaatcttcttagtgctgagtgttttccttcagcctaaatgctaaaaattcaggacacagtcattaatagggatgacagcggtagcatttcatttatgaatattcatgaagtgaaatccatagcattaattacattaatttacatacctgaatacaagtgagccataagtgataactaagccttaaaaaaatgttgctaaccatatattgtatgttttcttttaaatgttatttaataagggtgaaggtga

SEQ ID NO: 118680 - DNA, 402 bp, Homo sapiens
aaccacaactgctacctagggattgttgatcatttttaaggatagtctgcaatctcaggacctctactgggtttaggttatctaaagctgggcctggaattgatttgataagacaggcctggagagaactgaattgccctaaataagagagtaaaataatttagaattttcttgcacattctgggaagtggagtggggaaagaagagcaagcaaatagtgagggacccaggtggaatggccatgtcagaatttttgaaaaggaaagaaatagaaaggtcttttaagaaaacattgagttgttgactgggcagtgctgggcagtaacctctcttgctcaccaccaagctttgtgctaagtgcaagagctgtaaataactgtgtagcaggaagaaggaagggga

SEQ ID NO: 118681 - DNA, 445 bp, Homo sapiens
ctacaattatatatctacaagccccaaatgaaaatcaacgaaaaatagtaagctcagaatggtgacaaagagcaaacttaaaatagctataaatcagcagtcagttggagtgtcccagtctcttgaaattcagttaaaatgagccattttatgcactgttgaagctcaaagcttacctcaattcgtttttaacttctaagaggtttatgttctcatcctcacatttgaccctgggctcttgtttttgtatatgctgtgtttctttccttactatatcattttacttgagtctgaagatcataggaaatattgaatatataggttttaaaatagaagtgtgcacagaaacataatttatgaatttactcatttttcatccatgcaaaaatcagataacagttataaaactgttaaataaaaaaggaaaacataatctctcttcaat

SEQ ID NO: 118682 - DNA, 142 bp, Homo sapiens
caccgtctgccagctgcactcctcaccaattctttcttggagaaacttcatggcagcactcatagccatagacctctccggctccagggcaggatgcctgtgttcaaatccctgctccacaacctcccagcagtgggcctcg

SEQ ID NO: 118683 - DNA, 571 bp, Homo sapiens
tatcggatgccacagcccgatccatctcctctcgggccagcttggcgataatgggccacataaggtccgtgagtatcttcagcgtgcttcttattcccaaacacccggctgcctaggaccttccggtagatgatgccatctttatggagaatatctgttccaaaggcctccataaaggtggcatcgataaacaccgggtttatcgaggccagtattgggtggaaatcattgttaattatgcccatggagaattttatcattgctcaaggagaggtgtgattttttaaaagtgcgtttgtgctttgtgcagaagtcttcagcgtgtgactggattcaatgctgctactcttttggtctgaatactgaaccagccaggcatcacaggagacacagctgagctcccaggccatcatgggtgacagggtcagagctgagctgctccctccctccaagtctgcttgaaagtagcctgcctaaggatagtatgcagacatatacatttttttcctttcaaatgtggaataatacttaaagaatcctccctggaggagatgatttttcaaacacaaag

SEQ ID NO: 118684 - DNA, 530 bp, Homo sapiens
ttatactttgctgtctaatatgtgtatggctaaaattttgcataatgacaggagaaaaacaaagacagagggatgaagaagaacaatcaaaggaggccaacaaagagtgccagtgaaacaggaagaaaaccagaagcatgctatcctggaaatcaagcgtcccgactgtctattgctgcataacacacccccaaaactctatggcttaaaaatataacaattatacacagtatagagattcctcaaaaaactaaaagtagaactgccatatgatccatttttaatttctttagaaacctccatactgttttctgtaatggctgtaccaaaagacatctgaattttatggataccttttagtcacagctcctttttggaatgtctcctttgtaaaatactttaaatagctgcaagaagatgggggagagggtgaaaagatgcatacaaattcttgtgtctctgacagagaataagcaaatagcagagattagtttttccttaatcttctttttttttttttctttgggaga

SEQ ID NO: 118685 - DNA, 330 bp, Homo sapiens
ttctcgcaggcctccctcccattctgaatggccccctctagcctgagccctgcccttttatgagatgcggtccagttccgtcccccgctctggccccgcccacaactctgctcctatcgcagctccacctcaggcccgaccccttccacacaaccctgcccccagcagcccctgacttggcctcggcccaggcttgaccgtctgactactcagcccaccctgactcctccccaaaaggagaccaaagctgaattcgggtccacggccgcccatccctccacccaaaattttcaccaagactcggtgcccgacccctttccaccctctccc

SEQ ID NO: 118686 - DNA, 765 bp, Homo sapiens
aactcaggggatgggtccctccccaaatgaaggctggcttaaacagcacccccaggccactctccaattcagtccaagtcgccactaaggaattttccttcccctcacagctaatccgaagagctgaccgtctgctgttgacaggccagcttgagtgaggtatgatccgcgcacgtgaacagtttgacaagagcagtgtcatgagctttgctgcgtgtacacctgtgcggcgatcacatccattacgccaaagggtatttctagcaccccataagaccccaatcatatcccagcacgagactccagggatcactgacctgctttctatcactgttgctcagttttacctttttaaaaagttcaaatcaatgggatggtatagtaagtataaactcagtaagtctggcttccttcactcagcaagagagaccctttcatgtttccaagcaccgccgctgccgcgcattacactgcgtggagacgccacggtccacgtatcccttcacctgctgacaggcacctgagttgttcctgctctcagactgttagaataaggctctacaaacattcctgtacaagtcttcatgagaccacattttctcttgggtttctcttagattaaataccgaggaatggaactgcagggtcacaccgtaagtgtgtacaaagctaccaaaccatttccaaagtggccgtaccacttgctactcccaggggcaacaggcctggctgctctgcatctctgccagcagtcaggatggtcag

SEQ ID NO: 118687 - DNA, 278 bp, Homo sapiens
atggtgaagaatgctgctgggaacatgagtgtgcaaattggtccttgaacacctgttttcccttcttctgggtatagatctccacagaggggatctgataggccacggtatccttttcattttgtttaacaagcacatacgtagctcttgttgggtgccaatttaatattcataacctcactaagagggaggtactgttacctccgttttacagatgagcaaactgaggctatgtgggtttaacaggcaggatttgaaccaggcagccagatgctgct

SEQ ID NO: 118688 - DNA, 483 bp, Homo sapiens
agaagcactgagtcgtgtctctgggaaatttgagtctcggggaaggcaggtgcttccttggtaggataattggaaagggggctctcgggacagcatgaccatctctagaatcatacaagcactagtggccccaaaactctcactccctggactaagctgtcagtcccttggggaagaactgtggcacataaatagtgcattaggggactgaggcatgagtcacagcttcttagaatggggaaggcccttggagatcaacaagctcaactactctttattttaaggatgagtcgaaaaatagggcccagagaggtgggagaactagtctaaggccacatagcaaattactgtataattactgttaattcaagtagtacacagcttggcgccccctaaaaagtgggacttccaatataaattcattcttacctcattgaaatacatgatatatgcaaaatggagttctttctccaaatattagtt

SEQ ID NO: 118689 - DNA, 339 bp, Homo sapiens
agaagcactgagtcgtgtctctgggaaatttgagtctcggggaaggcaggtgcttccttggtaggataattggaaagggggctctcgggacagcatgaccatctctagaatcatacaagcactagtggccccaaaactctcactccctggactaagctgtcagtcccttggggaagaactgtggcacataaatagtgcattaggggactgaggcatgagtcacagcttcttagaatggggaaggcccttggagatcaacaagctcaactactctttattttaaggatgccacagtgttcgcctgatccacagtcgcctgatccacagtcttcgccttat

SEQ ID NO: 118690 - DNA, 474 bp, Homo sapiens
tgaaccttgtcttccataattagttattattgagtacttactgtgtacagagactatgcgtggccttcatatatagtattcccatttagtcctccttgatgtcctgtgagttaagtttttaatccttattttatcaataacatacctggagcttggagtggtgaagtaacttggcccagctctcacaagggtgagtactagattcaagatttgcactgaggttgatccaactttagagccatgcccttaacttttctactcttctgccacgtaaaggaactttatcctttaagacagggcagaacattgtttttaattttttttctaaattaacaaaatttcaatattagaatttgctgggcacagtggcccacacctataatcccaacaactcaggaggataaggtgggaggatcacttaaggccaggagttcaagaccagcctaggtaatgtagcaaagatcccttctctac

SEQ ID NO: 118691 - DNA, 305 bp, Homo sapiens
gtggccaggtgtgtattactccaggctgaatagcacaggctctgcagtgtgtatgctgcaacctgtcctggaagcagaaggaggctaggcccagtggtgagaacaggcccagtggtgagagaacagcccctgtgagggagtttcctaaaggaaaagtgggatttccctacatgatagtttgtcataagggatggaagtgaggctccttcagtaaaatctgttatccatgacagcctgtggcaatggcgctttgggaaactgaggcttgtgtacagaaactcctctctatgttctttccgtggaag

SEQ ID NO: 118692 - DNA, 393 bp, Homo sapiens
tagtaacaacaggggcaaaataataattttgtagccagtattacatacttacctcaaattcacagtaaagcgttagagataaagtaattcccagttaccaccacatttcatatttgtgagtagtagaactagataaggaggaaataacattaaatgatgaaatcacaatattttggcaaaccttaaagcatttttttcatttaaaatgcttctttcttctgcttatagaattaatacaagctcattgtaagaaatttagaaaatatagacaaatgaggattgggatgaattattcatgtatacttctcagtaaggtaggaacagcaatttggcaattgaaaattggaacaatgccaccatgaagtgacttttgaatgttatgatacacacaca

SEQ ID NO: 118693 - DNA, 714 bp, Homo sapiens
attgaataaattcattcttcccccactgaattttaatgtcatctatttctcagttttctatgctgttccactggtcaacccctgtgccaatactaccctgtcttaaattactaaagctttaaaataagtcttgaagtcagctaggtcagtcctatccacctaatcagtttctggaaggtatataaagtcatgcagccactctggaaactaacttagcattaccaagttgaacatgtcattacctaattatatgccttgcctcctagttgtacaccttagattagtgtttctcaagctgtgagtcttcatctacagggtcatgagtttcaaccagaaactttcttttttaatgagatagaattcaataatattttaagacgacatctcagacaagaagagagactgttattccatgcaccttttgttttggatctatcacattatgtaagtatgtgtgtacaggatcccatgtgaaaaatatttatttcttgctatcttgcctctgagtagagaaagataacagacattaagaacacagaccagaaaggaaagattgggattttgctttgaaagctattgcttaaagttatttccacaaatgtacaagaatatgtaagaatgtatatttatcattgtaatagtgaaaaattggaaatgtcaatatcctctgtaaaaggaatgcagacaacagaatactatataacactgaaaatg

SEQ ID NO: 118694 - DNA, 452 bp, Homo sapiens
gttcacagaaacaactggaaacaaacttagcttcctttcaaagccattaaaatacggccttaaatttttatgcattaatcaattaagtataattgtctcccaataagtataattgtctcccaacctagaaaacccagaatgattcagagagacaaagaactctaaggatatgtctctgcaaactgttcgtttcaccaaaggattcactgcagaattaattttctgtaaaatctgtacctcctataattttcaacatgttctatctttaaagataacatttacacaagtgttgatagcatatgtggaattcacgtgttacttgtgtaaatcattataaatatgtaatagaattaaatgttttaatcacttaagaatatcttcgaatgttcctgagtctccgagatcataggcagattatgcagtcttcatctgtgattttgtttagtcaccta

SEQ ID NO: 118695 - DNA, 527 bp, Homo sapiens
agcaatcatgtgaaagtgggaaacattgatataagaatttatgaatgagaaaacaggaatagaaacagagacggtgtcatgaaattcaaacagatgccaaaatacagctcttggcagaaaaaggtttggattcgtggtcctagtaagagtcctctttttttcctggatgaaggctggaggtatagcataagggaagtaatgagaatagtttctttgtctctatacctaaccttttcatactatcaacaaaatacttgggcaatgagtggcatgggttacactaaaaagaaagttctcagggctttctgcttcccttctacattcagagatcttagttgggctggtagcacatgagttctgctgaacctcattactaggtttgtatagtacaagcatggctgaccttctttattgtttaatttaatttttaattttcatttacttattttttagagatgaggtgttgttctgtcatccaggctggaagtgaagtggtacaatcatggctcactgcagcctcgacttcc

SEQ ID NO: 118696 - DNA, 614 bp, Homo sapiens
tggggggaatagaaaccttaaaagggcaacacaaagttttgaatagaagaggccaagcagcctcgcccagaagctgatgtttgtgaatgtactgggccttctaaagcggcgcttcacacaccttttcacttcttggcacaggtaggaaaggatgatattacaagggtcaaaatgggggtaaacagaagaggctgctcctgcagaaggcttcctgcagaagcccttgcacttggagggctgggaagacccatgctgtatctgcatccctgtcattcgtttcacggcatccagttgggaagctctgcttaaagctttgtctggcacgttttcttagctacatttttccactccagctgagactgcctcactgagttgtcaacacttggtcttcttcagcagtgaggaaccaacaagacaggaggctgggtcaatactcaacttggcaaactccaggaaatggtgcttaaaacgtttggcttcttgaatggaattcatggtactgctcccagcctgcacctgggttctccaacttgagacaatttctccccgcatccccccacccttccctggctttcactcactagcaagtgggctgcttctactttctttctcac

SEQ ID NO: 118697 - DNA, 427 bp, Homo sapiens
attgccaatgtgttcacctcagaaacactggaagccagataccagggaatattgttaaaatgataatcaggaacaaaaagagatcaaccgggaatgctgaatccagcaataaaatgccttgaaggtcatccatgtcggataaatgcatattgtgcactgccccaaagaaagaaaccggaaactgtaagaattggaaatcagcaggcttatgtaacaagagaggtgacccgaaggaattaggtagaagaagaattgaacaagaaaggaactttctgcagcccacgtaatgaagaatccagcaattggcaaatgtagatagatgtaaatgcaaaatattttcttgatcaaatttctatatctttgtaaatgagagttgactacttgaaacaaaatgatagcaagatatttaacttcagcatatgtagag

SEQ ID NO: 118698 - DNA, 466 bp, Homo sapiens
tgtaggaagtggggcctagtaggaggtgattggctcatgggggtggtttctaatggcttagcactatccccctagcgctgtctcctgacagagttctcacaagatctggttgtttgacagtgtgtgacacctgcccctttgtgtgcgcgctctctctcctctcttttttttctctctctctcctgctggctatgtaaagatgtgcgtacttccccttcaccttttgccatgattctaagttttctgaggccaccccagaagcagaagactgtatagcctgcagaaccgtgagccgattaaacctctcttcttaataaattacccactctcaaatacgtctttatagcaatatagcaatgtaacaacaaactaatacaggtacagaagtaaattatttattggcctgttatagacttagtaaatttgctttctgtgactaaaataagaagtgagctggctaggcacg

SEQ ID NO: 118699 - DNA, 320 bp, Homo sapiens
gcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgct

SEQ ID NO: 118700 - DNA, 319 bp, Homo sapiens
tttatatcagtaccgattacacgaaagtaaaatgtatttaaaatatctggttaaatccacatttagtatcatcattattttgactacgttttgctgactgttgagccagtgtagaacactaaaattgcgcttttattggacaactttttttattttccttgagttcaaaatggcctcgtggtttcattagcttagtttatttcagatgtttgcttgagttccacggtctccaccaactctgctctccaccaactctgcggaagccttcaacaacactctccagagttaaatgttagattacattcgtcagtttcagttt

SEQ ID NO: 118701 - DNA, 657 bp, Homo sapiens
ctaagtcgcgcgttcgacagctccctcctttacacacccgcgtgcaaatgagccgctgctctgtcatgaagtgagaatgtgagcctctttcaaaccctagaaaaggaaagtttggtaaggcgggggctgcgcagatctgctgttctctggaacctaaactgggaaccctagacttgcgcagaaaattaatagttttccatttttctttaaaaaaattaacttcaacgaaaaattgtgtgtattcaaaaaaattattggattaccatgtctgatcagctgctgatgacctaccaataagcgttttaaacacacatgcacattcacgcgtgcgcgcgcgcgcgtacacacacacacgcgcgcatacacacacacacacacacacacacacacacaccccaggggctatgtgcagtgaggaaggccgtcataagtaactaagaattcagagggagtcgcaagggcttttaagtgtgtaaaggctgtgtacgtgtcctccttgttacagagagcagagggagggggcagagggaatgagcgtcggctcggcgttttcgctgtgcctgtgtgtttcgcgtgttgtcagctggctctggtttctaagggctgagcgctgccatccattacacctgcggcagatggctcaagtggtagaatggt

SEQ ID NO: 118702 - DNA, 781 bp, Homo sapiens
ctaagtcgcgcgttcgacagctccctcctttacacacccgcgtgcaaatgagccgctgctctgtcatgaagtgagaatgtgagcctctttcaaaccctagaaaaggaaagtttggtaaggcgggggctgcgcagatctgctgttctctggaacctaaactgggaaccctagacttgcgcagaaaattaatagttttccatttttctttaaaaaaattaacttcaacgaaaaattgtgtgtattcaaaaaaattattggattaccatgtctgatcagctgctgatgacctaccaataagcgttttaaacacacatgcacattcacgcgtgcgcgcgcgcgcgtacacacacacacgcgcgcatacacacacacacacacacacacacacacacaccccaggggctatgtgcagtgaggaaggccgtcataagtaactaagaattcagagggagtcgcaagggcttttaagtgtgtaaaggctgtgtacgtgtcctccttgttacagagagcagagggagggggcagagggaatgagcgtcggctcggcgttttcgctgtgcctgtgtgtttcgcgtgttgtcagctggctctggtttctaagggctgagcgctgccaggggcgggggccagcatccaccatccacctcggcaccctagtggtgaaacaggactcatttgtttggtgcagagcggtgacgacctagaagagactggagtgtggttaggtcggccccctgccatccattacacctgcggcagatggctcaagtggtagaatggt

SEQ ID NO: 118703 - DNA, 303 bp, Homo sapiens
cgcgcctgtagtcccagctcctcaggaaactgaggcaggaaaattgcttgaacctgggaggcggaggttgcagtgagccgagatcgggccactgttctccagcttgggcaacagagcaagacggcgtctcaaaaaaaacaaaacaaaaacaacaacaaaaaaacatagttcccaaagcagctgctggcacatctgaggaatgtagctgtctaccctagcaaatctgccttcctaataattaaacaatccaagaggtggggggatgggggaaggacagcattaggagaaatacctaatgtgaat

SEQ ID NO: 118704 - DNA, 810 bp, Homo sapiens
agggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagaatccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctg

SEQ ID NO: 118705 - DNA, 434 bp, Homo sapiens
tttgtgtcttctaagttcccctgttgtccttgctctgctctgatgtagctgagaccacaggcgcgcaccaccacgcctggctgatttttgtatttttagtagagatggggtttcaccatgttggccaggctggtcatgaactcttgacctcaagtgatccgcccatctcagccccccaaagtgctgggattacagacctgagccaccacccccggctgaatgttctgtttttaatacatcagagatacatgttttgaattcttcattagagtcagaatgatttgacattttcagtgctactgatttcagagcatacaaaatgcagttttatgtatttatctttttaatttagaagaagtttaatatttaaaagaaaatttcctggaaaaaacggctcattcgattctcttatttaacaaacactgcacttactg

SEQ ID NO: 118706 - DNA, 319 bp, Homo sapiens
acatagagtctcgctgtgttgcccaggctggagtgcagtggtgcaatcatagctgagtgcagtggtgcaattgtggctcactgcagccttgacctccctcagctcaggttatcctcccatgtcagctgcctgagtaactgggactgcagacacgtaacactgcatctacctcctttaaaacattttttgtagtgatgagttctcactatattacccaggctggtctcaaactcctgagcttgagcaatcctcccaccttagcctccataagtgttaggattacaagtgtgagctgccacatgggctacggcagtttcat

SEQ ID NO: 118707 - DNA, 284 bp, Homo sapiens
aattttctgtattcctactaatcttttttggggtctgctttctatatcaaatactaaggcagatatattacaatctcctgctatactggaaaaacttttcaattttttccttgtacatctgttaattttttgctttattttgtggctatggttattaattgcatgtaactttaaaacatatatattcctgccaaattagccatttcccattatgtatcaattctttttgtctttaagtctatttgaaattatatactagctttctttccattaatattagtcag

SEQ ID NO: 118708 - DNA, 640 bp, Homo sapiens
aggaatatttgtgacatgcagaagaatgaagagtgggatccttgtaggaaaccacagacatctgctcatcctgaaactctgaggctattgtctgaactcaaaggcaatattttttaaagtcacaattactcaagagtttttagaacagaggtcacctgctttcagactgcacctaattcataataacattttaaaaacatttgtataattatttacaaataaaattactcatcaattccccttctttcccctactcccaactataagccaagttcaacattttattctcctttctttcctcaatacatgcatagacagtgcagaagcataagaatgggcataatgtatgtaccatcggacaagtgctaccttgagccttaatacctattagtgttttcattgtcttaaaattataagatagagtctatgactgattccattctgcagataagaaaagtggcacgacatgcagctgaatactggcagaactaagatacaaaccctggcaactcactacaaattctttggttttaatacttttaaaatactttcttgaaagaaattaataaattggttatttcataattacatcaatgaatgactgaatcaactaatgaatgaaaaataaaaagacaaaaaa

SEQ ID NO: 118709 - DNA, 894 bp, Homo sapiens
ctcattaccaaggcctaaagcctcaaaagttcttcagacgcatgggataatcaacggtggaaacccgtgattttttggcaaaaaggcctttccagttaatggttaaccagtcagggttttacccacagttttgaccttaagtgcagtgactctcttatttccaccgctcaggtctgggagaatgtctgcagcttttcacgatgtctgtccttcacagcgtctccaaccctctccccaagttggctccagggcttgggagaaataaagtgctctccctcagactgggttgctcagatccccagtggaaagaatttgccacagcaacccaaaccttcagcagacaacactctgataagtgagcagccatcaacatcaaagcaagacactctaccaacaaagagattacaacccactgaaggcccagatgatccttagtatttttttaccaataaaaaatttttcaattaaggcaaaacttacgtgcagctacgtttggaaaacaagagtcctcatcaaccaacctcgcagccagttaagtaaagatgatagggcccaaaggcaaaggaaagaaccattttttacatctttatgagataaaacaaagccaaatacgacatcattacacatccaccagattgccaaaagtttagtgtcacaataccaaatgcagactacaatgtagagcaatgggatttctcatacgtggtcaacaagtgctttagaaaaaaattcagtattttcttacaggattgaaaatagtcctacccatgacagagcactccaatacccatgtgtctaacatggggactaggagaggcatgtacaagaatgttcaatacaatgttgttcataatagccaaatgccaaggaaaaataaaacctttaacagcaaaa

SEQ ID NO: 118710 - DNA, 1420 bp, Homo sapiens
ctcattaccaaggcctaaagcctcaaaagttcttcagacgcatgggataatcaacggtggaaacccgtgattttttggcaaaaaggcctttccagttaatggttaaccagtcagggttttacccacagttttgaccttaagtgcagtgactctcttatttccaccgctcaggtctgggagaatgtctgcagcttttcacgatgtctgtccttcacagcgtctccaaccctctccccaagttggctccagggcttgggagaaataaagtgctctccctcagactgggttgctcagatccccagtggaaagaatttgccacagcaacccaaaccttcagcagacaacactctgataagtgagcagccatcaacatcaaagcaagacactctaccaacaaagagattacaacccactgaaggcccagatgatccttagtatttttttaccaataaaaaatttttcaattaagatagctcctaatttaattattataacaaaaatttactgagcatctactatgggcaaacatgggaaatctaaacatgcatgagtcccagtcctagctcaggatgactttagaacctaatggaaaacataaacatatacagaaggaacgtcaacccaacatcagagtctttttaatggttatatagaacatccttcaagacaccacagaagagcacgcctgaaggggtgcctgccacaaaggatgtgaggggtaagcagggcgggcagcatttcccaatcccgctgatctccacaaccataggagggggcagcttcccttcccccattccatatcagtctattcatacattacaagacaaagtatgattccttccaagaaagagtatgtcaaggaccacacacatacaggattttacagaatctttgaaatcatctcttttcaacattgtcatcgttcagataaagaaaatgagatcaggcctcacactggacactgaatcaaagtctttggggagataggcccaaaaatatgtataaaaaataaaatggaaacacaggttcttatgatcctcaaggtgtgagaagcactctgttggacaataagggaaagggcattgtaaggaagaaaacaacatgaaggaagcacttggacatgaaagcgcaaacgcaccgcgtggccagggatcatgggagatgaggctggaagcagggtggttcagaagtgagggctttgtatgccacaccacggcgtttgagcccatagtgatgacaaaaccatggaagatttttaaaacaaggaagtgatgagattgaccctccacctctacatatccagaactcttggatacccatgagaaactatgaaccactcaatagaaaactgggcaaaaggaatgaacaatttacaaatatcaatgtccaataaaatctgaaaaatattctctctcaacca

SEQ ID NO: 118711 - DNA, 450 bp, Homo sapiens
tgtggtggctcatgcctataatcccagcactttgggaggctgaggcgggtggatcacctgaggtcaggagttcgagaccagcctggccaacatggtgaaaccccgactctactaaaaatacaaaaattagctgggcttggtgtaatcccagctgtaatcccagctactcaggaggctgaagcagaagaattgcttgaacccgggaggcggaagttgaagtgagccgagatcgtgccagtgcactccagcctgagtgacaagggcaaaactctgtctcaaaaaaaataaataaataaaaataaaaataaataaattgtggtaattgtgtaaccacactaattggtcaatagctggattgtgatagtggttacacaattgcatgcatgtgtcaaaattcacagaactgtgtaccataaacagaatttactgcatgaaaaccatatatatttt

SEQ ID NO: 118712 - DNA, 430 bp, Homo sapiens
tatacccaaaatattctcattatcctcaacattaattctgtacccattaaacaatagctctgcttttctctgccccatcagcccctgataacctctattctactttgtctttgaatttgtctatcctaggtagctcataagtgaaatcatgcaatatttgtcctgtgtctgacttattatactaagcatgttttcaaagtttacccacgtcatagcatgtgtcagaatttccttcctttgtatgtatatactacatattgtttatgcactcatctgtcaacaggcgcttggttggctattatgaatgctgttataaaggtactgtacaaacatctgtttcaaaccctgtttttgattcttttagatatatgcctaagagaggactgctgggtctatatggtagtcctatgtgtaacctttcgagaaactg

SEQ ID NO: 118713 - DNA, 561 bp, Homo sapiens
cttttggcaatccaatgcttagcatacatactgcttcctctgggagatacttcccagccagagctagctctgggagggatggaaccaccccagactagttttcagaactgggatactaagtgctagggggcttactatggcaaacagtgttaactatgctggttcagtccaggtttggacagcatccatgaggtaagtcaaattcccagcattccagccccatcaaatggttcccaggaatgacagcccaatgctgccctcttctgtgctgctgaaaagatctgaatggtcaaatacctgatttagcctagcaaaaaggaatactttttcatttgttctggaagagaatacacttgttccttagtatccacagggattggttccaggacccctgcagatagcaaaatctgcagatgctcaagtcccagatataaaatggtgcagtatttgcatataagctacacatattctcccatatactttaaatcacctctagataacttataatacctaatataatgtaaatgctatgtaagtaattgttatactatattgcttctt

SEQ ID NO: 118714 - DNA, 442 bp, Homo sapiens
  misc_feature (333)..(333): n is a, c, g, or t
tatgggtgcatgcatgtgatgctccctgtactgcatcggcattgcaggagggaggggatgtgtgcattgaagttgcaacacctccagctgtgtgtagctggagagcaccccaatgagaggaggagggtgcaacttggagaaagaatgcggttgaggcggggttgcggtggaagcaagaaggtacccgatgagccaagagagttaggaatgcaaatagcccttccctcctctgatttatggtctctctctttttaaactttctatgttctcagtagaaagcaactaaatgtaaacagcaaagggcttgatgattcttaagggagaaaagtctgnctggtgcatgcatgtgctttctcatgcaattatgtgaaaagaactagggagaaggtttaagaactaaaagctgagcagattaaatgagttttgccccaaattttggcta

SEQ ID NO: 118715 - DNA, 438 bp, Homo sapiens
agttttgacaacaaagagcagttgtcaacagcagttttgaatgtttgcatattctagttgtcttctctgtcactttagctgtatgttaaaagaaaaggcaagaagaatgttttccagcagctgtggcagagtctatggcatataaacaattcaccagcattcgacatccacagcagacatcattaatcaattagaatgttctttcccactaaaacccacatggagtttcttaatcctttttaatgccaaactacagaagctacaccatttaattagagttgatatgtaagatataacctattctccatgctggacttaggaaaatgttctacaagaaaccagaaatctagttatcataccaagaaacgcaagtgtaaccttataaaggtatcactcatgaggactagctttggaatgttattgcaatcaaagaactac

SEQ ID NO: 118716 - DNA, 621 bp, Homo sapiens
caggcgtgtcccaccacgtccagctaatttttatatttttagtagagatgggatttcaccatgttggccaggatgggctcaatcttttgacctcgtgatccacccatctcggcctcccgaagtgctgggattacaggcatgagccatcgcgtccggcctaaataaatatttctaaaacatattcgtttctaacttttaactcagtaaatatgcttatatataacccataactgcaaaacctctttggaatcctcaaaaacaatgtctgtaaaaggatgccaataaaaccacctctgcaaaaattacaacagtgagagaaatataatataactgacttcatcttgcttctaacctcacaagctaactgcccttgctcattcctgggcataggccaagctaagtatgggacgaattttgtttatagtttaaccttaaagcaagggttagcctggcgcagtggctcatgcctgtaatctaagtactttgggaggctgaggctagaggatcacttgaagccaggggtttgagaccagcctgggaaacagagtgagaccctgtttctacaaaaaaataaaataaaaaaaaaagagagcgagagagagaaaagaaagaaaagaaaag

SEQ ID NO: 118717 - DNA, 276 bp, Homo sapiens
caaaactctgtctcaaaaacaataaattatgaaaaagtaaaaattgatgatttagaagacagcaatttatcccttactcttcaccctgacggtcagccatcgtcgccttccccctaccctcttgtgtttgttaggaagcattaatcctgtgtggccctcggctgaggggtttagtagctgtggaggcagatgtgtgtgtggcctggctggtttctgccattgcttccagctgtgtctggaggatgacagcagagacctccacagggaccccagctg

SEQ ID NO: 118718 - DNA, 429 bp, Homo sapiens
aaggcaagtgaggaacagaaaacgaacttctgtggtggtccagggccaatagattgggttctaggaaggcagcggtgggcagcagtggaagtttgaaggacctgcagactgattagtttctggccaaaatttaggagccattgttgacaggtatggaacgaaacatcctggaccctaagacctaaacaagtgatccttatctaggattggcaccaaggcattgtgtggagctggacggttcctaacacctgttattttataaaataaatattaggaaacccctattcattttgaatgtgttaatgaaagtgaactgctaatcacagttagcacttgtatcttttctactaaatgtgtgaaatgtgccttttagggaaatataatacacattttcattcttgtttaccttcttcatacgtagctggttta

SEQ ID NO: 118719 - DNA, 434 bp, Homo sapiens
tgtccatctggtaaggaaccacttcaataaggtgaaactgaaggtggcaaaaaaagtcgaagcactcagcatttagaccaggattctacgatgccaataaagtgaaacacagtgtttattttagtcgtttaaattgaagaatgccttttcatagtctctccaacatgaccctgttagactatttcactcatttgctttccatacctgccatttcttcctcccagtaaaacataaaaacccccaacttagagatgcaacactgaatctcagataaaacctgtaagttaaatgatttccctctatgagctttgggaaagttaagacaaaagaatcaaaattaataccaaatgcatatagcaggagttcgaccactcccagtgtaggggagaatgaaggagagttgtaaggaaattcatttgcatctacccgctaca

SEQ ID NO: 118720 - DNA, 573 bp, Homo sapiens
agactccattctcaggtattatatacaaggtaaaatgggcattcagaatattttagtagtgtagaaggtagaagattattccttttaagaaattaagtctagtcattatggagtagagtcagaaaattcaggaaggccttagatgctaattcctctaatgaagctatggttttaagagaaagggaaagtaccaaggaaaagaacaaaagcagaatatccttaaggagctgaagaatgaacaatcaacctggttggaagtctggtgattgttgtgcccaattgagcaaatccttctataagtttatattcttttaaaagatctgtttcacagaaaagttggcaagcaaatcaggaaaccacgaatgagcgatataagcagtactgtgggtttggagattagctgattcagaaaggatgaaaacaggacgccagagcttatataaccacaactcttcatcttctgtgtgtctatggcagcttacagtgaatcctgttcctgaggcagacaggcaaagagaaataattttaacttttcctttggtcttctggaaacctagaagccactgccttgtt

SEQ ID NO: 118721 - DNA, 793 bp, Homo sapiens
ctgataagtggcatttggaaaaatggggacagggtgtttgaggtataatggtttcctggacctggtacttgctaagggcttggatttccagggtaagaaattaacattgtaactggttcgataaaggaggttaggtaaatacaaaatattgagatcccctgtttgcttcttctgaggaattctcagagcacaggttgcaaggtgcgtattttccaggcaagaaattggaagtctttcggggtaatctaatcatttagggagaaaaagcttataaaaactgctgccaggtttttccaaggaaacaaactccctggccatgtcaccctagaggaaaatatcataatccgtaaagcccgatcggtggagctttcaatggctttttaaataagagcagatatccaaggatcccaggatatttaaagaagacatctaatgtgcacatgagggaccagaactaatatgcaggaaagaaggcaatgtgactatgaaaggaaatgaaaattaaaatgcaaaaacaaacaaggaaaatacttacagctgttagctaatattctcaaagggaatagagaaaattttacatccatgaaataaggtattattttaaaagaaacatataaagaacaaaaaataactctatgatagtagaaaaaaaagcccactagaaaaaaaatgaaagataaagttcaataaataccccagtagagcaaaatgacagacattgaaaatatggaaaattaggagactcatccagtaggttcatttccaaaatagtaaacatactagaaaagagaaa

SEQ ID NO: 118722 - DNA, 493 bp, Homo sapiens
cgagccctgacccaccggcggctgcggcggagccgcgccggcgccccccatgcgccagacggcaggacggcggcgtcggggggcgccatggcctcggcggcggcgggcgaagcggaggaaaccacccggttgcgcaagccgcgcttctcattcgaagagaaccagatcctgatccgcgaggtgcgcgcccactacccgcagctctacggcgcgcagagccgtcgggtgagcgtggcagagcggcggcgcgtgtgggacggcatcgccgccaagatcaacggtatcaccagctggaagcgcacgggccaggaggtgcagaagcgctggaacgacttcaagcgccgcaccaaggagaagctcgctcgcgtgccgcactccacgcagggcgccgggcccgccgcggaggacgctttctccgcggaagaggagaccatttttgccatcctggggccaggtgtggcggcgccgggggcaggtgctggggcggaggagc

SEQ ID NO: 118723 - DNA, 691 bp, Homo sapiens
gtaatacccagagtttgggtggaggctgctcctcggctagggccccaactaaaaccaaatagctagacaaggagtctaccttgttttaaccaagtagtctgctctgcaatacttgctgtgttttatctgtgtgcaagcaagaagcgccatcaactgcacagaatcttctctgttgagttagtaggtaatctcgcatcccatgactgggttaaattaaagcggggagtgcaggttatctgcagaggctactactgatggtgaaattttcactgcaacgttgtcctgccacgtgagaggcataagtaaggaaagattaaggagagtaagagtctcacatttatgagggggagtcttgctccaatgtggtttgctgttgtgaatgtctctggttgtggcattggccatcctagtgaactctgtgtggcccatgcattaggcatgagacttattccttgcgatttgcgtagatttgtccagcttcagcttatagggcttcaggaactaagcaggttcctgctatctaacaggtagataataaaaactcagtgaacagtgctgcaatctaaataacaggcatactggagttttcttttgaaatgtaattttcctctctaagtcactcccatttctaccaaagataatcacagtaagaccagtttgcctgactaaccacatatttgaaagcacatat

SEQ ID NO: 118724 - DNA, 796 bp, Homo sapiens
ttttaatagtaaaatattataataccgttacatttaactcataagattagttagataaattgaggtatgttttccatgaaactcaatatgtagtaatattaggattatagttttaacaattactggcatatcaccaggaacttttaagtgcagagaaagctaaaaatcacacagccagtggccaagtggcttacagtttacagcctagcatgtaagccgttatatcacggagtaataagagcagcgattcagttaagcttgtgatactatgacattttgattaaaaccagaataggttcaattctgtttccatagtttctagctctgtgaccttaagaaagttacttactcttatccaacctcagttttcccattgtaaaaataaggataaagcatacttactaaatacctgaaaattaaaatagtataatactaagtctgcaatacttggaaaatgcttaataaatgaattcttattattactgttcttaatgatataacaagagagcaaggagaaaggaggaacaggaaaaaataagtcaccacctaagaaatgactgttgacattctttctgccttgtcttctttccaacttgtgtgtgtgtgtgtgtgtgtgtgtgtgcgcgcgtgcatgcgcgcgtgcgcatatacccatatactctcacatagctatgcctgggcttcatttaagaagaaacactgaggccaggcaaagtggctcatgcctgtaatcccagcactttgggaggctgaggtgggtggatcacctgaggccaggagttcgagaccagcctga

SEQ ID NO: 118725 - DNA, 837 bp, Homo sapiens
gaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggcctcgtatgtacagaccgagatcttcacggaacatacggaattccttctagcgagcaagacacgacacagatattaaactcattttcaggcaccagacaccaactcaatggggtattcaagagaagcagaacccgacaggcctggctcccagggagcaaacacttccgccacaaggacatcgtcgagttcctggcagctacgcagttaaacttacctagacacactggtgacctaatctgggactgctagggcatattggggccaggatgtcatggtgaacagtacaccccccgggacaccactactacattaaaatccaggaaagaaagtaactgccgcttatggtgcgcgtgatggggacatatcgtcccccacatgtgagacagcctgggtcaccctgttacgttggttccaccggaaggcgaaagctaatacagcagcgccactctggaattcccgaagagccatcaccaggaaatgttgacagacgctgtggcaacacggg

SEQ ID NO: 118726 - DNA, 476 bp, Homo sapiens
ataatgctgtgcccacactcaagactaatggcaaagtgtgttttagttaagttactcggaaagagtttatatagaatgacaacatcacatagtttaaataagggatgggattgtaagctttcagaagtggttttatttggtcccccttcctttattttgtcacaaatgctgggggcacatatggagatggccaccagcctgattaagcctgccagcagagtcttagagacagacattcccaggagcctcccaaatctcaggctcacaaagtccaagtaagattgggtgcctgggacttgagtggctttgtctaaggatctttcttctttgacctgggtgcgcatgtcttcacaacctcaactgctatgctactgaacaccattgcacatgcatactgtgaatcgaccctaccacaaacctgtgacctacatttgaacatactttgttacggggaatagcaaaagtcagtggcttcg

SEQ ID NO: 118727 - DNA, 722 bp, Homo sapiens
ggcacaacctacgtgtgttgtccaaccttagccacgacagcctaaagacaatctcagtctcttttcccctccccaggccatatctctctcttattttttaagtgctaatgccaaagaagattttactttatccttgcttggctgatatgcccattcctgcaccaacagcaattgccaagatcaggtatcacgattgattgctacacaaggatcatgtagagaggaggaaaattacaaaaaagcaccaataaaaggcagatggaaagtatgctggaaaaacaaattataaatgacattgcctttgctatatagacggtgaattaacttgcttagctagtaagttgtggaggactgtttccagtctgggtctgcctgactttagaccttaagtgttctaatgtaggtactcttcattcattacttctgttattatttttataatatttattttacactaaatatatgttaaagctcaggcatccattacaaagaacctaaatatctctttggtctgtttctactgaaacctactttcctgatttagaagctagaagttaccatggatgatttctgttctattttcccccacagactagtttctttatggttatataggaatagtctatatataatatttataagatagtttgacacaatttaggatccaagtactatttagatcttaacacactaaaatatacatttcttcgtgaagcttccag

SEQ ID NO: 118728 - DNA, 520 bp, Homo sapiens
gaattgatgtagtgaaaatatgccataatagtatctcaccatcacctctgtgtatttactcattcttttcacatttgagaatattatttagtaatagtatgctgtagtactaatagtgaaagaacaataaaaaattaattttttttttacaaataaatatttgacaaaagctacaaaacgaaatgagaccatataggaatgtataaagaaaattcatcccaatagatttcttgggagctgtagagctatggccaacagtcatttcaaagtgtagcttgaaatctctattgtgctactgaagattatcaggattttttgtagcttcttcacttttttttttagacggagtctcgctctatggcccaagctggagtgcagtgacgccatctcagctcactgcaacctctgtctcttgggttcaagcaattctcctgcctcagcctccccagtagctaggattacaagcatgtgccaccacgcctggctaaaatttgtatttttagtacagacgggatttcac

SEQ ID NO: 118729 - DNA, 349 bp, Homo sapiens
cgggcgaggctggctcggagggtcctgtgctggagagccgcgcttttcccgggcccgggaaaggaggccagactcgcttgcaggaatgaggcactgtcggctgcggagccacgcggggcccgggctggggactcaggaggaagccgagggtcagcacctgtttgtggagcagggccctgagcgccaactcccagggctggtgaggaccaggctggcctgcgggatgccctcccggccagcaaggatccgccagcctgcggcgctgagccagcgcaggtcagctccagagacacgcagctgacccaggccagaactacccttgaggcccagtcagatccacctcacctgg

SEQ ID NO: 118730 - DNA, 446 bp, Homo sapiens
gcaaataagaaactgagtttttaatttaaatttgaatcactgtatgtggctactgattaacccattggacggcacaaacctaaaatattgtatgactgggtttgaaatagcaagaatgatgtgaggacacaaaggtggagtgagaatatttaagagaagatagctgggtgcggtggctcacgtctgtaatcctagcactttgggaggctgaggcaggcggatcacctgagatcaggagttcaagaacagcctggccaacatggtgaaaccctgtctctactaaaaatacaaaaaattagctgggcgtggtggtaggcacatgtaatctcacctacttgggaggctgaggcaggagaattgcttgaacccaccaggcggaggttgcagtgagctgagatcgtgccattgcactccagcctgggcaacaagagcaaaactgtcttctc

SEQ ID NO: 118731 - DNA, 186 bp, Homo sapiens
tctctcatcttgcatttactgcctcatgaggagctccctctgacagctgactaaggaacactttaggcctgatttgtgatggttcaacataaaccctctagcactaactgaaagcagacagctatagcatgagattgtaatgctatagctgtctgctttcagtaagggcaaaaggttataggggaa

SEQ ID NO: 118732 - DNA, 742 bp, Homo sapiens
ttcagatggagtctcgctctgtcgtccaaagtgctgggattacaggcttgagccaccgcgactggcctgataggaggtgtttaaaaggagcttcaaaagaggtcagtgctctacactgaacgaaggatggagggtaatggtaatgcctccacattaaaatgacacaaatgctgctgtcttactgaagtttggtactttctgtgggatagatacttttcactttgttctgtggctttggtaaatttcagaagtctgaaatgattgattttagtgactttgcgagtgttttcatcattttgcagaggagacttggtttcttgtggtttgcattcatcagtgtcagaagctgatctctctattcaatcttgcagttttaagtaatgcattgaacagtcacataacagaacgctgagcaggagaactaaatttctagtgtaatcagaatggcaggcactaaatgaattattttacaataagcctgtgtcctttttattaactgttcagtggagaagtttggagtctataaacttgtaataaatgtggcctgtaagaactacaaatactggaaagctctgaggatgtaatttctaatttgatgaagaaaacattctctttaattaacttggcaaggagaaggcttcaataaaaagaaaggcaactatgcctggggcggagctggagtggaaataagatggcagacattggacgtcattgaaggcctggtgatgtggttttagtccat

SEQ ID NO: 118733 - DNA, 346 bp, Homo sapiens
agctcaccagctgtcattcgtgttagtgtattttatgtgtggcccagacaattcttcttccaatgtggcccaaggaagccaaaagtttgaacacccctgctttacaaccacacgaagtcagggtgaaccccacctccatcacttactgaccacaggacatcggacaatttacttaggttttctgaacttcagtgtcttcatttgtaataaaagtttacttagcacagaagccagcctgagcactctggctgttcaataaatggcacctattgttgctgttgttatcaatccatccaaagagcactacttttacccaagccactcattccccacaatgtgctgatat

SEQ ID NO: 118734 - DNA, 406 bp, Homo sapiens
tcgttaattcttaatggttattaattactgtttaatatgacttaatggcaagtttgtgtagcacttaatttacatacattctgtgctccaagatttgagaatgtagttttgggaaagataaagtctttccatgggtaataatcaggtcatcatgagtgatggatggaatgggatgaggttccattctggacgtggtttctagctcatctgaggattcttttcccattgctcaaagtgaccttccatagaagaaccttccatggaacctgtgatgaccaaagacactcaagcaatgactttttggaaacttcttataagctgctctcctcagaggagaaaatcatcagatcggaagagaacctagtctgttgaaatatcctacctgaaagttggttcatccttgaca

SEQ ID NO: 118735 - DNA, 477 bp, Homo sapiens
ttatccccttgcaaagaagaaactgaagctccaagagttgaggaacttgcttgtgtcacacattcagtaactggtagactctagatctcaacttatgtccatgtaatgtcaaagcccaagttcctaaccaaagacagtttctcaatttacaaatggcaaaactttaggcagaaaggtgcagagacattcccagccacacagcaaattagaaaggatgctgctgaaaaatctgacattttatgacatctttcaaagatgctttgttacactctagcctgaataactctcactgggtccattctacatctctggctcagttcatgcttcatttgctctatgttgtctcaatagatgccattattggtgaaatggaggccaatgtcctctaagattacacaatgtcaagtaactcacaaaacttcagtccgcttcatcacaactttctataaatacaaaactttaagcttaagccctttt

SEQ ID NO: 118736 - DNA, 377 bp, Homo sapiens
gcacgagggataatggagttttaagagcagttaggaattaccctaaattttaaatttgagacaaatgtgttttccgtgatgcaagaactgctgccagtctaaggaagtacaagaaagagatttttgaattagtgagctatataaaattgtcctcacattgattttctaaagtagcctgccaatcagaggtcatttttagttcaccattgcctcttacttagtatgaattttccattttgcacacaaatataagaaatacaatttaaaaaatggtacattaggaaagctaaagtactttacttgactcttagtttacattgccttagtgacaccagccaatgaggaatgaaaaatccaggtgagttagagcaatgatc

SEQ ID NO: 118737 - DNA, 654 bp, Homo sapiens
gccaaatgcctagttgtctaaactgagaccagggtccctcgcccgggaaacttgtttctactggcagacatccttgtggctcttgtctggcctgaccatcacacttacactgggagcctaaccatatgcccagagaaaacccagcctggggcagcccctggttcttcagatggaaggtacaatgcaccaccagaacagaaaacaagttcaaagaccttttacttccagaccctgagcaaagagagtaccatgagtcaggagggcagtcctctgtttccaggtcacaggaggcaggaacaaaaagagtcagacagagagagtgcacatcacaactagcagtgtatgttataagggaacagggtgtgggtcacttcaagttcacaggcaaatgcctgaatggtccattacaagcagctacaggaaagcagggagcccggtctgccaggtgggagagacacctctaagttctcacgccctctgggtgtggtgtaggactggaaactgggctctgcctctgatacgagaaagttaaacctgtactcgaaatggatgccaaggcaacataaagtcatcagaatctactacattatctctgaataaaatgttgaaaacaaaaaaataaaaaagtttatgcagtgtttttcactgagatac

SEQ ID NO: 118738 - DNA, 288 bp, Homo sapiens
ccttcacttccttgagcctcagtttccatcagtaaaatgagaaaacagcccctgcctctgcggggttcccagaagacctggagattaaatctgtccagtgtcaggcacacggcagggaatttttatggtgtctttattggccatcctggcattatgcattagccacaagggtacccagcctcaacctcaaaagccacagaaaaaggccacctgatcctccagacaacatgtgtggccatggctgtgctgatggtcttacagaggcagtcactgtcctacactcctgag

SEQ ID NO: 118739 - DNA, 614 bp, Homo sapiens
acaatgcacttttctttgtgcattcacacgatgcattttcttttcttatcaccaaactgttttgaaagataaaagtacttcctgaatatgtggatggtgagccacgtgaatggaagacatggagatatggactgttaacaccttgtcaaacatttattgtcccttccacctctaaacttctgtgataataggtgaacaggacccacgtggtgcagaatactgcgatacacactgcggaataattcagtgcagaacaacacgtggattgctcagtacaacttgttcatcacatcctcctgttcactgaagaattatggaaatattctctgagctgctttcctccctgcccaacgagtcatctctgtgtgaaaggccaagcttataaatcctgaagaaagagacattatacaaatgtaagctgttgtcacaacaatgataagaaatcaggagtcgaaagatgtggagtaagggggaatttcagagaaaccacaaaacacaaaataggaaacagagacaggagaagattgctatgacaaaattgcagaaggtgaaatctttggcagcctcttatttctctggagaatatgatattgtcaggctgaggtggaagaatc

SEQ ID NO: 118740 - DNA, 343 bp, Homo sapiens
ggatatgctgtctcaaggttgggagaggtggaagaaaatatgtatgtaggcggactggcaaagttcagactcatgttgttcaaggatcagctaatatatacatatctttttgtcgtttcaaataaatgattctgcttcccagggcaagtgctaggaagcacattaactgtatattagtctgcaattgaattgcttttgttctttctttggtattccagagattttataatctatgttaaaatcatgggttctgaaacttggtgagacagggcttttgaaagagagcacttttggctgtgtaatgtaaatctgtttctcttcagaaagacaggggccctgtaga

SEQ ID NO: 118741 - DNA, 447 bp, Homo sapiens
ccaggaatgagcaatggagcagcctggcaccaactttgcaggctgcatggaggctgatttctggccctctcctgaaggccaatctagagcaaatggtttgaaaatattataattacatgaaattgaagaagaaactccctgatgattcaggtgattaaacactagagtaggctttcagataattcagaggcctgaagttagaatcttattccagtgtactttgcggcatcctttttggaaacagatgattggactaggttcattcattcattcatttgacaaacaaaaaaaagaaaggcatcagataccaaatccacttcatatctgtgatgcctgaaggattagggggcattaggaacagtgagtactgtacagtgaacaattatctgattataaaccattaaataccaagatccacaatatttatttgttgtctttcatttgccc

SEQ ID NO: 118742 - DNA, 209 bp, Homo sapiens
attgaacatctgtgtaacaggtactgggaatacagtgttgaacaagacagacaacattccatacataatagtgttttggggggacccagtaaacaagtaatatcacataatatgtgcagtagtgaaaataaaatggaataatgtggtagagaatgatggggaagctactgtagacaggaaggtcaagtctgaggacatggcatttaaaa

SEQ ID NO: 118743 - DNA, 248 bp, Homo sapiens
acagcaaatcaaagaagaaaacagatgctgctgacaaaccaagaggatttgccagaggtcttgatcctgaaagaataattggtgccacagacagcagtggagaattgatgtttctcatgaaatggaaagattcagatgaggcagacttggtgctggcaaaagaagcaagtatgaagtgtcctcaaattgtaattgctttttatgaagagagactaacttggcattcttgtccagaagatgaagctcaa

SEQ ID NO: 118744 - DNA, 774 bp, Homo sapiens
ggcttctactgtggacctggcattatgccacgccttcgatgtacattggagaaccagagagccaaggcattatatttcccaactctcctgcagttagctgggggccacatggctgagttccggccattggaatgttgctggaactgatgtataccacttccaggattggtctataacaccttccttgaatcttcccttctctgtctttcctggtcttctggaagttcttagacaacggtggaaccactagatagataacaggttcccgattccctgaacgagtgtgatagagtgtcctcaccaacccacattggaatatgacatgggtaagaaataattcttagttgtggtaaactgctgagatttgggaagatttttttttgtaacattatggtaaattgttgaattcatcaaaggtatggcctttgatgaatcacacattcctctgttcacacccttgtattcttccttcccacatggactctgtctttggctatgtaacttgctttggccattgggacatcagcaaatacgagataagcaggggcttgaaaggtgtttgtgcattaaggcttagcctgttttgctgctgagaattcttcttccacaaagtaaagaagcttaggctagcccactgacaactatggcccaatcatccaccagcaccaagggcaagacgtgaaaaaggccataatggaaagtctagtcttagaaaagctgctggatgaccacaactctgtaagcaacccaaagcaagattagcaaaaccaccta

SEQ ID NO: 118745 - DNA, 456 bp, Homo sapiens
ctatttagatttttaactgttaacccaaactgattattcccacctctgattttatcattttatagatatatatgtgtgtgtgcatacatatgcatatatatatatatgtgtgtgtgtgtgcatatatacatatatatatatatataaataaattttagggacagggtcttgctttgttgctgcccaggttggaggagtgcagtggcatgatcacagcttattgcagccttgagctcctgggctcaagcaatcctccagccttggcctcccatagtgttaggattacaggcatgagccaccatgcccagccaagatccattattttgaggtcgcctgtatgtatcctttatcaaaaccttctttcaagaaagcatcctgtgaaattatgttcctaaattattgttttcatgtaaatgtctatttctcataaagatattggatataatgataaaatta

SEQ ID NO: 118746 - DNA, 204 bp, Homo sapiens
tttgtcttaatttcttaagatttcaggataattttaccaggataagtgtctcttttctacttttttaaaatcaaatcttctgcaagcaattttaataccagactaaatgtatcaaggaaaaaatagcaatgatacttctagatcctatatttttttctctgaacttagctaccaaagaacagatcttaatctgaaatattgaat

SEQ ID NO: 118747 - DNA, 353 bp, Homo sapiens
catataatatgtttcagactggaacttctttaattcgtggctttagtttattttaaattaatccatttctactctctagattaaaaatcatgaatctcttgatttgttaataatgaaaactacttgtggtttttttttcgctcaataaattacatttgtaaagttgatgtgtgttttcttttgccagttttattaatagaaaagtaatcattgagctgtttttatgcattttgttagtattttgagatagggtctcactctgtcaccacgttggagtacagtggtgctatcatagctcactgcagccttgaccttccaggcccaagcaatcctcctaccttagcctcccaagt

SEQ ID NO: 118748 - DNA, 437 bp, Homo sapiens
tgcaaggaccattgaagagacacaggacttttaacaggtaaattggcagaatgttagggactgtttctcctcttctgcagtcaccacccaaagcacttgcctcccctgttttacccaatatggtggctgtggaccacacacttctttaggggatttgcttgggttgggctaccccaacatctatttccctactttttgcacaatgcccatctccctttggggaaattgcccctctcccactgtgtatggtcttgggttggtgggaggtcaaagtgccctgcttagttgagtaggctagctataagtaaaggtattctgccattgcttggtggggtgggctggctgtatgttaaggttccctgccattgtctagtagtgtaggctggctccatgtcaaggtatcctgccattgctggtggggtgagctggctacaagt

SEQ ID NO: 118749 - DNA, 312 bp, Homo sapiens
ttagaccatgcaagatatcattttcctatcaagaaaatgacctcatttttatgccacagatatttcaagggtagaagaataagaaatttcatttgctgaactttcctggatattgccaggcccccagaaatggggtgaaggaggaggtaattaaattaatctatattgaatgttactatcctcttttcctgctaagtcagtgaccaccttctgctgtcattaaaccctttaagatggtggaaccagtcctataaaggacatctgattactctggttgagaaaactgagcttctttaaaaacagagctgtgga

SEQ ID NO: 118750 - DNA, 118 bp, Homo sapiens
actccagatacttggttgtgtcaagcctttgggtttctttgtgtccttggggatcaaaatccacttagacttaggaaacttttcagcagttccatccattggccaacccatcagccct

SEQ ID NO: 118751 - DNA, 631 bp, Homo sapiens
gaactcctcaaaggctggggtttgttcaacacacccaaggggccaccagtgctctgaagcaactgaaaatgaatgacgtggcccaagaaagaatgtgactgttggccacaaaatggggagtggtgttgagcaaagaaatttaaactctaatacccataatcccagcacctggctaggtccaagtgggaggatcgcttgagctcagaaatcaagaccatcctggctaacatggagaaaccccgtctctactaaaaatacaaaaataaaataaaataaaattagccgggcatggtggcgggcgcctgtagtcccagctacttgggaggctgaggcaggagaatggcgcgaacccgggaggcagagcttgtagtgagccgagattgcaccactgcactccagcctggtgagactctgtctcaaataaaaaaaaaaaaaaaaaggacaacacgtgggggtggggtatggggtagagggtatttgcaaacttttcagatgaatgaacggcgagcacacgtaccttattttagatttgccacaagggaaccagtgaaaagggtgagccttttcttttgtttttgagatggggtttcgctcttcttgcccaagctagagtgcaatggtatgatcccgg

SEQ ID NO: 118752 - DNA, 388 bp, Homo sapiens
gaactcctcaaaggctggggtttgttcaacacacccaaggggccaccagtgctctgaagcaactgaaaatgaatgacgtggcccaagaaagaatgtgactgttggccacaaaatggggagtggtgttgagcaaagaaatttaaactctaatacccataatcccagcacctggctaggtccaagtgggaggatcgcttgagctcagaagtttaagaccagcttgggtgacaagacaagaccccatctctacaaaaaataaaaaaattagctgggtgtggtgggacacccctgtggtcccagctacttgggagactgaggcaggaggatcacttgagcccagggggtccaggctgcagtgagctatgacgacaccactgcattccagcct

SEQ ID NO: 118753 - DNA, 108 bp, Homo sapiens
aagggctctgcctttatgaatgagattagtgcctttacaataataactctggggaactagctagcccccttccactatgtgaggatacagtgggaagtcatgaactat

SEQ ID NO: 118754 - DNA, 341 bp, Homo sapiens
tgaaaactccaatatgtatgacaaaggcctgtctaatatcttgcctgtctcatttccaatgttatccatctctactttatcagcagaaaattcatcaaacagagatgttgcacctccaagattacaaacctaaaaatgttctttctctgcttctctgtttctctctcttattctgcacctggacttgcaaccccttggtgggtttccagtgttcccagtgtgttaccacactttatttctcccccttagccaacatggttctttattaaaataaaatttattattctgtattatcaatgcaatacacattacatagaaactttctaatataaaaagtaaaa

SEQ ID NO: 118755 - DNA, 472 bp, Homo sapiens
tgactccctgaaacacacttctctactcccactgctaagactattaatacctacttattcttctcatcctctatattctgtaaaatgccaccttctgtccccaagttttgtaacctcctcttactgcccacctggccctggcactcgctgcctgctctctgattcaccatcacaaaacaagaagagcctgtctaacaaagcaagatgttccttagaaaagaataagaagaaaagatcatcttctttggagaactggaggaaaagaaaggcaggaaacatgtctatataaatattcttgtccttccaataaactgttaacgttttcacctcatagtaagctcaacagatcaacaatatgtgtgattacaaaacaaagctatctagttttagatttcacaaaaaaaaaatactgtatcaggaaagatcagagtaaatctgacatgaggtatgaggagcacatttcaaaagtatt

SEQ ID NO: 118756 - DNA, 156 bp, Homo sapiens
cttcatgccccatagccaattcaaagtcaagtcctgttagcgctgtctttggaatggatctagaatcagaccgtatctcacctcactgctcccaccctggtctgagccgcactgtcccatgtttgcacttcacagtagcctgctggctggtcttcc

SEQ ID NO: 118757 - DNA, 176 bp, Homo sapiens
gaaattctcatttaagttttcctttcttagagtaagtttaggaattttctcagatgtattttttgtgaatatatatataatcaaatatatatgtatttatatttatatttaatatggactcttgctcttgttgcccaggctggagtgcaatggcacaatcttggctcactgcaacc

SEQ ID NO: 118758 - DNA, 299 bp, Homo sapiens
catcaatctatctttcagtgaggaagtagcaatgtcccttaactactttataaagagctaattgtactcaattgtttccgggaaagggtatcctacagtcttttagagtttaccacttcattctgtttcttcaggcgttgataattgccagagtaatttcacaaaatatgttttttttttctaatatgtggaagtggcataaagaagtgtatacaagactcaaatttcctggggaagcccaggcgcagtgtctcatgcctgtaatcccagcactttgggaggctgaggcaggcacatca

SEQ ID NO: 118759 - DNA, 323 bp, Homo sapiens
cattttagtaaatatggatacagtaaacaaatctgtatgagaaaccaggcctaacaacactgcatttttctgctaaagatcatattaacataggtccccactcccctgtttttcatggaataggggataaattacctggtctttttccccaccaagttttttaaagctaaaacttacctgagcattaaatgagtttggaagtgcctgctagctgaggggtaaagctgaaatttcagccgtttgtcactcactgcagagtttgcttgggtttgggggagagggatgagatgacattggataggcaaagcagtgacatcagtctc

SEQ ID NO: 118760 - DNA, 901 bp, Homo sapiens
gagacagagtttctccatgttagccaggctggtcacgaactcctgacctcaggtgatccgcccacctcggcctcccaaagtactgggattacaggtgtgagccaccgtgcctgaccaatttgcagaggtttttaaagagcactttggattttattagaattagcatgtccagtttaggatttacaaaaacaagtcgattatactttctttcagaagtattttttttaaagactaactaaatgctgcagaaaattattagtagaatgcaggcttctttaattctgctcttatttcagtaagtctttttaagtgggttgttgtgttctaattattattgaaagctgtttttaaatgtgctggctccacgggcaggaaggcacggacgagctggtgagtttctgccacctactgacaagtgatggtaacagcacatgcttcttttttaagcatccggggaccttttttgctgtcagcttacccacgcaacgtttataagtcaggtgaaagtagaagcgttcatttaagactctcaacttactgggttttttgctttgttttgttttttgagtcgagggtctcgctctgtcacacaggctggagttcagtggctcacggccgcctgaaactcctaacctcaagcaatcctcctgcctcaacctcctgagtaactgggaccacgggcgcacgccaccatgactggctaatttttaaatttttcgtagagatagggtctcactgtgttgcccaggttggtctcaaactcctgggctcaagtgatcctactgccttggcctcccagagcacaggatcacaggtgtgagccaccatgcctggccaagagtctccagcgtactaacagggctatttgtagaaggcaaaacacattgtgtgataccatcca

SEQ ID NO: 118761 - DNA, 799 bp, Homo sapiens
ctctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcataatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacacccccca

SEQ ID NO: 118762 - DNA, 464 bp, Homo sapiens
agctgagaagccatgagggtttcctgtcagccagagtagtctggaaactttatataggaggtaggagttgatctagtgtccagtgggtctcactatagaaccccatactgggatgggcttgcaatcagctctgcctgagtttgttgaggcttggaaatgggacagaggtgaagcctggggaagctacaacctagtactcttttaactacagtcctcctatggttctattccccagtttggccttctatacctctacctacccctccacgcgtcatcttgagttttgaattttcaccaagcagcagctggaagccaggcattggctgctggaacaatattgactgcatttcaagttactttcagaccttcagaaggggaaatttgcttttctcttgcacattctaattaagaccatgtgctctgggacccatggaaacatagttctctaatagttcatcttgggg

SEQ ID NO: 118763 - DNA, 172 bp, Homo sapiens
caaagtgctgggattacaggttccagccagccgcagtcagtctcctctttatttaaatgtttgctatgatgatgcatttctcttaagaaaacttcataattgacatatgtggatttaggactaccttccagtttttaatgttgtctatttctgaactagaagatggtatttt

SEQ ID NO: 118764 - DNA, 883 bp, Homo sapiens
tccagaaagggcaaatgacttctgaaagtcacacagcaaatcagtggccccagtagaattgacccctagagagctggtctgggaacttgctgagaagagggcctgagtgctaaaggcctcggtttattatctgtaaaatgggaccgagattggagggagtgtcctgggacgagcctagaaagtaagttcctcaagggctggaatcttcattttgttcactgatatatccaaagtaacacatgatcagtgctcaataaatatttgttgaatgaatagcagggaaaagggttctctaggagtctcttggctgctctgcctcagccctgctccttagcctagtgagcttgaggtctggaaatggcttcttctggaggttggacaaccccaaattcattttccctgagggttctatggctgggcagtccctactgaggccagtgcattgtcccccactgacctgcaccttgatcccagcacccagtagcctgacccaggtccatgtctccatctcttctgactgcctcattttcccgcccccaaaagctgtgtccagggatgtggggcacagacaccacagacttttatagacatccagcccccttcttttatagttggtgagttgaaaagagcactgatggattgagagtcagggaaccaacttttctgttcccaggtcccataacagaagtgtggtttgctacaacagcatctgagctagaaaaatctttagctggaacctgacagttacagaattgtaattataatttttagaatgcatactatatattgagaacgatgccaagattattctatacgtttttatgttctccctttttactagaagaaaatgaagctccttaacctcttcaatggaagaatttct

SEQ ID NO: 118765 - DNA, 436 bp, Homo sapiens
gttccacttacgatttttctactttacgatggtgcaaaagtgatacatattcaagagaaaccatacctggagtactcaaataggcattgttttttcactttcactacagtatttgatatgttacatgagatattcaacactttactataaaataggcttcatgttaagatgattttgcccaattgtaggctaatgctacatgttctgaacacgtttaaggtaggctaggctaagctatgatgtttgacagattaggtgtattaaatgcattttcaacttaatgatattttcaactcacgatgtctttatcaggttaagttgaagagcatccatactgtgatggatgattacctcgtggtttccacctggccactgatttcatttcattaacataatgatgcaactccagtacacccaagagatatatctgcactcc

SEQ ID NO: 118766 - DNA, 901 bp, Homo sapiens
gtattattcctactttaataaccccaaaactagtgtgatatactataaaaaatgtatttaaagtcattatttctggctcatacaccactcagaatgtaaactggtatgatatttttacaggttgatttggaaatatctattaaagtgtcaaataataagcctctctttttcctcagcaattccatgtttaggaatttaccctaggaaggaaaggatatgtacaagaacgttaactgaaaattatgataaaatggattaatacgcgacttaagaacaaatagaagggtgggattacaggcaagagccactgcccccggccttatttatatttttcaaatgactagaagtatacataccaaactattaaagagtgactaatttgggggagtgggatgaagacaaatattgaaaaaggtgcctgtaatttttattttgttcatttttctgtactgaaaaaaaaattagccatgtgtacttattccttttaagacaaaagaaaagcctaataaaatagtagttcctgagactaactggttaatgaggctacctccatgccactgttccccaaaacacctcaccatattccatgagccaaagggaattcatttggtgagtttcttggaccttgggaactgctgcctgatgttttgcctagtttctgctactaaattaaccttagccagttgtagattatcatggctgctgactcatgagctgatggtcacagagctatttatgtttttaaaagtacaatgtttgatagagatgaaaggtaatagcagtcttacccaactactaaatgatgaggcaaggtgctttaacattaagagtttctttgaactccccaacacaaatgattcacacgtttcttatcctgttcatctttccagaagaaagatta

SEQ ID NO: 118767 - DNA, 199 bp, Homo sapiens
aacagggaaacattgacttggacagcccccgtccaggctgggactggggaggtggccaaggtgagagcctggccagctctcgaggcataagggccaggcctctcactgcagaaccatccccctgtccctgtctgctccttttctctgtccaccctgccctgtagcctgcccagtttccccagccctggagcttccccct

SEQ ID NO: 118768 - DNA, 221 bp, Homo sapiens
cataagcaggtggttcacaagttcagaggaagaaaagtccttttcaactgggattattagcgaatacttgaagaagatggaatagatctaaagggaattaactgctgcttcagtttcttctctttctcatctctttttactctgtactgtttcgttatagtaaaaaatattataaggtaatttttttggggaggagacggagtctcgctgtcacccaggct

SEQ ID NO: 118769 - DNA, 818 bp, Homo sapiens
tgtggcagcgcgtgcagctactcgggaggctgaggcaggagaatcgcttgaacctaggaggtggaggtaggttgcagtgagccaagatcacgccactgcactccagcctgagtgacagaatgagactccgtctcaaaaaacagaaagaaaaaaaaaccatttggaagcaagaaagcagagagacaagagatgtgcggcctggcacagtggagagtggggaaaagaaacacttaggcttggagcagacaaccaggaaaccagcaattctggagactgaatccagagaccctagtacctgtaaagccagggatcacggaaaagctgaggacaagagagttggtttcaccacagaagcactgacccctctgtttactagggaaagatggaaccactgagggtatgcattctcaggactagggtgtggaccaaagggaaaacaggaatcagagtgcgaatcatcaaccttaacatgcacactcagctcttgggacaggaacagcctggcttcaacgtcaacagacaagaaaccgctgaattcttgcctgtgagatatacaaggtcaacaaggaaagatctttttacagagggcattcaagaagctcctcaatggccaacaagccccacccttacatctgaatcccatctgctttttcttaaagggggcacctgagaatgattatcagcaggtgcccacgggaagtctccaaggtgaaagagaaagagaaaaaagactcagagaaaacaaagacaatgcatgaaagaagaaaacgccaggggaaaaaaatacaattaatatcctagtaatgggaattaatgta

SEQ ID NO: 118770 - DNA, 319 bp, Homo sapiens
ttttgttaatgtttctgagttgatattcttaagttgttctatgacttaacctataacattttttcatagaaacagattcggatgtatttggagagtctgaatctgagtcatcttttgcacaactcagtcctagtgttggatttagcagtaagcgatttatttatttatgtatttatttatttttaaagacagggtcttgtcctgtcatccccaggctggagtgcaatagcatgatcatagttcactgcagccttgacctcctaggctcaagcaatcctcctgcctcagcttcccaagtagctaggactacagacacaca

SEQ ID NO: 118771 - DNA, 456 bp, Homo sapiens
caaggtgctgggattacaggcgtgaaccaccacgcctggcccactaccttttatttaaaatgatacgtcttttttgctgattattaaactattcagttaaaaaaaaaaagctaggaaaattcagaaatataaagaaggaaaatttgtgattcactaccccgaggaagaccaaagtgttaactggttattttcttcctttgaatgtatactttcataccttcctttaatgagattgaactcttggccaggcatggtggtcagtactttgggaggagtaatcccagcactttgggagggtaaggcaggaggattgcttgagcccaggagttcaagaccaccttcagcaacaaagtaagactccatctctacaaagaaaagaaaaaattaggtgggtgtggtggtacacttgtggttccagatggtgggaggctgagacgggaggatcacttgattcca

SEQ ID NO: 118772 - DNA, 409 bp, Homo sapiens
cctccctctgtcttcctcccctttcccttccagcccctcttttccaggaaccttgccacacccgcacgtgcaccctttactccttggccctcccacagctgctgtggcacacctgtgctctgcacttgcctcaccagctctctgctcgctttttttttattattattattatactttaagttttagggtacatgtgacaatgtgcaggttagttacatatgtatacatgtgccatgctggtgcgctgcacccactaaatcgtcatctagcattgggtatatctcccaatgctatccctcccccctccccccaccccacaacagtccccagagtgtgatgttccccttcctgtgtccatgtgctctcattgttcaattcccacctatgagtgagaatatgcggtgtttgg

SEQ ID NO: 118773 - DNA, 680 bp, Homo sapiens
aacggaggcgctcggggcctgctgcggtgcccgcgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccccggctgaggatgattgaaagagcctgtgtgccgccatccaacgtcgttactgtcgcagacggcggctaccgcgtgatggatggagcagcggactcagccgtgcaaatcattcatcggggtcagtgcctggtgccgtgggaccgcggcgtgggggtttcaacgcgtaaaaatcgcaccgcacgccacccggagacggagcctgctgtcggcagggcgggccgggctgcggggccgggtgctccggaggccgctgaagaggcagctccccaacgccaagagcccgtccagcccca

SEQ ID NO: 118774 - DNA, 506 bp, Homo sapiens
ggcaacttcaatgaacaaacatcttccaaaacttttgaatttttcttctgcttgctaaatactattttgtaaagtttcaattactagttcgaatccacacctcaataaatagatatgtattagagaaggaatggaaaaatatttactcattaagaataccaacacatgaaagtgatttcagagtatggagtcttgagtcaaaaacaaaggacccttcccggaagcttccttttttgcttcagtttttgaatttgactgaaggaaggtggaaatgatcactcgagcccctaatgaattctccttatcttcagatgttaattcccacttggccctactcttctcctttagaacgtttttcttgcaaaatataatttaatgcatttcagattccccttcctacctaaatagggccatagaataataattatctttcttatgggtcttggtatctaaattagtagcaaggacttatgagctggtttactgcacttctttgcaccaaaaat

SEQ ID NO: 118775 - DNA, 560 bp, Homo sapiens
ggcaacttcaatgaacaaacatcttccaaaacttttgaatttttcttctgcttgctaaatactattttgtaaagtttcaattactagttcgaatccacacctcaataaatagatatgtattagagaaggaatggaaaaatatttactcattaagaataccaacacatgaaagtgatttcagagtatggagtcttgagtcaaaaacaaaggacccttcccggaagcttccttttttgcttcagtttttgaatttgactgaaggaaggtggaaatgatcactcgagcccctaatgaattctccttagtaaaatactggcgaggaagaatcaatcccagcaacaggatgatctgggaccagtcttcagatgttaattcccacttggccctactcttctcctttagaacgtttttcttgcaaaatataatttaatgcatttcagattccccttcctacctaaatagggccatagaataataattatctttcttatgggtcttggtatctaaattagtagcaaggacttatgagctggtttactgcacttctttgcaccaaaaat

SEQ ID NO: 118776 - DNA, 418 bp, Homo sapiens
gagcataaatattgcggtgccctttcctggcagcgccggctcagttttctggaatgtttctccttgtctgttagacttcgtgtccacatctaggaggacactggagaggaaccttcttggaggctgcgtagtttcttctatgggatcaaatgcctcctggcttttgtagggattactttaggagctgaattgtcagagggtttgacaaactagattgtagtttctttggtgatacgatttctccacattttcagtagtgacattctagcttcataacatgagttgggaaggtttctgcctcctgtttcctgaaatgtttatgtaggattagtattatttcttccttaaatgtttgctagaattcaccagtaaggcaatctggatctggagttttctttgtggaaagggcaccgcaaaa

SEQ ID NO: 118777 - DNA, 1109 bp, Homo sapiens
gcctcagtctcctaagtaactgggattacaagtgcctgccaccacacctggctaatttttgtatttttagtagagacggggtttcaccatgttggccaggctgatcttgaactcgtgacctccagtgatccacccgcctcggcctcccaaagtgctgggattacaagcgtgagccactatgcccagcccctgaatgttttttaatgattgcttctgagcttggggtctccaggagcacacaggtcatggaccccagcaagcaagtgtgcatttctgaagtatttgtttttcacccagagcccagggtaagacagctatgcttcctgagtcaggacttggagggcgtccaggtcaccatctcctacctgaggttgtaggccacagaggaacctagggttctttgggagcattcagcaggggtggacgtaggtccagttcttgccttgacttggcccaaggccttgatctgattggtacattggttccccaggcagcaagctctggcacagggtggctacagacgcagcatctgaccaaggtcttgctgctttacttactatttcccttatcattggggatcccgaagagcaccctggggctcagtgctgtgccgggagggctcggaactcagaaaagctgtcacactcccagttccggtttattacaaggaaaggacacaggttaccgtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcatcccagccatggcggccagggtttccgtgggaggtggtgggctgcatgggcatggagcgcctgcgtggccaaccctggtcacttgggctgcagccaccagagatctggcttgggactctgtggcccaaggccctcaccataaatgatgtggttagcacagaccgcctggcagtccagtaaaccaagacgctcacacggggcaggattttctaggggcctagaggttatcctccaggagccaggcagaggccagacctgcctttggaaggt

SEQ ID NO: 118778 - DNA, 751 bp, Homo sapiens
cacagtagctcacgcccgtaatcccagcactttgggaggccgaggcgggcagatcaagaggtcaggagttcaagaccatcctgatcaacatggcgaaactgtctctactaaaaatataaaaattatcgcgccactgcactccagcttgggcgacagagactccctctcaaaaataataaaataaaataaaataaataaaaatataaaaattagccagacatggtggcacgtgtctgtagtcccagctactcgggaggctgaggcaggagaattgcttgaacccgggaggtggaggttgtggtgagctgagatcacgctagtgcactacagcctgggcaacagaggtagactccatctctaaacaaaaacagttcacagttcattgattgcaatggtgaaaaataaagtacaacagagacttgggctgaaaagggaggtatgtggtgctactgaaataacctctcacaaaggatttgagcagcgctattgacccagctgaaacccaaaggaaggacttgatcactaggtgtgtatgttgttgtaaattgtttttgcttttagacctcaggtttagagaactaaggtcatcatgaccctgggttcatggcacattgtatcatcaaaggcccacttgggcactttcttattaacctttcatctccatttttccttcccattccctgtttccccatacgtggttaatgatgaacttatgagagaacctgttctgtctggctttctcagagaaagc

SEQ ID NO: 118779 - DNA, 152 bp, Homo sapiens
tcgctattcatcggcacctcgctattcatcggcacctcgctattaatcgacacctcgctatccaccggcaccacatcaagattttctctttgatccgatcaggaatagtaagaactgaaaagggcagtttgaatcacggtgcgatgaaggag

SEQ ID NO: 118780 - DNA, 398 bp, Homo sapiens
ctgcttctgaaagggacaggtcccctggaaagtctagttcctcagttaatgccatgtctctgatatacataacttcatacacagtgactggattcacacacccccatcctcagcatgccacagcccaccagatggacagtcattcataaacacctatgcccacacagcatcctcatccttatcctgtctggtggtatccccaaagatgccaagctccccgcaagtgactgaaaaactgaaacagtctcagaaagggcaaccaaccatgtgcccagtaccacagagcatgctcaagcctaagctgggatgcaccctcaagtcttactaaccacaaaatcccaaatcccaaagggtgccgccctttctgctaaactatactgccttctcagtcttcccac

SEQ ID NO: 118781 - DNA, 694 bp, Homo sapiens
  misc_feature (647)..(647): n is a, c, g, or t
gagacagagtctcactgtgttgcccaggctggagtgcaaatggcttgatcttggttcactgcaacctctgcctcccaggttcaagcaattctctagtcccagctactcgggaggccaagacagaaggatcaccttgaggccaggagtttaaggccagcctgggcaacatagcaaaacctagtccctaaaattaaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtcttttccaacanccaacagatggaaattaggattatatagccttggggattgtgtgacc

SEQ ID NO: 118782 - DNA, 863 bp, Homo sapiens
aagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaccgctagaccaaggagccctctggtggccccgtccgggcataacaggctcgcactcttgtcttctggtcatcctcattgtcccctcagctc

SEQ ID NO: 118783 - DNA, 609 bp, Homo sapiens
aattcgcggccgcgtcgacgaagacgacagaagggggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaccgctagaccaaggagccctctggtggccccgtccgggcataacaggctcgcactcttgtcttctggtcatcctcattgtcccctc

SEQ ID NO: 118784 - DNA, 183 bp, Homo sapiens
gtctcttgacaccagccacctagcattgtgtccccagtgcccatattccccagcaaaatcatgccatttattgcctccgtgctttttgtgactggcagtgtccctaccccaccttcatctggctacttctttttctttctttctttcttttttttttttttttttgagacagaatctcactct

SEQ ID NO: 118785 - DNA, 881 bp, Homo sapiens
tctaggacagtactacctaaaatattcatctctgtgaaggaaaaaaattcacaaagaagcgcctttctttagcccactgattctcctaggccactctttcatttaatttctttaaaaaaaggaattaaacatagaaatcagatagtacatagacaaagcctagaacctgagttttaatttgtgagctgagtaggaggccagaggatccgtattaaatttcagaacccattgtcaaatctaaggtcaaagatttgctctaatgttttcttctaggagttttaaaattttagcccttaaattaagtctttgacctattttgagttaattattaaatatggtgtaaagattcaacttcatttttttgaatatggatatccagttttcccagcaacatttgtcgtcaaacactgttctttcccccattgaatggtcttggcactctagttaaaaatcaattgatcgtagatgggaaagcatattactaggctctcatattccactggtctgtgtatctgtctttatgccagtactgcactgttttgatttctgctactttgtagtaagttttaaaatcaacaactgtgagttctccaactctggtcttctttttcatgattgttttaatcagggtcactggaaattccgtacgaattttgggataggtttttttatttctgcaaaaaacaccatctgggtattaatagagattgcattgaacctgtatgttcctttgggtgtcatcttaacaatctaattcttgcaatccatgagcatgggatgttgtgtttccatttattggtgtcttctttaatgtctttcagcaatgttttgtagttttcagttgcatgagttttgtaccttcatggttaaatttattccta

SEQ ID NO: 118786 - DNA, 502 bp, Homo sapiens
ttgtaatagctttattgagtcataattcatattccatacagttcacccttttgaaaactgcacaattcatttgtttttaatatattcacaaagttgtttaactaccatcacaaacaattttagaacactttattcacctcaaatagaaacccctttaactgtcaccccctaatccttcatcctcctcacccagccctaggcaaccactaatttctgtctctaaagatttgcttcttctggacattttatataatggagtcatacaatatgtgtcattggtgactggcttcttttacttagtgtaatggttttgaagtttgatgtcatacgtatcatttcattacattactttttattgccaaataattcattatatggatatgtcacattttatttattcataagttgatggaaatttggattgtcccacttcttggttatgaatgttgctacactaaacatttgtggacacatttttgtgtggacatatgtttttattttt

SEQ ID NO: 118787 - DNA, 416 bp, Homo sapiens
tcgctattcatcggcacctcgctattcatcggcacctcgcaattcatcggcacttcgctattcatcggcagtcatgggcatgctagatcagcctggtttcagtggagaggtggagacaaaagcctggttggaattgattcaaaagagagaggaaggggaagaaatggagacagacaattttttttgagtttttccttaaagatatatgcagacatggagtggtcactagggagggatataggatcagggaacataattttttaaggtagttttgacagcatatttgaagattcttatgaataatccagcagagaaaaaataaattgatgatgtaggagagtgaagaagtggagtgtacaggcataggtgccgatgaatagcgaagtgccgatgaattgcgaggtgccgatgaatag

SEQ ID NO: 118788 - DNA, 358 bp, Homo sapiens
agactaaccaagaaaaaaaaaagacccaaataaataaaatcagaaacaaaaaaggagacattacaactaataccacaggaatacaaaggatcattagaggttatcatgaataactgtgtatccaattagaaaacttaccagaaatggataaacttctggatagatataacctatcaagattgaaccaagaagaaacagaaaacctgaacagaccaattacaagtagcaagactgaatgtgcaataaaacgtctcctataaaattaaagcccaggacccaatggcttcattgcagaattctaccaaacatataaagaagaactatcaattcttttccaattctctcagaaaactgaaga

SEQ ID NO: 118789 - DNA, 242 bp, Homo sapiens
tcttgttcttactggatctttcctcttggctctgcaggtttctgttaacatgatacagccttcacaaaattgtaaggtataaagtaacagatttttagagctaacagtgacttttcggatcacctagtcaaacacctccattctacatttaacccaaatgccgctcaagccttctatccatcctgtcgcctctttagtattcttcatgtcctcagggattatatgctcatggttattcccag

SEQ ID NO: 118790 - DNA, 536 bp, Homo sapiens
tcaggagttcgagaccagcctggccaacatggcaaaaccctgtctctactaaaaatacaaaaattagccaggcatggtggcacgcgcctgtagtcccagctactcaggaggctgaggcaggagaatggtttgcacctgggaggtgaagtttgcagtgagtcaggatcgcggcactgcactccagcctgggcgacagagtgagactccatctcaaaaaaaaaaattttttttaaacatggagaattgcaaaagggaatagcctggagaatccccacatccccatggccttgctccatcatgatattgaagtcactcttttggttgtgtttctctaaattctatgaggacagcaactctcttcattatcctctatatcattgctatgccctggtgttgtgcccggggtacaacacgtagtaggtgttcgataaacttgggttggataaatggaagaatgaatgaatgatgagctggtgcacttagatgtgatttataagacttctagggggatcaccggctattacttagaactatat

SEQ ID NO: 118791 - DNA, 413 bp, Homo sapiens
ttgtctggctgctgatagggttgagccattggtaggtaccaacagaaactctgaaaagtgagaggagggtgaattcaggcagggggtgtattccctagctctttccctgtcacgaagtagctgtgtccctgcattgaaggctacacagtttctcttgggatacccttacattttctttctgggttccaggaatcactggctcccttttgtcttcagatcttgggaatcatggttctctgctattgctagtccatgttctgcatcatttcctgttggctgttcttgatgctaactactctaactacactactataaaaatctcttttaaaaatgaagcaattgtcctatatgagggcattgcctgttttctgctgggactctgacagataaaatatcttttactgaaatagatt

SEQ ID NO: 118792 - DNA, 292 bp, Homo sapiens
gaattccaatctctaaaggttattttcttggtggaaagcagcaggaagcaccacaggtggggtaaagaaaagctacagcaatctcttttctcaggctaatgccttgggaaccctgaggggtttctttttctttctaaccagtccctcgcctctcctttcgctgttttcttctcatatacaactggtgaggaaagtcattggaatgatgactggggatagtagggctaggttggacaccttttaataagccctggagggtatgaatgttccaccaatatttatgtctccaatt

SEQ ID NO: 118793 - DNA, 716 bp, Homo sapiens
tcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaa

SEQ ID NO: 118794 - DNA, 498 bp, Homo sapiens
ccagttgggaatctcctgcctcacagacctggtggtctagaggtactgtggtataagtagaaacgagcagctggacttagagacaggcgtcctgagtgttgatgccagccttaccctgaccctgtgtgtggcagcagtgggtcggtcaaacctttccaagcctccgcgtcctcatctgaaaatgggaatgaggatgcctatccgaggtgacttagcagaggatgaagcactcccgtgagtgagctgcgcacagtctccttgtacaagcaggacatttctccgtttctccttttctctgcccgtaggattgactttcatcttgcctggtaataagccctcctaggaaaacaaattactctgaaaatttgtcattttggtgtggtgaattcgttcttttattcatcatccaaaaagttccattgtttgagatgattcaacatgatttggaaaccatggggtaagtctctgaggaacaagaagacagaagaaagaacgcac

SEQ ID NO: 118795 - DNA, 263 bp, Homo sapiens
gtacattcaaactgtagcactctacccagcttccacagctgtcatagtcacagccaatcgagtgttcttaatacaccacccattcacccttggtatatttcaaggcaaattccaggcatgccgtttttttctgtaactacatcagtatgtatatgaaaaagaaaagactctctttgaataaacctagccacaataccattatctcactttaagaggtgattaacaattccttaatatccaatattctgttgttgttcacattt

SEQ ID NO: 118796 - DNA, 590 bp, Homo sapiens
ggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttt

SEQ ID NO: 118797 - DNA, 490 bp, Homo sapiens
tctattaattgcacgtcacttattttggggataattagaaaaagggggaatgagaggttgggaatagaaaaagggagagaagcaaagggcagaaaagaaatggaagcttttgctttgaggtcttgtgggggtgggggtggaaaaaaaagtgtaggagaagcctgagcccaaaagcttgcctcctccctctacagggaaagggagttgagcggagtgtaagagggtggatggcatgcgcttctgacctaccaaagcatctggaaatttcagactgctctttgtctctgagactgtgttgggcacagcattgaataaagtgtggatcaataagtatgtgaagtgctggatatgttaattcactggatttaatcattcctcagtgtatacatgtatcataacatgtacgatgtaccctgtaaatatatacaactattgtaatttgcccattaaaataaaacaaaatataaataaaacatgagcagtgatgatt

SEQ ID NO: 118798 - DNA, 234 bp, Homo sapiens
gctaaaccagcccctggagccactggagggtgacaaggagactcattcacatgtgatcagaccagaagtagcccagcagggcatggcgttgctgcccctaggaacagcctactttttggatgtttgggtctctgcttccagcttcgaactccccaggagcccacacatgtccaatcccaaccttccttccatctaagcttccccgtcgggctagtcgggggggtaccgagctcg

SEQ ID NO: 118799 - DNA, 397 bp, Homo sapiens
aattctatctactaaccttgatcaggaggctagtgatactggctgtgtaaaacaaaacaagacaaaataaacaagggaaaaccacagcgcatgtggccactttgttcagaaggtgacaccactgaatttagtctgtgaaggtcttgtcacatgaaagcctagaaatagctatgacctaaacatgagagtagaagacaatccggttagaaatgaatgaacacattccattgtgcttgtatagtgtttaaaatctattttggggcaaaaggggtattgtaaatactttcccttgttcataactatcataacccaaactttctggctctcaacattttccagtgaccctgcatgcctataattttttacacaccacctgacctggcaagaattatgctac

SEQ ID NO: 118800 - DNA, 427 bp, Homo sapiens
gcacgagatgagacattatgtattgatttgaatgttattagacctgtaacataattcttatctgatgaatatatgatgaatatattccttgttcaaaatgagtcataaattcaacacatctctacatctatattatgcccatttaatttctttcagcaatgttttgtagtttttggtgaacaggtactttatgcatatgtactttatatttatctctaagttttatatttctgatgcccttttaagtgacatttttatttcaatttacaattgtttattcttagcttatgggcacataatagatctttgtttgacattatatcctgtaaacttgcaaaacttattagttccatcagttttttataggttatgtaggattttctttatagatgattatgttgtcagtgaataaagacatttgctttta

SEQ ID NO: 118801 - DNA, 117 bp, Homo sapiens
gcacatgagggagagaagaatcattcttttcttttgcagatgttggagatttcttctttttgatgtctttaaagtcttcttttcctcacggttgcttcctagctcctcaccgggctt

SEQ ID NO: 118802 - DNA, 400 bp, Homo sapiens
tcctaagtccccaatgtgttggtatttggatgtggggtctttgagaggtaattaggactaggtgaggtcataaggatggacccctgatgatgggaatcaatgcccttataaaaagaagaagaggccaggcgtggaggctcatgcctgtaatcccagcactttgggaggccgagccaggtggatcacctgaggtcaggagttcaagaccagcctggccaacatggtgaaaccctgtctctactaaaaatacaaaattagccaggcatggtggcacatgcctgtaatcccagctactcggaaggctaaggcaggagaattgcttgaacccaggaggcagaggttgcagtgagctgagattcacgccattgcactccagcctgggcaacaagagcgaaactcc

SEQ ID NO: 118803 - DNA, 414 bp, Homo sapiens
tcctaagtccccaatgtgttggtatttggatgtggggtctttgagaggtaattaggactaggtgaggtcataaggatggacccctgatgatgggaatcaatgcccttataaaaagaagaagaggccaggcgtggaggctcatgcctgtaatcccagcactttgggaggccgagccaggtggatcacctgaggtcaggagttcaagacctgagcaccacctgatgtgacgagaacctgattaacctttataaagcaggttaactttaacctcttccgaactcaccttactcatctttgaaacggaaaaaaaaaacaaataaactgctgtccgcccatcccaggaccataaatttgtggccttgaacttgcttacctcgactgccctttccttctccctcacatagggatcgtcta

SEQ ID NO: 118804 - DNA, 436 bp, Homo sapiens
gtattacttttgtcattatgcaacattaatggcagaaataatttatgcagggggttatttggcatttattttagagtatataaaatacattttgtcaatcaaggaagactttagttctcttttatgttatacaatctactttgattttttctttctttgaaacagggtctcactctgtgagactctagcgccaggctagagtgcagtggcacaatcatggttcactgtagccttgacctcccaggctcaattgatcttcccacctgagcctcctgagtagctgggactacaggcatgtgccaccatgcctggctaattttcatattttttggagaggtggggtttcaccttgttgcccaggctggtcttgaattcctgggctcaagtgatccacctgcctcagcctcccaaattgctgggattacaggcatgagcc

SEQ ID NO: 118805 - DNA, 217 bp, Homo sapiens
gttctttctggtgccctaccacctgtttccccaaacaaagacatcaggacccacatacaataaatcactgaagagaggagagggggcagagccttgtttgcacactctccttagctctgaatattctactgcaggcctccaggaggctccaaggaacccagcttgaaggtcattggtatgatccagtgcttttatttacatacgctttttttttttc

SEQ ID NO: 118806 - DNA, 278 bp, Homo sapiens
tgggatggaatgggggtttgataatacctccctcccacctcagcctcccgagtagctgaaattacaggtgcacgccaccatgcccagctaattttcatattttttgtagagacagggtttcaccatgttgcccaggctggtctccaactccggggctcaagcaatcctcctgccttggcctcccaaagtgctgggattatagatgtgaaccaccatgcccagcctaattttttcaaaaaggccaggtggaaactaaaaatctgaacttttggtgtaag

SEQ ID NO: 118807 - DNA, 557 bp, Homo sapiens
tttcagtaacatggtcttgggatgacagggctcaccctgcagagacccaaatggaggtattcagggcccattgaaaaaccatctgctgccaaggctctgctgctgatctcatgcaacagaaaccagagtctgtcgcagctctgctactcactgggtgactctgggcgagtggcaggctctctggtcctgtcttttctgatgtggagaatgactagctggtgcccgaggttttcctaaagctatggaattccatcattttataaatgactccaatgacgaatcctactggcataacatctatggtttcaccaactcttagcagtgatctttggttccagattcatgtgaaaagccaagaaccgctttccacaatttgtcttgtcatgactctccggctccatattttaagaagcagtctacactagcccttgaatctagactctaattttttaagatacaaaggaaatcattaagccccagaatattagtagaatatacggcaatatggatcaagtaatccaaagtattagcaatgttgcaagaggctgtcacctagc

SEQ ID NO: 118808 - DNA, 200 bp, Homo sapiens
ttgtgcctggcttttcacaggtctgggtttatggcattcattggggctttttcatttaagaggcagcattcaaaagatgccataataaaagatgctataaacacaagaaaatgaagtcatctatctttctagtatttgttgatgtagagacctgagcaagccggagacctgaggaagccaggagacctgagcaagccagg

SEQ ID NO: 118809 - DNA, 468 bp, Homo sapiens
tcctaacctagtcttgggtggaattctggaagcactttcctgaggaagtcacatataagctgaaaactggaatatgagaaaagtaccccaagcaaaaagggaggcatgggggtgggattcagagcaaacaccctgcatttggaaggaccagtgtcaggaactactgtgttttactgattaattataagatgcattttccatcacattaaaaatccctgaaatgaagacatgtcctacaattgatgacatctgaaattcacggaatttaaaaaaaaaaaaaaaaaaaaagaccagaaacattggagagcagaaagcgagggggaaaatgacgggggtgatgcacaggggcccaccgtgcagagctgcatagggcagatatgaatatcggactttgtcctataagcaatggacagtttcagaaaagtttttgcaaatgagtgcaatgaatagataagtttattaaaattt

SEQ ID NO: 118810 - DNA, 1088 bp, Homo sapiens
gaacacttttgttttcttaataaagaaatggaagtttgagtaacttacacaaggttactcatcaataactgattcaggatttgaacccaggctacttaattcagaagagcccatacctaccactcaaatggattgccatccaacattcattccaaactctaagcctttacttttgaaatccatttgtcctgacatttttataaagaagtctttaagactagaaggaaaaaatactctgaacataaatttatttactagcaggaagataggaattagatgaaatactttcattttgcttcaccctcttagaggtctacaacaggaaattggagagatattgccgatgttttagtagattccatagaaagttcatatacatccaattttcaatttagaaagaggtaaggaattggattgttttcatgacatttttctaagggaagataagagaggaaataaaggggtgaaccaaaagacatcagatataaagtgcctgtttactccctctgagtgactcacattattctactttaaaaacatgttaggaattcatctaatcttctttagggcacacccacttccctctaagcttagtatagttcacagataaattggtctttctcagctcaccacttctgctatgtagttaccttgccagtggtgatttgatgtcccgtggctggccatgctcttcctcttctgtctcaatttcttccttatatgtataaataaatacctgactcacaagtgttttgcctaaccctgtgctttccattgccttggcaatatttcttgagttgaaaaagccatctaaggtgctaagttaaaagaaaaaaaaaaggccttataaggtactcaggatctacacgaggttgttaattcatgttttgctttaattggttactctgtttcctatttcctcggtttccaatacttgtttgtagaaaacatcagttttgtgtgtatttgctcttggtcctaaagttaaggacactatacgcagagttaattgaccttcatttgtgtgccagcattctggggtgacataatgcctgcaagtgtcatattcttaatatgtgagggggttc

SEQ ID NO: 118811 - DNA, 287 bp, Homo sapiens
cttccccccagcctggcagcagcgtcccagcgcctccacattgcccctctcacctcccagctctccacgccacttggctctgcagcgacccctcctagacgctccctggcccctcggcacccagaatgccacattcttgtgtttttttcctccttctttcccaatccctctcaaccatgtatttatttatatatgtatgtatttttttatttattatttatttattgaaacccctactttgattgacaaaggaatcaaggtagatctgaccagtattcccctctctt

SEQ ID NO: 118812 - DNA, 434 bp, Homo sapiens
tttttaaaatccctaataaaaacttgctgattttgcggctcggggtcgccatcatggtcctaccaatatgtgatgacacccctggaggcccagctgtaaaatttctctgtttgtactctttctctttatttctcagaccagctgacacttagggaaaatagaatgtatgttgaaatattgggggctggttcccccgataaaagtgaaaaggtgagtgaatactatgtatctgaacagttaaattttggctctgctcaggtcatatcacattagttttataaaagattttagctaaatactggttttccagcacatgtaaatgaatatgtagctgtctactccttttcctctactcatccacactcctttcaactttaatttctttattcctgcctgtatctttccagcaagccctaattcagaagtgggaagcc

SEQ ID NO: 118813 - DNA, 343 bp, Homo sapiens
aggttcctgccacatttgtgtccagcacaacagtgagtaaagaactgggaacatgttctccctcccaattcctcccgttttccttcccaaggcaggcaggacacattgtctcacggcgagctggccttaccctgaactcagagcatcagcaccccaaagctgcagtgaggaggaagagactgcccacccgcgaaaaggcccctcagtcttcagccaacaccacaggcacagcttcagccctctgactcttgctgaccacgggttaccttggatcttctctcctttgagggcaactgagccacatttggctcctttcagaacatagaatcttggctttgtcttt

SEQ ID NO: 118814 - DNA, 416 bp, Homo sapiens
ccccgtactagtcccgacagtgctgagtgcgagctgagacgggcgcagagcgaatggtgggaggctttgccctggggcggacatgctgtgtggggtctgctgtcgggctagtcgggggataacacgttcgcgagctgtcgggctagtcgggggctgtcgagctagtcggggctgtcgggctagtcgggggctgtcgggctagtcggggctgtcgggctagtcgggggctgtcgggctagtcggggactgtcgggctagtcggggccccgactagcccgacagcgcgacccgcccggggcgcactggggacatgtccgccccgccccttgacagtttagataggattttcaagtacatccacgattgtatttgctcttcttagcccctgtgcggaaggaggggggcattgcagttac

SEQ ID NO: 118815 - DNA, 481 bp, Homo sapiens
catgatgcatttcagtagctttcaatcaccaatggaataaagccccacccttcgcctgtcattcctacttgccacggctttcgtaagccatgtggagggaatgggacttttcatatattaagggggtcttatgtgccaggctttgcagggagcactgctccaaagaagtagccaccctgactaaaagcatggatgctggagccagactgcctgggttcaaatcccagctctgccacttaccaaccatgtgactttgaacaaattatataatttctctgcatttctcattttcgaaacagggatgagtactgctataaacatttgtgtccacccccacctccaaattcatactgaaacctaacccctagtatgatggtatttggaggtgagttctttggaaggtaattatgtcataagcgtagagccctcacaaacagtattgcccttataaggaagccccagccaggtgtggtggctcacg

SEQ ID NO: 118816 - DNA, 414 bp, Homo sapiens
cttatgggaaacaccgtataaagttggatctaaatccaactttagattggttccttttttttaaagattgaattctctagaagtttatttttttttttctattagtcactctctggtctctgaaaattatttttctgttttgtccagagtttatagttaggcagataaatctgatataatattctgccattacccaaattggaacttcagtaattgagaaatgagcaaataaagtctaaaaataaaagaacaaattatctttagtggaccaggttgaaagagagattgtatacagttggaggagggtaggatatgaaagacttcatggaataggttggtattcaaagtgaagcatgagggattatttggatggacttccatgtgcagagagtaggagagcatttcaagaggaag

SEQ ID NO: 118817 - DNA, 219 bp, Homo sapiens
aactaaattcattgtacctccactaccttctaccagcacacacactaagtcttcctctgtttcatgattatcctctgggcccctggtttatacatagtctaattcactttaatttccccctttcctcacaccttatatccattcagtagcacagtcctacttgttctaatgtcattttctctcgtatctattccttcctttcaatcagcacggaagtat

SEQ ID NO: 118818 - DNA, 237 bp, Homo sapiens
cctctctctcccgggttcaagcgattctcctgcctcagcctcctgagtagctgggactacaggcgtgcgccaccacccccagctaatttttgtatttttagtagagacgggatatcaccatgttggccaggatggtcttgatctcctggccttgtgatgtgcctggccggaattctttacctaaacaatcatatctgtgaacaaagacagttttttttggagactgagtttcgcctt

SEQ ID NO: 118819 - DNA, 251 bp, Homo sapiens
ctactcaacagggcttcccgcacacactccttccaggccagtgacaatgtggaggacaggaacaaagcctgccttctccacttcccttcctagaaagccatcatcacccaggaatcaaacgtatcattcagttgctgcgtctcatcaaatctctctctgggatctttaccctgtggcgcccccatttcaaatgctacgtcacccaggtcgagagacaactcactgtagctgctttgatctgctgctgcagg

SEQ ID NO: 118820 - DNA, 815 bp, Homo sapiens
agaaattaataacagaaagaaatccacaaaattcctaatacttagaaattaaacatcacacttctaaataatcactgtatcaatgaagacattacacagggaaattataaagtattttgaacaggctaaaaatgaaaacatgacatattaaaacttatgaggcagctaagatagtttcttcaaggaaaatattagaaaagaaagtactcaaaccaattatctaggttcccatgttaagaaactagaaaaataagagctaattagacacaagtaagcaaaacaaaggtaataaagttaagagctgaaatcaataaggtagaaaactggaaaacaatacagaaaatccatgaaaccaaaacctgggtctttcaaaatgattaataaaattaataagcctccagccagtgatcaggtggaaaaaaagagagaagataaaaatgatcaatattatatgcagaagagtagacatcactgcaaatcctgtggtcattgaacggctcataatattataaagaattttataaattctgcaataaattctgtaatttgagtgaaatggagaaattctttgaaagacacaatctaccaaatctgaagaagaaatagataacctgaatagtcctgtatctattttaaaaagtgaatttgcatttaaaatcctttgaacaaaggaatctccagtcccaagtagtgaattctaccaaacattttaggaataaacaatatcaactctatgctaattagaaaatagaagaaaaattcagaggaaaaaaagaaaagaaatgctttccagctcatgttaacaggctagaaac

SEQ ID NO: 118821 - DNA, 803 bp, Homo sapiens
cccatgatgttctgcccaacagccaacaacagtctgccctcccatgatgctcttccctagaaccaacaacaatctcccctcccatgatgaaggaagcatcccgtgatgctctgctctacaatctgataacagccctctttcctgtgatgctatgctgtacagcctgacaacagtcttccttcccatgatgacctgccctacagcctgacaagagcctcccttctcatgatgccctgcccaacagctgacaacagttcgccctcccatgatgctgtttcccagaaccaacaacagtctgccctcccatgatgctctgccccacagccaacaacagtcttccttcccatgatgctctgccctacaaccgacagccacacctcccttggcaccaggatttgcctccagtctgacagccttccttcccagcatgccttgccctggcctgggcagtgttgtccacacccacatgagggtggtgtcggtgctgcccacgtcccagctgtgaggtcagccagccacagaagcagcagctgtggggacaagcttctgtgcgcagctctgtcgttcagcagctgtgtccttcagaaagccctggagctctctgggcctcaggtggcctttcggagtgtagacaacgccaacagctctgaccacagacagccatggcaggcaggtctgtcagtgactaaggaatatgcccagcagagacacggcaagaccacaaaccatcttgggaccctgagaaagaagacacggtgggcggattcaacagtcttatggggtcacaatgcacagggcttggt

SEQ ID NO: 118822 - DNA, 426 bp, Homo sapiens
gaaatcttgcactgaaaacaatcctataattagaacgttatcttgaagcctctgaaattgttttcaactgagttaggaaaatcaaccatcgcagtattcagttccaattatccacctcctcaactttttttggagacagattttcactctgttgcccaggctggagtgcagtggcactatcatagctcactatggtttccaacccccgcgctcaagtgatccttctgcctcagcctgctgaatagatgtgactacaagcatgtgccaccatgcctggctaattttttgttttattttttgtaaagaggggtctaattatattgcccaggctggtctcaaacttctagcctcaagcgatcctcccaccttggactctcaaagggttgtgattataggcatgagccaccatgcctgacccactttatt

SEQ ID NO: 118823 - DNA, 256 bp, Homo sapiens
cctgcccccatcagtttacaaaggtccagaaatctttcacaatttaatgagactgaggaaaacatgcacctgctcagagttctgccaggcattagatgaccaaaaagctcaagtgggtaggttaagcttttactttttattttgaatttttgttccactggaccaaaatacctaagtagcttaataatctacatctacaaggaatattggtttgcctgccaaaggcactaagtgtctgctaccctgctttcttcac

SEQ ID NO: 118824 - DNA, 140 bp, Homo sapiens
tttttgtagacttccacacatagcctcacagtggtggttgctgggtcgcgttacctagttggctttatggcaccagctgtaaattacagccctccctgttccatcctaagagacctgtcgggtagacagcaggtgaaggc

SEQ ID NO: 118825 - DNA, 139 bp, Homo sapiens
ctggaatgaggaccaacatcaggttgaggttcaggataggggaagcccgggatgagtgaaaatatgttaggcacatttgttaattttcaaaaagctaaaagtgggcagggcatggtggctcacatctgtaattccagca

SEQ ID NO: 118826 - DNA, 172 bp, Homo sapiens
ttcagctaaggcagtttaattccactaaaaatctctgacactttgtatgtgtctccacttagagcaaaatcatcttgggcataatcaaaagtagatcagttttgtggaaagaatgagaaagtgtttactcagggagaagggaaagacttggagcagtattggcagctacgta

SEQ ID NO: 118827 - DNA, 380 bp, Homo sapiens
aaagtactattagcctctcataaaatactgatagattttacagttgtggtcagtgtttacttttgaccatcagttaccagtaacttctttcatggttcaataaaatcatagctttagtttatggcaccttttcaaaacttcctttggcttttctttgtgcttaatttaggtagttttgcttttagctcacttcctaattctcttttttacacaattcattttggtcctaatttctttactttactatataaacaaggtgctgaaatgtgtgtgtatgtatttaacttcctctacccatttgctcttggttatttcttcagttatgatattctggatttgccagtcattgtccgtcctcctgcctctattactggcataat

SEQ ID NO: 118828 - DNA, 446 bp, Homo sapiens
ggtcagaaagggcattgttaaaggaaggagatggtagattttgggttctgggttctaggttctaggctaataatttactactttggtatgttgccttgaggctgacatttgctgctctgctaagactaaagctggccctttccaatcaaaagtgttaaaagctggctgggagccatggctcatgcctgtagtccagcactttgggaggctgaggtgggtggatggatcccttaaacccaggaattcaagaccagtgtagacaacatggcgaaaccccatctctatccaaaaatatacagaaattagccaggtgtggtggtgtgtgcctgtggtctcagctactcaggaggctgagatgggaggattgcttgagcctgggagttagaggatgcagtgagctgaggtcgcaccactgcactccagcctggacgacagagtgaggccct

SEQ ID NO: 118829 - DNA, 297 bp, Homo sapiens
gatgagttaatgggtgcagcacaccagcatggcacatgtatacatatagtaactaacctgcacattgtgcacatgtaccctaaaacttaaagtataataataaaaaagaaaagcaacatttgtacccttgtagttttcttaaaccacaaatccaaattccaatcctagaatgtaactccaggatatgaaagatgggaaagaataatattacagtgtaaaatttgaagaaaactaagagaggaattttcatacttcactaaattctcacatctagtagttctgggtcagtgcccttat

SEQ ID NO: 118830 - DNA, 457 bp, Homo sapiens
ccagattggagtgcaatgatgtgatctcggttcactgcaacctccgcctcctgggttcaagtgattcttctctctcaggctcctgagtagctgaaattacaggcatgcaccaccacaccctgctagtttttgtatttttagaagagacggggtttcaccatgttggtcaggctggtctcaaactcctaaccttaggtgatccacctgccttggcctcccaaagtgctgggattacaggtgtgagccaccgtgcccggcccaaatttcttcttgaaataacattttaaatgaataaaataaaagatgtatactcaacaaattaggaacagaaagaaacttcctcaacctaaatgaagagcatctattaacaactcacagctaatactttatgtgtgtgtgtgtgtgtgtgtgtgtgtgtgtattttatatacctatataacatctctccctatggctt

SEQ ID NO: 118831 - DNA, 771 bp, Homo sapiens
tttgtaggtgatttgaatgtaaaatcctgaaaaagattgctaattttttgagtgttgagagttttacaattagaggtattacagttagatatttgaggcatttggagtgaatttttgtgtttattctaacctaaaattcttaattcttttcatgggaaaatccagttttcataccaccctctttggaagacactacaatttagccatgttatattgatggttctcatgctaaaaatcagcttgtcatcaatatgtgggtttatatctaagctctatataggtatttaagccaaaactttctatgttttaataaatgttgaggcctggaagtgaaatgcctaaagctttcttcttgccttgttacagatattgtaccaaaatattctaaccttttactattgagtgtaataatagctgtggcctttcttaacggcttttattatgttcaagttgttttcttgtcttcctactttgttcatagttttaataatgaaactgattttttttcaaagtctttttctgtgtctgatgaaatgttactgagatattttttctttagttttttaatgtgtaccaaactgattgatttgagaatgttgaatcaagtatgcatctcaggaagaaatttgagttggtcatggtgtatgtcttctaaaacactttggagcttagtttactattgttggggattacattcatgtctactaatgatattggtctgtagtttcctttattgtggtgcctttgtctattactggtaatactatcatg

SEQ ID NO: 118832 - DNA, 322 bp, Homo sapiens
aaaaaatgactaatacagggccattattaccaaaccccaaaattttcaggcctcacttttgacaagtacagaccataaatatgtgatcatttgcctctctgaaacactctatacaccctattttaagaaagaccattgcacttcctatgcaaaatatatcttagggagcagcaccagaaggggcattatactttacgtccaatatcccgtaggctccattttatctgcccccgtaggcctccactgaacatactgctgtctctacctcaaacccaacatctaaacttgaactaagcaaccgcttcataaaactagctccctt

SEQ ID NO: 118833 - DNA, 349 bp, Homo sapiens
gggcatggtggcgggcacctgtaatcccagctactcgggagtctgaggcacaagaatcacttgaacctgagaggcgtaggttgcagtgagcgccaagatcacatgattgcactccagcctgggcgacaagagcgaaactccatctcaaaaaagaaaaaaagaaactttgtaagagaaaatctgaaatattctagaaatttttttttgtaacattggagtatactaaagcacactgaagtcgtaaaaaatcccatctactttatgctgaattccatcaaactcaattagtgattattcacagcctaattatcctcttaaggtttagtttactcctgtctcttttaaactt

SEQ ID NO: 118834 - DNA, 599 bp, Homo sapiens
tgaagacagggctgcctgctagaggggctggaggtgagcagggcatggcactgggaggtgggtccatgggctccaggagagaagggtcgctgggaccattttctaccgacggggtcacgaccccagccccagccctttatggagatctgaagccacgggaaggaagggtaggcaatgggatgagaaacagcaccttcctgatcctaagtcaccacccgctccatctgagctacatcaggaaagcaagtaattggccgggcatggtagctcaggcctgtaatcccagtactttttaaggctgaggcgggtggatcacctgaggtcaggagtttgagactagcctggccaacatggcgaaaccccgtctctactaaaaatacaaaaaattagcagggtgtggtggtgcacgcctgtaatcccagctactcgggaggctgagtcaggagaatcgcttgaacctgggaggcggaggttgcagtgagcccagatcgtgccactgcactccagcctgggcgacagtgagactccatctcaaaaacaacaccaaacaaacaaacaaaaataatactgcgatttcctagcattgcccagtgacttac

SEQ ID NO: 118835 - DNA, 320 bp, Homo sapiens
aaaaaaaccagtacaacaataaaaaaaaaacaaaatttaaaaacacaatataacaactatttacatagcatttacattgtactaggtattttaagtaatctagagatgattcaaagtatacaggaggatgtaggtaggttatatgcagttactatgccaatttatatagaagatgggaacatatgcagattttggtatcaagggaggtcctggaaccagtctcccacagttgccaagagacagctgtatgctgagaactttactgcactaccacagttcagactgttcaacttaggcctaggcttctgcccttcatggtg

SEQ ID NO: 118836 - DNA, 357 bp, Homo sapiens
acatggagagggggcacaaagactgagcttctcttcagtgcgacctccatgcctcacccgtgccttttcttccctccagccacaggcctctgggagggagaattcgcattgtatctgcctttctcaaacctacttatgcctcagctaccacgatctgtctccctctaacacccgacctcgtctcagtgccagagcccctctcaccccacaatgccccacttctggcttatgtgatataaccgggtggtgactgtctccttaccttcctcagtctgcttctagctcctccggcacctgccctatcagtcttcccgggggtcagcctatggtgagaggggaagggctcttctgtacctt

SEQ ID NO: 118837 - DNA, 277 bp, Homo sapiens
aggaatatgaaataaccttatggctgaatcagggtgaaggggaagcttgtaagcatggaagacgctctactcaaactaaaaagttcaagttctgatccagcagatgaagagggaggcctgagaggctgctgttctaactcgctcccaggtgacttccatgctgctgatccgcagaccacattttgagtgcccagattgtagtagatgaggttgagtggacaggctggggccagattccatggagcctcgtgggccgtgttaaggatttttatttttt

SEQ ID NO: 118838 - DNA, 397 bp, Homo sapiens
gcaatctcggctcactgcaggctccgcctcctgggttcacgccattctcctgcctcagcctcccgagtagctgggactacaggcacctgccaccatgcctggctatttttttttgtatttttagtagagatggggtttcaccgtgttaaccaggatggtctcgatctcctgacctcgtgatccgcccgcctcggcctcccaaagtgctgggattacaggcgtgagccaccgtgccccgcccatctcttcatgttaagtgccttaatttaatcaaatctgtaaagtcccttttgccacataagagaacatgtgcacagattgtggggattcagggccattattctgcccctacgtgtggtcattggctgcctggcagatgacctgcagcctggtttgg

SEQ ID NO: 118839 - DNA, 317 bp, Homo sapiens
ggaacttgtccgggtgaggccagtaaccacccaaagaaggcctttgtctagaagcctccttttaatatgatagaaaaaaaggatttgaaacaaagatttaatgaaagaaagaaaagaaggaaaaaagaagtagtatctcagctaagacaaaacatcactcagatgaaacaattactttgatctcaatacatttgggttttccttctgttgttaatcatagctcttgaacattatccatttcattctaatgaattatttaacattccattccttcaacatacatgcattgagagatagtataaataaaatacatgtta

SEQ ID NO: 118840 - DNA, 347 bp, Homo sapiens
ctcagcctcccgagtagctgggactgcaggcacatgccatcacacctggctcattttttatttttagtagagaccaggtttcaccatattggccaggctggtctcaaactacagacctcagatgatctgcccaactcggcctcccaaagtgctgggattgcaggcgtgagccacagctcccagctgttactgattaattttgaattgagcttcagccaatcacagacacccagctagctgattgattatataacaagagacctcccattgaactgtacggaaatacatagctatagttaatcaagtaattttttttactttgtttccatgttcagactataaaagcc

SEQ ID NO: 118841 - DNA, 315 bp, Homo sapiens
ggaaagaggcgacgaagctgctggagaaaccccagctccgccaccgatagccctcaagtcctcctctctccaggaggggcccacactcaccgagcagctggtctgcccacagtcgcctggagaagcagctgagaacctctgcagggccctgatccccaagacctagccacgcacattcagaggcctgctccctccgtcacccagagcaggggggttaatgttttggagacacgaagccccctgagaacacgaggaaagcagaatccccgagatacacagactttgcaaagctgcacacagcacaggagactcctg

SEQ ID NO: 118842 - DNA, 411 bp, Homo sapiens
ctgtggtcgatctagaggtccccctcggttctaccttgtcagcaaatcaaaaccacgaatgaaataccatctcacaccagtcagaatggtgattattaaaaactcaaggtacaacagctgctggcttttgtataggttagacaggaatgggggttttggtagattattgtggggcttagaagcttggtgggatgtgctgatctctcgagtcttagtaggaaagctgagatgtcggttgagacatggatagagaatctgaaaataatccctcaatctgaaaataataatccctcaaatatcactttttagtttataacaaaagggctttcacatgtgttggctcatctgtcctccatagcaactgtgtcaggtagacattttctagataagaaaccttaggccgaattgtgt

SEQ ID NO: 118843 - DNA, 1008 bp, Homo sapiens
gaaaaaaaaaaatcttaaaacacacatgaaagtacaaaagaccctgaatagtcaaagcattcctgagcaaaaagagtaatgctggaggtatccatactacctgacttcaaaagatactataaaactatagaaaccccaatagcatggtactggcataataacagacacacagaccaatggaacggtaaagagaacccagaaataaattcacatatttacagtcaactgattttcaacaaagtgccaagaacattcagtaaggaaaggacagtctcttcaataaatagtgctgggaaaactggatatccatatgcagaagaatgaaattaaacccctatctcttaccatatacaaaaagcaaatcaaaatggagtaaagacttaaatgtacgacttgaaactatgaaactactaaaagaaaacattggggaaacacttcaggacgctgttttggtcaaagattttttgtgtaggacttcaaaagcaccagaaacaaaaacaaaaatagacaaatggaattacatcaagctaaaaagcttctgcacagcaaaggaaacaatcaattgaatgaggagacaacacacagaatgggagaaaataatgtacaatctctccatctgacaagggatgaatatccagaatacacaaggaattcaattcaatagcaaaacaaaacaaataatctcaggtcttacgggacaatacagaaaaaaaaaaacaacaaaaatatcaatatcctaaatacaaaaaactcttaaataagagcaaaaacagaaaaataaaagacatcaagacatatttcacagaacaggaatgactaataaacatgaaaatgtttttaacttattaatcagaaaaatgcatgttttcttttatagtgaagtgagtgctgtcacattcataaggaaaatgcaatttaaagccacaataaaataccattttacacctaacagattggaaagaattgggtcttatgatagcaagtaaataagaaaccatactgtaaagc

SEQ ID NO: 118844 - DNA, 1232 bp, Homo sapiens
gaaaaaaaaaaatcttaaaacacacatgaaagtacaaaagaccctgaatagtcaaagcattcctgagcaaaaagagtaatgctggaggtatccatactacctgacttcaaaagatactataaaactatagaaaccccaatagcatggtactggcataataacagacacacagaccaatggaacggtaaagagaacccagaaataaattcacatatttacagtcaactgattttcaacaaagtgccaagaacattcagtaaggaaaggacagtctcttcaataaatagtgctgggaaaactggatatccatatgcagaagaatgaaattaaacccctatctcttaccatatacaaaaagcaaatcaaaatggagtaaagacttaaatgtacgacttgaaactatgaaactactaaaagaaaacattggggaaacacttcaggacgctgttttggtcaaagattttttgtgtaggacttcaaaagcaccagaaacaaaaacaaaaatagacaaatggaattacatcaagctaaaaagcttctgcacagcaaaggaaacaatcaattgaatgaggagacaacacacagaatgggagaaaataatgtacaatctctccatctgacaagggatgaatatccagaatacacaaggaattcaattcaatagcaaaacaaaacaaataatctcaggtcttacgggacaatacagaaaaaaaaaacacaaataatccactttaaaaatgggcaaatgatctgaatagacatttctcgaaagacacacaaattgccagcaggtatatgaaaaaatgctctacatcaccaatcatcagagaaatataaatcaaaaccacaacaatatcttaccccagtcagaatggctattaagattaaaaataacagatattggcaaggatgcagagaaaaagaaactcttatatattgttggtgggaatgtaaactagtacagtcactatggagatttctcaaaaactaaaaccagaattaccattcgatcaagcaatctcattactaggtatctacccaaaggaaaagaaatcaatacatcagagggatacctgcacttgcatgtttattgcagcactattcacgatagcaaagatatgaaatcaacctaagtgttcaccagtgcatgaatggataaagaaaacgtggcatatgcacacaatggaacgctattcagccataagaaaaagaatgaaatcatgccatttgca

SEQ ID NO: 118845 - DNA, 556 bp, Homo sapiens
cactctacaagcgtaatggaggtggaagggttgacgggaagaggcctgatcatttgaaaggtatcttgatagatggatttacattcttccctggaacagttttacaagagctggtaagatatgccagtgagaatgaggcatattcaatctcattaacaactgaactagaaaaacctaatcaagcctcaggtaggtgacttctggagggtatcacataatctttgataccaggttaagatttggtttaaacatctcattttctgaagaattttagatgccaaaaattatcaaaataagatccctcccttcatcaggtaattttatcatgactcacctagtttatatgaatcctgtgttaggaactaaggacagagagacaaaagacatcagcactggcctcaagatgagaaacactacagaaaagcagacaacaatgcagtgtgataatgacgtatacccaggcagctctgggaccacagaagacatccaacaggataccaagaacagggaaaggctctgcacattgcagaggctcagtagctattaatgtgatctc

SEQ ID NO: 118846 - DNA, 290 bp, Homo sapiens
agaaacggggtttcaccatgttggccagactggtctcaaactcctgaccttaagtgatccacccgcctcagcctcccaaagtgctgggattacaggcgtgagccactgcgcccggcctgtaattaccactttaaagaccctacctccaaatacagtcacattctaaggtactagggggttaggacttcaacatacgaattttgggaagtacacagtccaacccatagcaacctgactgccagcatactaattcaaactaaagtgagattttgttttgttctgtcaaagta

SEQ ID NO: 118847 - DNA, 413 bp, Homo sapiens
tgctgggattacaggcatgagctactgtgcccggccttcttgctgctttctctatgcatactgaaaaagctccctgtcagcaaccccaagcctatgacctgatggctgtcttttagcgttgtaaattaaccattgctgacaaggaaatagggagaccacaattggagaggtctacatcataggctcactcttgggatgaggaagtaaactgcccgtccataaccttatgggatggggaagttcagaggtcctaggcaggcagaaacagcacatgactactgcaggggtgtgtgtatgcacacatgtgtgcttacatgtgtgctcttatctcacttctttggggtccttctagagccttccaactggaatgaatccagtgggttgtgtttgtccatcaaactttgactcccact

SEQ ID NO: 118848 - DNA, 339 bp, Homo sapiens
ttcttttcccaggcatgccccttggtaaaagggataaatgtgggcacctcctgtaacgtctccaagcttccctttcctctctaattgagcaaggatgttataaggctctaaccacaaccttcttgggaagattcagtgagataaagcatgcaaagttcttagtcccatgccaggcatgtgattagctcgttggatttagacccgagtttttttctcttggctgtgattctctttgtgccacccacacagccccctggtgctttggggaccttgaagagcccagagggtagtgttagacccagataacccatcccgatgctgatacccggatgcctgggt

SEQ ID NO: 118849 - DNA, 121 bp, Homo sapiens
tcccggtatcccacccatataggcgtgaggtagaggtctaacttgattcttttgaatgtgcatacccagttttttcagcataatttgttgaaaagactatttctatcccccttgaattgtc

SEQ ID NO: 118850 - DNA, 190 bp, Homo sapiens
ttgcctcccactgggtccctcccacaacatgtaggaattcaatgtgagatttgggtggggacacagccaaaccatatcagcacctgtattcccatttacttgggacactgaggcaagaggattaatttagcttaaagtttgaggctgtaggcagggcatggtggctcatgcttataatcccagcactttg

SEQ ID NO: 118851 - DNA, 311 bp, Homo sapiens
tgctggaattacaggtgtgagccaccgcgcctggcctactttttcctttcttatttgcgtacgttttatctcctttctcttggactagaatctccagtacggtgcgttggcccaacgttgggccaacgcaccgtgttgggccaacgcaccgtacaccaggggtggtttggcttgtgcctgggcctggaggcctgagagagcaggacctgttcagggtaaaccggctttctcagcatgcgctgcattcacaggggaggagcaggaggtgacagggagggcctcgtgtgccgggccacggtgcgttggcccaa

SEQ ID NO: 118852 - DNA, 889 bp, Homo sapiens
gtgcacccaggtgaaataaacagccatgttgctcacacaaagcctgtttggtggtctcttcacagggacacggatgaaatttggtgccgtgactcggatcgggggacctcccttaggagatcaatcccctgtactccttttctttgccctgtgagaaagatccacctatgacctcagtcaggtcctcagaccgaccagcccaaggaacatctcaccaattttaaatcaggagtttgctacaagtgccagaaatctggccactgagccaaggaatgcccacagcccaggattcctcctaagccgcgtcccatctgtgtgggaccccactgaaaatcggactgttcaactcacctgacagccactcccagagctcctggaactctggcccaaggctctctgactgactccttcccagatcttctcagcttaacagctgaagactgacactgcccgatcgcctcggaagccctgtagaccatcacggacgccgagctttagagaccttgaagatcggtggtcaaggagaaactgaagagcaagaaggaaagtgagagccagcgaataccagcagagccagatctgaagctgggagaaggggagaaagtctgtgaagaggagatcggtgactgggctccttatgtgcctgaaagagttgagtttcctggtaactccaaatcaacagtattttcaagcaagaaatgtgcaattgaaatcaagtgctggttaagtgcagctaggaattccaaggaagacacttggcgtgaacagagtatggagcaggaagaaagggatctattggaacaagagaacatttgacgtggattgggtcattataaatacactctaaagggggtcaatacagggcttgattcaggtgatatggtaagat

SEQ ID NO: 118853 - DNA, 161 bp, Homo sapiens
ataggtactgctgctttcattctgactgtaaaactgtagccggccccttctcctcatatgactggatctgttcttatgggaagatcacattgacaaaagagagcacaatgtgcaagaatgggacggttctgataatggcaaaatctgtttttcattgtgat

SEQ ID NO: 118854 - DNA, 430 bp, Homo sapiens
ctcctccctcgtcccaccctctcccacacgctttcatgaattcctactcatccttcagccccaggcttggctgtcacctcctctgacagctgcacccttcctgatgcaaccaggttgggtgaccctcctctgtgtttccaaagtaccctgtgctccctccagcacagcttctctatcctgcctattcacctgcctgttacctgctcctaggcgtgagctccataaggacaaaggaacttggtctgccctgtggggctgtggccttagcacctagcacactgtttgggtccatcagtatttgttaagtgaaatatccgtggaaagggccagtctccaagaagagacttcactaataaagagtatgacacagatttctaattcctggcatctccacatgttcacacacactgatcctgacatctatctactc

SEQ ID NO: 118855 - DNA, 556 bp, Homo sapiens
tgcatcacgcgtgggagctcccatatgtcgactgcaggcggcggaatcactagtgattagagactgcgagaaggagaatctcttgaacccaggagacagaggttgccataagccaagatcatgccactgcactccagcctgggtgactgagcaagactctgtctcaaaagaaagaaaaaaaaaaagaagaagaaagaaaagactacattccttcccacagatttttcacatggaaaattaacagtgatgttgttgggagcagtattggaagaatggttgagaggaccaattgcattgagttaaggattgaataggacatgagtaggtgttgacagtgtttagaagaatctttgtagagagggagggatagagagagagtgaaggtcacatgaggttggaggaaggcgtctgccctcgccaccccctcgaaagtgcctttgttcttttccttctggcttaagatgttcttcctgtcctcctgcggactacttgatgtcctagtcccaggctgcgacatttaaattacttgtagcagccacccatagtgttcccccac

SEQ ID NO: 118856 - DNA, 304 bp, Homo sapiens
tggtccttaactttgcctgcatatcagatttaactggtaagctttacaaaatactgatgcctccccctgaacctcataagatttggatttaattggtccaagtcgtgccctgtgcattggacagttctaaaaactttccagatgtttccaatatgcatcaagtttgaggacctctgatttaagctgtgtgaagtgttttcaactgtcccgattcagagaacagagtcatgtaatggctcagaggattcctccacccacttacacacacacacacacacacacacacacacacacacacacaaaa

SEQ ID NO: 118857 - DNA, 195 bp, Homo sapiens
acctccctgaatgggatgctcttcaagggccaacaaaatactcttggcaaactgacccaaagagaaatcagggtgattttagctttcaacagcagtcagaaacccagcccaaattatccgtaagtttaaatttaactatcagccgccattggcaggactctgaaaggtcctggctggagttggttcctcagttta

SEQ ID NO: 118858 - DNA, 500 bp, Homo sapiens
gatcggggactcagcaatgtcctgcggggatggggagaggagagtggaagaggagtggggataaggtcacctgagagcacgtcatttggcacctgagccctgcggctgcccctgcctatctccctgtcttggaggtctggtatgttccttctctgtgccccacaccagtggctgggccaggctactgtcagcactcgcaccatctcacttcaccacttctgagcctggcagatgacactccttggtcagagtggcctgcctggcctgaagccccataggggctggctcaccagtgggagccagtcacacacctttccggaaagtcacacacctttccagaaatgcacgacaggaattctggctcattttcggatgggttaacaggcttggagagggcacgtgacgccccaggtctcttggttgagtgccagccctgggattagcatccagaactgtcagcctactatgccgagtgcacctcaaggctgcaggggcaggat

SEQ ID NO: 118859 - DNA, 177 bp, Homo sapiens
gaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgttttt

SEQ ID NO: 118860 - DNA, 238 bp, Homo sapiens
cccgattgctagaggtcccatcacatggacttcaccccagatgtgatggtccatgcaggagaggacaggtgtaagggcagaaagagtgttccctcccgctctgaagattcaagtctgctgaaataaactgacaataaatagattaacaaaataaaaggctacaaatatattaatgtgcatgaacacaggagccatgcaaaatataagactttttatacagggtcagatggttgaggct

SEQ ID NO: 118861 - DNA, 392 bp, Homo sapiens
catgttgaaaccctgatgcttacaagtagagaaaagaacttttaccctaactaaccaagtcagagacctaaaaatgtaccagtaataaagctacttaacctttcccctccccaccatgctaaaacaatgccttaggaacaaatgactggacaccgatatacagaaccaggaactccaaatatctgtatttttactgaaataagtacctctggaaagactttcaattaacagagaaattagcaaagactaatttctcctagtatgataccatatgatcgattctgataacaatattcaaaagatccttcctatttatacagcaatctttagtctaataaaaaccactttttagtcctgctgatggtaaatttctggaaaacttataaagaata

SEQ ID NO: 118862 - DNA, 685 bp, Homo sapiens
cagaaagcgtaaacataaaactgtgatactctatattaatcaacctgctgataagatctgacacagtaactcaaactacagctccccagagaggagatttagattctattcctggttctgtgtctttatctactacgtttttgtgaaccttaattttctcacctgtaaacagagggaaatgaaatgaaatgatctcttccagctctaatgagttgtgactctagatctggatgagaaacactgcaaatgaccagatttgttgcagagaagtcatacaactgcatcatgtaaatactgtagcctcttgtagaacctaccctccctcttgggggtttctttcacctctctcctcctgggagccccattacctggctgtctagtcttcctctttcttggcttgctccttcattttcctggggtctatcttttgttagctttgcaagaaaccatgtgtaaaagctgtcacttcatgtttgaaaatatctttacaggacaatttgggtgtgtatagtttaggttattaatccttttctcccttgttttttttttcttgagacggagtctggctctgttgccacggtggagtgcagtggcacgatctcggctcactgcaacctccgactccctggttcaagcaattctccagcctcagcctcccgagtagctgggattacaggcacatgcc

SEQ ID NO: 118863 - DNA, 547 bp, Homo sapiens
agtacctaccaacgtttcagctttcaaaacgaacttaccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttgtaaaatatcatcttggcgggactcaagagcttgcagagacaggttagactcttcctaaacaaaccaacagccaaatgttcatttcctctcccatcagaccagagttggttaaatttgatcacttgtcttactttgccatgcactcaccaaacctcccaccctttaaaagaagacattatgggctgtgcgcggtggctcacgcctgtaatcccagcactttgggaggccgaggggggcagatcacgaggtcaggagatcgagaccatcttggctaacacggtgaaaccccatctctactaaaaatacaaaaaattagccgggcgtggtggcgggcgcctgtagtcccagctactcgg

SEQ ID NO: 118864 - DNA, 509 bp, Homo sapiens
acactgtaaatgcataacagaaatataactagaaaaattccaaatgttggaaaattaagcaacatgtttctacaacctgtggtttaaagaagaaattacagtggaaattacaaaaaatgatatagaaaatataaagcaaaggttaagaaagatggtgtacaacatgagaatgtttaatacgtgtctaatctgagtccttaagtagaaaacaagaatgaagaatagatagcattcaaaaaataattgctgaaaattttccaaaactttttgaaatatacaaatcctatatccatcataatagagctaaagagtagcaaaggaaaggacaaaatcttttttttttattattatactttaagttctagggtacatgtgcacaacgtgcaggtttgttacatatgtatacatgtgccatgttggtgtgctgcacccattaactcatcatttacattaggtatatctcctaatgctatccctcccccctcccccgaccccatgacaggccccag

SEQ ID NO: 118865 - DNA, 430 bp, Homo sapiens
aggccctggatcttagataggggaagagatgagggtaagaaatcttttttaaaaattaagaaagaatacaagaccttgtcactggactaaaagggaatctaggatgagatctgagggtttctcccccaccggcaggaccaaaattgggggaaaaaatctggagaaaaagagccctgagagagaggcctagggagaaaggaagaaggacagggaggggagtcgaccaaaggcagaggaaatggcaaggggaggtggccgggctcagtgatgaggcctcaccgggcgctgggcctgggggctggaagggaggagacaggtttctggtctcccttctggagtggcttctttcctcgatgggagcccggggcagtactgaggaccagtcgaggaaggagcagacatgggtggacccacagaaaagcaagagggc

SEQ ID NO: 118866 - DNA, 397 bp, Homo sapiens
atattacaaacattactttgcgcctactgtttcaccaaaactactcgtcaaggttagcaatgactttaatgttcctaaatccaatggtcaattcgtagtcctctcacttgacctaggcagtgaccattctctcccactttcacacatgttcacttgacttccaggccatactcttagtttccattttacctcactgcctcactcgttatcatcttccttgcctcgttcctcaactctctatgctagagtacttcagggatcagtccttgatcctctccttttctctatacttactcctttgagggtttatctagtctcacagatttaaatatctttgatatgctgacaactctctaattatctaattcaccctgcccccaatccaagtccagacctg

SEQ ID NO: 118867 - DNA, 620 bp, Homo sapiens
taaattcagctgtctgggctcagttcacagttctgtcagttgtgtgactttgggcaactctgtaacttctgtttctcagtgtcttcatctggaaagtgagcatgacaataaaaagcacttatcttgaagtgggaggagggctgactgagataacacatagagctgagagtaacacaggcacatggtgtgcatttgatgagtgtggttctgatcacttattcaacaagtgtgtaatgcctactatgtaaaaggcactgtgatggcggtgggggatcagttgaataatacagacatgattcctaccccacgatgcatccagcttgaggagacaaacaacaaacaagtaatcacacaccacctgccagtctctttaaaatagagactgtgatgagcgtcctaaaggaaaccactagaagctgtaataaagacgtctatttagaattctgcataaagatgaataatttgacaaatatatatcattttgcattcatctctaaaccacagtaatgaatatttttaaaaagatagaacccacaaggaagtggaaagagaggagataagagcaaacaaaatttgaagctagtaagcagatgggtgaatggcacctgtgaagggaaagc

SEQ ID NO: 118868 - DNA, 585 bp, Homo sapiens
ccctttgcattgcctggcttggcctcattaatgtccccaaatctgtgttcttctctccagctcttctggcaacccctgacccccttcattcctcacagccagtcctaactctcctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggcccagccactgcctggggctctggccctgtgactcaccgcgccctgtttccctctgcaccctgcatcctgtagtcctttccaggggctgtgctcttggcctggggtggtcttttctctccttacctggctgacagttacttgtccctccgcagaggatcatgttcggacctccaggccagcccactgctgctccttggcactttcacggccctggcgtgtccccgtcatagcccttatcagtcccttgtatttacctggtcactctccatctctgagggtatgggggccagatggctcttgctgccctgatgttttggggggt

SEQ ID NO: 118869 - DNA, 325 bp, Homo sapiens
aaaaaaaattaaaacagataatagactaaaatgtaaaactataaaactttcagaaaaaaaaaaaagaatctttggaatcaagggctacacaaaaagttctttacttgataccaaaaataaaatccatgaaaggaaaaaatggataaattgggctccatcaaaatttaacactttcgctctgtaaaagactgttaaggcccggtgcggtggctcacgcctgtaatcccagcactttgggaggccagggtgggtggatcacaaggtcaggagttcatgaccagcctggccaagatggtgaaaccccgtctctactaaaaatacaata

SEQ ID NO: 118870 - DNA, 291 bp, Homo sapiens
ccagactggagagggatgggtggctgtttgagaaggttctgggagggccgatgagtctggagttgttctctctgagagtccctgaatgggaggtggctctagggtaggagcctgagtgcatggtccagaggaggcctggggaacacccacctggggatcagagctctggttcaggacctggggaagaaaggacagtgagctcagccttcagactgacctgacctcagcttcatgctgaccccatgaccctaccttccacttcttgaggtgatgctgctgcttatgggaggg

SEQ ID NO: 118871 - DNA, 469 bp, Homo sapiens
ggcttggctgcacatggtggctcatgcctgtaatcccagaactttgggaagccgagggaggtggatcacttgaggtcaggagttcaagaccacctggccaacatggtgaaacaccgtctctactaaaaaataaataaataaataaatattagccaggcatggtgccagttacttgggaggctgagacaggagaatagcttgaatccaggagtcggaggctacagtgagccaagatcacgccactacactctagcctgggcaacagagcaagactctgtcaaacaacaacaacaacaaaaaaccaccagagaaaatcagtaaagatcctccacacatgcccagccacaatgtaccatctacttgctattgtagccacacatattattctgtcttccttctattatcttggctttatttttacgtttttttgactatgctgtttagcttttccaataggaacagctagctg

SEQ ID NO: 118872 - DNA, 239 bp, Homo sapiens
ccatctgggccatggctcttctggggacagtgcaggactcgaagagaagctaatggccttgcttgggtggggatgactagttttttcttttgtgttggtcacttgctggcaagcgggttttcccacctcactggctggttgtccagcagcgtgaatccgctgcctgagaagtgagtctccaaacaatcacagcgggactgaccacgcaggtttccccattactgcgctatgaagctccc

SEQ ID NO: 118873 - DNA, 372 bp, Homo sapiens
gctacatagcatctgtattcatattcactttaacaaatattacattaaacaaaatgactcatgaagaattagacatacattaacacatgaatccaatagttttattataatgtgaaatacagtaattgaattcctatacaataaacttgttagtaggaatgtagagaaaatactataatttgatttattatcagcacatttgaattaaaaacatctaatactttgacccagtaaaaattttcaagcaaataattttcattgcctgctgttatgcaatatccacttctgttagtgttagtgcataagcaatggctaagcaacatattggcaccatcatgtaatcctcataagttacaaagtattttgttctca

SEQ ID NO: 118874 - DNA, 417 bp, Homo sapiens
  misc_feature (399)..(399): n is a, c, g, or t
gccaccctccctcctgcaccaagaaccagtttttgccccttttaagtgcaacattacctctgctaaaatgcatgaagtagaggacagagagggagtgaagaagtagctggtaagataggagaaaggccagtacagagtggtagaatgaagtcaagagagggtgaagattgttagaagaaaggagaaagggtattgaatactggagaatactctctttatgacttggcagtgtggttattgtgaccttcatcaaaccgtgtcactgcagtgatgagatggaaatggagtggtgagttgaagagtatctgggaggcaaggaaatggagcctcaagggcagaaaacttttgagaagtttgggtacaaatgggtatgggaagtgggtaaggagtaggatacantagggagagggtaccgag

SEQ ID NO: 118875 - DNA, 247 bp, Homo sapiens
taatacatatcttgggaaagatactttgaagctatgcaaatatcctgtttctcctcaaaccttcaccactgattttagcattcaatggtggaatttgcctgcaacaattattactgtggcatctgtctaatagtagctcacacatctgaacctagagggaagcagctaatgagccatcccttcgcttcacaaccccaacctaaccaataatgagatgtgaactagtgcaaaggggtaagaaatgtcc

SEQ ID NO: 118876 - DNA, 319 bp, Homo sapiens
ggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaat

SEQ ID NO: 118877 - DNA, 187 bp, Homo sapiens
attacctgaggagctcgacgttcaaaaggcagacccccctgccgccgcatcccttcccggttccagctcacggggcctgggtggagccaagcatatgcgttttgatgcgttttgaacaagcatcccaagtggttctgaggggctggtctccaggccacactgaaaaaccgagttctggaggtcgacg

SEQ ID NO: 118878 - DNA, 215 bp, Homo sapiens
ttcatttatctttcctacaagtcatctgttttcccttaagtgcccttcatctccctttacttcctctattatgatggtatataaagtccaaattcttacagccttttctctcactaatctgtcttttattaatttaatttgcccccaactacttaacgtaaggcagagaaaaagcttttcttccctgacatcatcaactactaaattttctactt

SEQ ID NO: 118879 - DNA, 774 bp, Homo sapiens
cactgattggtgtgtttacaatcctttagctagacagaaaagttctccaagtctccaccaacccagaagcccagtggcttcacctctcacttccatgtttgaaacttgacctcctgaacttgaaagtagcagtaacatattttgattttctgatgagaaataccatgatttgaccacagtcatagaagacctaaataatgtgaagagagtggtagaacaaataagaataatatatagtgaaaatgagaaaaacgtaatccacctggatgtaatataaattagttcagttgatacactctcatgaaaaatagtttaaaggtcacctgttgcacttaaaaccccacttactcgaaactactatgttttaggggatatttttctcaaagaaaagttaatttttttccttttccttctataacatcacatgtcattcctttgacttctcattttctttagttttttaagaaaatttttaaaactcttgatttattaagattttagaactcttggtaggctctcaaaccataatttcatttttaccaatacctactccagcttgtatcttgccccacaaaacaaagtactattaatgtaatttacattaatgtctgttaatttgtctctagaatatacttaaccatttacagatagattttatttaatacagaaatctgcagaaagtacaacagctatagactgtaggttgcttttctgaatctgaaggaggatttcgaatttagaactttgtgaactggaaagaatcttgcttattgg

SEQ ID NO: 118880 - DNA, 627 bp, Homo sapiens
ctggtggctcatgcctgtaatcccagcactttgggaggccaaggaaggtggatcacctgaggtcaggagttcgagaccagcctggccaacatggtggaattacacaactttgtttctttaacaacagcagcaataacaaaaaaaaaacaccagagaaaaaaagaactgatgggcgtggtggctcatgcctgtaatcctatcactttgggaggtcagggtgggagaatcacttgagcccaggagttcaagaccagcctgggcaacacagtggaaccccatctctatttaaaaatacaataccattaacaataattcaaaataaaaagggagaaatacatagttttaaatctagcaaaacatttacaggactggcatgctgaaaactataaaatgctaatggaagaaaggaaaacaagatggaaatagagagctatttcatgatcagagatttgaagacataacatagtaacaatgtcaatggctgggcatggtggcacatccctatagtcccagcactttggaaggcagaggctggaggaatacttgagcccaggaactccaggctgcagtgagctatgatggtgctactgcactccagcctgggtaacatagagagagcctgtcccc

SEQ ID NO: 118881 - DNA, 642 bp, Homo sapiens
gagattcagacacacagaaagattgttatgtggtggcagaggcagatattgtagtgatgcatttccatgccgggaaatgctaaggatggctgttaataaccagaagctgggagacaggcatggagcagattcccactctggatgcccaagaaggaatcaaccctgctatcctcctgactttagacttctagactcctgaactgtgaaagaacatctttgtattgccttaaatcacccagtttgtggtagtttgttatggtaacaataggaaataatatagtaactaatatagatgcttagtaaccattttcccatcccaaaattgactaaggaagctaataagaaggggtagaaaagtggatttcgaaatagcctttaatgttcaataggtgttccacttcagcacaaatggaaatttccttcctggttcttgtgactgctctagtatttatttacaaattgatatgagaacttttgcttttgatggatggaaggatccaatcaaggcaaagatatgcagggagaaaggagaggtggacaatagaagggaatgacatggaaattctcctcatctcctggtctgctggattgtcctttaaaagcagaactcaagttattgtttaataagcaatttcatgaaac

SEQ ID NO: 118882 - DNA, 323 bp, Homo sapiens
attgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctc

SEQ ID NO: 118883 - DNA, 621 bp, Homo sapiens
aggatttttcaccttctgcactattattgtcagctaagtcttcattgtggaaggctgtcctgtatgctatagggtgttaagcagcattcctggcttctaccctctgcatagcaatagcacatctataccgccacttctaccctagttacaataaccaaaaatatctctagatattgcttaatatcctggtgaatgaggaagaatcgcccccagttgagagccacttgagtagagcagtctgggactgaaccctggggcacaccaacatttagaaaaatgacgaaccaacaaaggagcccaagaaggagtaactgaagtgagagttgaacaaagaacgtggcatcccagaagctaagggaaatgtttcaaggaggaggagagtgaaaacctgtcagtgttgcatttaagccaggcaagatgagaaacgaaaattggcctttggatcatggaggtcattgatgacctggtcaggaattactgcagtagtcgtacaaaagcctcagtggagtgggttcaagagggaaagggaggagaggaattgtgagtatagaatagcccttccaaggtgtattgctataagggaagcagagaaatcacatggtaaccagagagcaagggagg

SEQ ID NO: 118884 - DNA, 354 bp, Homo sapiens
atctgatgtatgatttgcaaatattttctcccaatctgtgagttgtctcttcattctgttgtttcccttgctgtgcagaagttttctagtttgttgcagtcccatttgtctatttttgctttcattggctatgagactcaaaaatttaagtaagatattaccaacgaaatagattaagatcacaaaaaccatctgtatcttggagagataatacaagcttacaaagacaaagctacatattagacagttactgggagacaccgggccaaggattccatggatatgtaaaacaaaaagtcataattgaactttgcttcccacagggcccatcatatctcattaactatgaaagaa

SEQ ID NO: 118885 - DNA, 700 bp, Homo sapiens
ataagattatttctggcaagggattcttgaaagctgtaaagaaaacatacctgctgtctttaccgataatgtggaaaacttcatgggaaattctagccccttcgatgtcaagtctatttaatctcattcctttactattaataaatttaaatagatgaatttcaaatctcattaaatgttacaacagtatgtctaattagtttttttctttctttgattggattccacaaagtagaataaagctcttctcagaaacctgtttggacttagtaattatttttctctagattgttattttttctctagtttgtcaagagtgagtaaactttgaatgattgagagtctgttatgacataggtcaaatcaattgagcaggaccaaagagttgggctaccctggtcacattaactatatacatttactgcgattatttccattgtttcttcatacacagctgtgtgacacagcgtgccttttgcatcggtaaaggagttaaatctgtagttaatttgtgtggcattctctaggctgagccaggctttcttagccctttggaagatcccacatggaagcattagacataatgaaaactcagcatatttctttgcttctgagttgttggaaatgattagattgaaactcaatgtgttgttttcttttcccacccccaccctttagaaaggtatctgtatgtacagaa

SEQ ID NO: 118886 - DNA, 303 bp, Homo sapiens
acagcatagactatctaattcgaaagtacaaatgttaaagtacaaaatttcctatgtatgattatcatccttctgataattatacgttgaacttcctatcacctggttacaaccaagcttctacatttcaatgtttgatgctataatatgcaacaacaccttggttatctgttttgagagtgaaatgctacctattaatacagtaattttttggctgctgtaatttctcagtaatgtagatatggtataaaattaacaagctgtctttcagcctgtccttatcacatgctttttgtctttttt

SEQ ID NO: 118887 - DNA, 704 bp, Homo sapiens
cctgcaaatgttaggagagaacctaggatgggggctggtttggctataaacagctttagattacatcatcacaattcaataatcaaaacaaaaaaatcctctgtctcctagcatccaagtacaaaatctgagctgggtttagactaatgctctgagattggtccagtgctaggaccaatagctatagccagaggtaggaaccactgtggctaatcagtcatgtagcatactcccagccatctggcctggaccagtggggccatgtgataggcagccctaccagaattggaattgaggagggaggttttcctcaagtgaaaagggtactgtcactagaagagaggggaagtaatgctgtgtgaacaaacaataaaatccacccacaccagattaacattttattctcagaccctaccattaaatctgtcatgtgattattggtcaataaatgcttagtgaatgaatgaacttaggaaatgcattttgaggccaatatattccctgtattaatatttggggtattggaactcatgagtgaggatgaaaagaaacatagctatttcttatagcaagtaaaagagaacaacgtgttttcatggccaaaaagctaatcctatgcttaataaagattgcaaatgcaatatacttaaaattgtgtcacagaatgtccactgaaagatcaatatatttgattgaagattgtg

SEQ ID NO: 118888 - DNA, 846 bp, Homo sapiens
aaaaagagcaggagagggatgggatagggaattttcttattctgttttatttttccaagtgtttctttagattttctagacatttatatcacctacattagatatcattttgccttttccgttccaattattatatttccaattgtttattcatttcagtagctaatatttccaacatgatattcagtcagatggggacaactgatatctttttgttcctgatttgagcaggaaatttcctttcatttctccatcaagtaagatgttggctttgagatggaaattgtgtgtgtgtgtgtacatgtatcattatataatatatattgcatattgataggaaatatctattcctattgggaaatttttaaaaatataaacaagtgctaaattgttttcagatgcattttccctatcttatttcctctacttctttcctctatcttatttcctctgcttatttaatgggttatatgaatagattttataatattggcccagtaagcattcctggaataaactccacctggtcatgatgaattagtttttaatatgctcttgtgctttctttgctaattttggggttttttgttttttagtttgtgtaatcaatattcatagtgaaactgatgtgtttttttgattgtaatattatactcaaattagaaaatatatatttctaatataacaaggaaaataagttttccttagttttctgtgcactgggatattttaagtagcatttggatctggtctttaaaaatttgatagaaaatttggtagaaattcccaagggagtctattcttctattttttttaaattattaattgttaattctaattatgtat

SEQ ID NO: 118889 - DNA, 736 bp, Homo sapiens
tcaggttccatctcttatattggcctttcagtgtccctgctttcttgagagcccagtaaagcatttttaaaagtatattgtttataattgaactaggaactaatagtaatgggagagccctttggatgatcttgtcttttataaccccataaaccactaccattctagaagccaaagaaaagacatagttttgtcttaatattcactaatttttctcttgtgtaccactagcctcctctgaaatttatgtgttgaagacgttccatagaccagggggcccccgtccgcgggcctcaaatcaatactggtccgtgggctgttgggaacggagctgcacagcaggaggtgagcggcaggccagtgagcattactgcctgagctccgcctcctgtcagaccaatgacagcattggattctcataggggagcaaactttattgtgaactgcgcatgtgagggatctaggttgcaatctccttatgagaatctaatgcctgatgagctgaggtggaatagtttcatctccaaaccacctgtccccacccctgccctgtccgtggcaaaattgtcttctgcaaaactggtccctggtgccaaaaaagttggagactgctgcttatagaccttaacagagctttcttttttttgagacagggtcttgctttgctgcccaggttggagtgcaatgacgtgaacatgactcactgcagccttgacctcccgggctcaagtggttc

SEQ ID NO: 118890 - DNA, 852 bp, Homo sapiens
caattaatccaggataatctccccattctaccatcagttgatccactctagcaatgcaggtaaaggtgccatcacatagatatcaattataaaaataatattaacaggcataattgtagttaaatttcaattcagacatactttcttttgaatgtctggtaggtctgctgtgttggttgtatgtgggttttcctccatatccacttttttggacttaatctcaccattttttacatgtaaacatatcacaatattaataacattaattaattgaaggttaattatataaactaagtgaaataaatctttaaccagaaataagaaaatttatttgtatttgagttacagaacaatatctgcactccagcctgggcaacacagcaagactccatctcaagaaaaacaaagaaaagaaaaaaggagagagccttaatgggcactcaattttcacccagactttgaaaaggaggggtgacgaatttcctttaccaatctccattaaagaacacttctgggtgtgagacgagattatgtggggccacgggctggcactctcacggacgggaccaattaccttctaccctgacgcaccagggacaaagaacggtttccaaacccttgcaggcaagatattttatcccaggaatattattggcacaaactaatgaccaacagaaagctccaccggggacgatgcgtaacatttgggttgcacacagatatacggtccccaggattataaggtcgagctggtatacacagattacacaaaaacacatcttgggacatggcgagatacggatagctctgcacatttttgtgcaaaaggtaacatacgaataaccggaatcg

SEQ ID NO: 118891 - DNA, 216 bp, Homo sapiens
ggttgatctaaggatccccatcaggcgaagaggtgtggggcttcctttggaggtgataaaaatgttctaaaactgactgtggtgataggtgcacatatctgtgaacatgccaaaaagctgaagtgtacattttaaatggcatctaaaggcatgaggccgaggggaatcaccagacactgggagcaaagagacaagcggaggcagaaccaagccctg

SEQ ID NO: 118892 - DNA, 363 bp, Homo sapiens
gcgtgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccggctacaccagcctgacttccgctggacagtgccattttctgcctctgttaacaccgtggtgaagcgccttacgtaaagcaacagattttttgttttaagatgcactataattactcttttcagaaccaataatattaacccagtgaagtcaaaactgaattgttttataaactgactatggagctggtgt

SEQ ID NO: 118893 - DNA, 637 bp, Homo sapiens
atgctgtcatccagactgtatttctccatttgccttatttgcctgcaagagtctttttgtgagagtgactcatgataattgtggcttattacctgaagcctcatgagaaacggtattgaatgctttctgaaatcagaatgtactacttgtttgtactactagtttgtttaaaaaggaaatgagattactttggcctggctttttccatgcttttcatgtcctatgtagctcaaaaatttgaaatgacaggttatagtgctactgagaattcacgtttaagatgtagttcctagaatttgatttttctctctttgggtcaacattactttgttttaatctcccactgacatctggttcttcatcttctttcaaagattactgatgatagctccccattcattcatttgaaatatatcattacttttgttttatggcccagcataccgttcatttttataaatgtttcactggtccatgaaaagaatgtaaattctgtagttgatgagtgcagggctctgtgtgtttttggtcaagtttatgtgttgtgttgcttacatcttttagagctttaccgagtttttgcctatgagatctgttagagacagagaggttaaaatctcctcgtataatttttgga

SEQ ID NO: 118894 - DNA, 363 bp, Homo sapiens
tttttttttactgagaaatgctggtaaatgtaaaatcagtgtagtaaacgcataatacatagtccagtgaagatgcagagttcaatcagggaacattatcaataagaatacacaacatttttaaaacattcttttccctccaagttagtttatataaaattaaaattttaatgtgatattttgaagcatgagataatatttcatgctcatctgccaaccaaaaatacctccaaagtcttgccattaatgtattcatctccccacaatcctgcaagttaacctggcccatggtcaacactgccatcctcattttacctgtgagcccctccacaggtagtctgtggaagagtcagaactgcagtc

SEQ ID NO: 118895 - DNA, 821 bp, Homo sapiens
aacctcgtgatccacccgcctcggcctcccaaagtactgggattacaggcatgagccagtagctttttacatttaaagtagggtccagctgaagtgaattcattttacaaacgctaaaagcagtgagaactagctgagagcattttgagaagaaaagtgaaaggtatgaaggttttcctgaagttagtatccacttttgtaaaatctaggccagtggttctgggccaggggtggttttcccacccagggaacatttggtaatatctggagacatttttggttgtcatgatgtgggggaggtgatatggtttggctgtgtccccacccaaatcttatcttgaattgtagctcccataattcccatgtgttgtgggagggacccagtgggaaataattgaatcatgagggcagtttcccccatactgttctcgtggcagtgagtaagtctcaggagatctgatggttttacaagggaaaacccctttggcttggttcctatttctctcttgtctgctaccatgtaagacatgtcttctgccttccaccatgattgtgaggcttccctagccacatggaactgtgagtccattgaatctcattttgtttataattacctagtttctggcatgtgtttatcagcagtgtgaaaacggactaatactgtatgtaactaatactggcatctaggtagagggtagggatgcatctcagtatcctgttatgccccacaccaaaggattattgagccccaaatgtcaatagtgctgatattgagaaaccccagtccgggcttcatgtacttatctggcctctctagaaca

SEQ ID NO: 118896 - DNA, 551 bp, Homo sapiens
tgctgttcctctctcttggaaaaaccttctcctgcttttttcctaaattgtatgtattctttaagaccagctcaaacgccacctttttcacaaagacttccctgatcccagaattaagggtgagcttccctgtgctcacagtgcaatatttgtacctctccttcacatttaccacactgtgtttgctgctatgattattggtgtaaacaatttctgcttctatgctataaatcgactaccacaatcatttgcaacatccacagagcataacagcattttgctttataaatgtttgttgagttgaaatgaacccccctacaagctcaaatattggactgaaaccaacaagataaaatttcatagggagatatttttattttttattttttgagatggagttttgctcttgttgcccaggctggagtgcagtggcaccatcttggctcattgcaacctccacctcccgggttcaagcaattcccctgcctcagtctccagagtagctgggattacaggcgtctgccaccacgcccggctaattttttgtattt

SEQ ID NO: 118897 - DNA, 272 bp, Homo sapiens
aacatttatgaggaactgaaagaaatgcattatacttttctaaatcaagaaagagttccttactgtgcagtgggaagttggcattacctgctcagactgtgcagacagtggagtgggggtcagagtctggaaaacaatgatgaccactgtttattagggaataattaagacaactcctccattgagtcatggtttgtgactagcttggctcacacttgggcaagattcgttgggtgttttgtttcagactttgaatgcctcagtgctttttg

SEQ ID NO: 118898 - DNA, 132 bp, Homo sapiens
tgttcattaggattgacaagattcagtaacttagaggaaatggaagaaagggtagaactttgcctaaactcttgggctatttaaaaatagttgctgctggccgggcacggtggctcatgcctgtaatcccag

SEQ ID NO: 118899 - DNA, 295 bp, Homo sapiens
ccccgactagcccgacagccccgactagcccgacagccccgactagcccgacagccccgactagcccgacaggggcgtatctgtgagccaaggaattgatgtttctattcacaaagcctcttcagtctcaacgtacagctgatcaaagacagacagatcttcagataaaagaagcaatgtgtaaattatgtatcagtttttgaaaatcctaaccaaatgggtctggagagctatcaggttagtgaacaagaatgcatctatgtgctgggatgtatgaagtgttacatccatgggg

SEQ ID NO: 118900 - DNA, 277 bp, Homo sapiens
tccgtgcagactgatagatcgtatttctgaacttccatatttagttgtctacagtgcctctgtattttctattaccaacattttttgaatgctaagaagtttgtcgatttttttaacatttaaaaaatgactctaatgtatccatttccacatacgctttttctggcattcatcttttgaggatttgaactgcagtaattacatacaatgaacagtggtggcatttgagataaggtgaggctagaaacgtcagttacactgttgatagagaaagttg

SEQ ID NO: 118901 - DNA, 676 bp, Homo sapiens
aggaaaccaaaaattatagttaatgatataaaagatttaaactatacaattagcaacttgatcagaactcttccatatatggacatataaagaacgctgcaatgaaaatgtacttaacatgtttacaaaatttactgggtttataatatctataaatttcaaagaactggttttatattgcattctcaagcaatggaatcaagttaccatcaataataaaaaatgaccttagtgaacatgttggtgtgagtgtccacaagcctttgaagattttttcctgttctgaaagttgtccaaagtgtgtaagtcttccttgtgacttagaatcccatgaggaaaaaaaatggaatgatactttcaggaaaatctgctgacctaggacaaagagtcagcaaaaatatcctttaaaatagaaggcacaattaagatgtttccagacaaacataagctgaaagaattcctcatgattcaaagcatggaagtagttcttcaggctgaaagaaaatgattccaggcagaggcatcgagattttggcaggaaagaagactgctggaaaggcaaatatatgagtaattgtataacagcaatggctgtaagtctcaaacaataatgtcttgtgaaactaccaacttaaatagaaggcattacaacaatagggcaaaagcagagggaaga

SEQ ID NO: 118902 - DNA, 884 bp, Homo sapiens
agcgggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagccaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaacaggagtcgctttgcgatgacatgttggggatacatgaacccattctattgcacagagctggattcccgagaaacagtaatatttgcctca

SEQ ID NO: 118903 - DNA, 351 bp, Homo sapiens
gattgagcttcacagttctatttaatgagcagaatacaaaagtataatgcataatcgctgaccatatagattttctagtcctaaaaggagataatatatggacatattaaatgactcaaacttcctgttttaggggcactattcctgggcatgctgctaccagtgcagtaaccagggcactacctaccatcattagcaccattttcagattacagacaagatacgaagtgtaatgtcaaatcaccaaattcaagcaggattagataagaagctgaggttcagagaaaatgtgtgagaacccaggggccatgatttgtaggctcatcacagacagacggaaatcaaaccaga

SEQ ID NO: 118904 - DNA, 884 bp, Homo sapiens
gatctcaactcagcgcaacctccgcctcctggtttcaggcaattctcctgcctctgcctcccgagtagatgggattacaggcatgcaccaccacacccaactaattttgtgtttttagtgaagacgggctttctccatgttggtcaggctggtcttgaactctcgacctcaggtgatccacctgtctcggcccaccaaagtgctgtgattacaggcgtgagccaccactcctggccgaactaaaagttttgaaataagtttagaaaagtcattaatttttggaggctaatcttgtttgttatactttagtcattaattcaaagtaaaggagttgttaatgaactggaaactccttttgaattatggtagcaatcagaatatttttatattagccagttttaccttgaagacctatttttaaaaactacctgtgtctctggacttagttgcaaatgcatattaaaacaaaaatcccccaatttctgtgctttcttatttgaaaggccatttctagggggaaaacagttcccaaacacattatacatgttggaaaagtttatctctaaccttttgaattaaacaatttcagaattgaaaacagtaaggtgaattttaggccaataactcttttctataatcttgactcttttaagattaggcagttcagatagtcttatactactgaaaacctagctagatatcagaagtaattattagtggcaagaataccaaagttaataccaaagtttttttgttttgttttgtttttagacagggtctcactcagtcacccaggctggagtgcagtggtgcaatcttggctcactgcaacctctgcctcccaggctccagagatccttcctgctcagcctctcaagtaactg

SEQ ID NO: 118905 - DNA, 333 bp, Homo sapiens
actgtgatagattcacgcaacgaagtccttacacagcagtgtgaaatgagtgactgagctggagcgacacatggcaacagggataaatcgcaaaaccatgctgggcaaaaagcacaagttgcaggagaacgacagtaaataccacttctgtgaagtttgaaaatatgcacaccattactctagattgtttacagctgtacacatacatagaaaatatagaaatgcataaatgagaatttcaggaaataatttaataatgattgtaggaaagaggtgaccctggggacctgggggaggtgtgatcagggcgggatacacaggaggctccacgtg

SEQ ID NO: 118906 - DNA, 274 bp, Homo sapiens
tccttttggcagtgacatctgactcttgagttatagccactgagatctctctaagtgctcttgactcttgacttgtgtcattatgttttgttgcccctaagtcaagggtacaagtaattatacatggaattggtgtgaagtactcacagcaaagactgcaggtgggctctgggaggcctgactgggttggggacagtgaatgcagaggtggggacgggacccagcccgtggcaggagagggcggctgtggttttggaggaatgagttttcaggg

SEQ ID NO: 118907 - DNA, 616 bp, Homo sapiens
atagtaaaatataatccgagcacagtggcacgtgcctgtactcccagctactctgggcagctgaggcaggtttgctcaattccaagattttgaggctccagtgcactatgatttcacctgtgaagagcaactgcactccagcatgggtaacatagcaagactgtcttttaaatacacaaagtattttgaaaggccaggtgcagtggctcacacctgtaatcccagcactttgggaggccaagacggacagatcacctgatgtcaggagttccagaccagcctggccaacatggtgaaaacccatttctagcaaaaatacaaacgttagccgggtgtggccagacatggtggctcacacctataattccagcactttgggaggccaaggtgggcggatcacctgacatcaggagttggagaccagcctggccaacatggtgaaaccccgtttctattaaaaatacaaaaataagctaggcgtggtggcgggtgtctgtaatcccagctactcaggaggctgaggcaggagaatcgcttgaacccgggaagcagaggttgcagtgagcagagattgcgtcattgcactccagtaagactccatctccgaaaaaaaaaa

SEQ ID NO: 118908 - DNA, 121 bp, Homo sapiens
gctggtggtccaggggtgttactccttggaggctatgtgggccatgaggtccaccaccctgttgctgtagccaaattcgttgtcataccaggaaatgagcttgacaaaatggtctttgagg

SEQ ID NO: 118909 - DNA, 265 bp, Homo sapiens
gctggtggtccaggggtgttactccttggaggctatgtgggccatgaggtccaccaccctgttgctgtagccaaattcgttgtcataccaggaaatgagagaccctcactgctggggagtcccctccacactcagtcccccccccactgaatctccctctcacaggtgccatgtagcccccttaaaaggggaagggcctaaggaaccgcccccttttcatggtccctccattaaagtcccttggtggtccacccaaaaaaaaaaa

SEQ ID NO: 118910 - DNA, 751 bp, Homo sapiens
tgtacttgatatcgatctcttgttcatttcttgataatatgtttggttatttttgttttcattgcttttggtgtcagagatggctttggattccctgttctgtgtgctcctgtctggctcctgaacccagctggagaggtgtgtcaatcccaactggtgaagtactgagaggaagctacacaaaaggcagcaaggtgttaataagtgtacctctgacattttaaccacctctgacttttccatggaatggacaagtagtagtctctgtcagagcaatgttttaaaggaaaaaaagaaacttgaggtcgtaaactgtttattaatttatgctgttattttgtgtttactcaactcatttatattgacttgtaaattagtaatttatgaactactattcatcaattcattgcctacatgtcagcaaacaagttttcttcttaataaagaatccggtggctgggcacggtggttcacacctgtaatctcagcatgttgggagggcaaggcaggaggattccttgaggccaagagttcaagacccgcctgggcaacatagcaagatttcatctctacaaaaaaatgaaaatattggctgggcatggtggctcattcctatagttcaggctactcaggagcctgaggtaggaggatcacttgaacccaggagtttgaggctgcagtgagctatgatcctaacactgctctccagcctgggtgacacaccaagagaccacctcttcaaaaaaggaat

SEQ ID NO: 118911 - DNA, 691 bp, Homo sapiens
aaaatagtccagaaaatggtgtgagagacgaaactcctaattgcctttgaactttagaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtggtcccagcactttgggaggccgaggcgggcagatcacgaggtcaggagatcaagaccatcctggctaacacggtgaaaccccgtctctactaaaaatacaaa

SEQ ID NO: 118912 - DNA, 653 bp, Homo sapiens
ggttttatcagtggtttccgcttttccgtcttcctgattctctctttgccagctgccatccaaatcaaccctgaggattgggaaggaactatacataccaggaggcaaggagcactgggggccctcctggaactgcctgtcacagcgtcctcaaaggttttcactctcctaggatgacccaggtatagaatctgcccctatggttcggctccaccctctcacctgtctcttgagagcattgtgaaattctgagacacagcaaggacagaaacagagggcatggaagatgctttcagagatcagatccagagcctgacaagtttatttacttggagaagcagattctaggttctagaaaagaaggctgaaaatacaactttaagggaaaggataatctgatgactaattctcatttatcaaaaagccactttgccttagatctatctgtataaactccatgcttcacagtaaaatccttctaactttattgaaaaaagggggccacctagcaaataacaccaagagtattatttctggggttcagttaacccaaagacaattatttatcttactaaaatccatttctaggtctataaacctattgtgtagtacataaatacataggctttagtcctagatagttggagcagatc

SEQ ID NO: 118913 - DNA, 420 bp, Homo sapiens
attctttagcttaaaaacttatagttttcatcaccggattgagataggagaagctagtataatactgcaaaccaacgccagccctccccacgtacacatagtcaatagagttatttataagatacattttcatctgcgtaggctgaaaaatgacctctccacaaaaaatccatttcaagtccatagaacctgtgaatactaccttatttggaagaaggatagttatgttgaatcatcgtggatatctggttgggcactaaatccaaagacaagtgtccctgtaagtgacatatggagaatacgatgtgatgacagagggagaaagtggagtaatgtggccacaagccaaggaagccaagcaacgccaacaaccactggaagtagaaaggattccctcctaaagccccagagaaagcttgg

SEQ ID NO: 118914 - DNA, 666 bp, Homo sapiens
ctccatacacaaaggttttgtatcctgcaagtgctgtattttctatctgtgtttggttgaaaaaacaaaaacctacatataagtagacccaggcagttcaagtccatgttgttcaagggtcaaatgtattcctataaagcaaaacaaagaagcatattgcttaggaatgtgtctgtcgtgctcaaaatggagtgaatatcaatggtctggtggcatcaaaatggccagttctgtgacagtaaaagaggtttgtgtcttatttaatcttttgataataataacagctatggtgtatcacagctttaccaagtaccagacactgttctaagggctttgcatggttcactcactccttacgtcatccctcggtggcaggtgctgtaattatccttatattgcagacaaggacattgagacagaggtcaagccaccttcccaagggcacacatggcatctgcactgctcctgaccgaccgacagagagagctgctgtcacgatcctcaaatgagctatgcatgtcaaaagtttaaaaataaaaaagataaaaacatgcacaaaatttaaaaagtaaaccatttcaggctggacagactgaaactgagagatggccagagaagagtatgaaagataaatctatggacagagtaaaccctgactggcttgaa

SEQ ID NO: 118915 - DNA, 373 bp, Homo sapiens
cctcggctcactgcaacctccgcctcctgggctcaagcgattctcttgcctgagcctcccaagtagctggaactatagacatccaccactatgcccaggctaatttttgtattttgttttttttagagacaggatttcaccatgttgcccatactggcttcaaactcctgggctcaagcgatccacccaccttggcctcccacagtgctgggattacaggtgagtgacactgtgcccggccagatggcatgaatttgacaggcatcgttatgacctgaaggtccttctgtagacagaatcttatgttttagggaataagaacattataaaattagaagggttttttttttgagacagtctcaccctgtcgccc

SEQ ID NO: 118916 - DNA, 134 bp, Homo sapiens
aagctcaccaaaatggtcaaggaaggctgcatggaggaggtgaggcttgaaagaaatgcaacatttgaattgggagggaagaagagagagtgtgtgtaaggagaatgtttgcgtcagctcaagtgtggaggcag

SEQ ID NO: 118917 - DNA, 399 bp, Homo sapiens
acctctgaatggagggtgtttgatgattgagtgagtgttcaggtttagataaaactgcaagggagattttagcagagcatggcaatttattttctaggcagtcaggaactttgtaagcttttgagagctgcaagggtgcagtgatgagctctgtattttaaaaagtcatctttgtcagcaatgtgaggcgttgattggagccaagaagcacaatcaggaaaaaagctcaggcaatggttcaggcaattaggagtcaccacacttgtacctcttttgccttcttacagctgtatgtcatgcctgaaggtcagctcccaacccatcaaatcccacatttccagtgctcaaatagtattgaagtcctatctcccttggacataactcctcacttcagaaagg

SEQ ID NO: 118918 - DNA, 591 bp, Homo sapiens
gagaggcacagtttaagttaggagggtaagggatagtatatttctagtagttgcttttcactgagaatatgtggcattgcacgggttgttggaaattccctctccattttagctgctaaatttggcccgttgttactcagcacggtactcagagatggtgatgcaagtgctgtattaacctgataacattgtgtccaaagggaggcctgggcattttgaagtgattcaccaagcccattacattggcaggtctcactttactcgggctcctcttatttttcagatatgctattaattttaaaagggcctttgttcagggtgagtgtcagaattttttcttaattttattgctactgtgtccataaccagatttatgtgacttaggtgtgttgaatgtataactttaatagttaattcgtatgccataagtggccataaatgtcctttggagaaagggagagaatattgatcatctaaaatcaaagatgtgctgtgtcctcagatgaaagctttgtatcctgcataccttctagtacaatgccttgaagacagtgggtaatatttgttgaatgaaggtgaaaggacaacttc

SEQ ID NO: 118919 - DNA, 281 bp, Homo sapiens
acaggatactagcactttgggaggcccaggttgtaagatcacttaagttctggagtttgagaccagcctgggcaacaaggcgagagggctgtctttgtttaaacagaaaaaaagaatcccgtgtctgaatacagtcacattctggggggtaaggaattcaacatgagtacttgagggacatgtccagccgcctgtaacagcagtgaaaatgacatgtgctcaagtgggtttattttactttttaatttttgtgggtacacagtaggtatatatatttgtgg

SEQ ID NO: 118920 - DNA, 578 bp, Homo sapiens
aagaagcacaatctgaaaagacaaagcaaatatcagtatcagatttatatatagcagatatttggaattatcagaccaggaatttaaaataacattaatatgctaagggctccaatggaaaaagtgcacagcatttaaagtaacgtaagcagaggcagagaaattcttagaacaaaccaaaagcaaatgctcaaaatcaaaaatagtgtaacagaaatgaagaatgcctttgaaattagccaggtgtggtggcacacacctgtagtcctagctacttcagaggctgaggatcacttgagcccaggagtttgagactacagtggactatgattgcaccactgcactccagactaggtgacagagtaagaccctgactcaaaaaaaaaaaaaatgtgtttgttgggcccatcagtgtaacggacctggctgagaaaagaatcagtgagcttgaagatatgtcaatagaaacttcccaacttgaaaagcaaagaggaacaaaaagactgagaaaaacagaatattcaaaaactgtgagtcagttataaaaggtgtaacatataaggaacaggaacaccagg

SEQ ID NO: 118921 - DNA, 472 bp, Homo sapiens
ggttatggagccttcatgatgggattagtggccttatgagaagaaaggttcccccacccctccctccaaggagcacagagaaaaggccatgttaggataaagtgagagggtggctatctgcaagccagcaagagagcccttacccaaaactaaactctgcctgatcttgtcatggacttctagaatacatttctgttgtttaggtgcccagtctgatattttgttatggccaacacacatacttgtagataaatgctagggcaatactgtctagcaccttgtcctcagagaatggggcaaggcccagttttggtttggcccagggtacaatagtttgaacaacttatctttgctacagatcatttccaaagatctatccagtaggctacattctccttgcctgagactgacattaacctgtgggccatcctcagaaataatctttttccaagggttcaggagaagacaggat

SEQ ID NO: 118922 - DNA, 717 bp, Homo sapiens
cgtctcaccttcctctttcactacatatgtaatctaccagactaccttctcctggtcctcgtgggctgagatgctattttctcagattatggttgcctcctgttttttattcaagattcactggaagttccatctcctcttagcagcttcctgcctattgactatgaaatgagcaccctcatcgttcttaaacagagctttacattttcttctcttcataaagaatattatatattaagaatagataatagtaatagtatctattaatagatactatcaatatctataacagataatcaaaagattgttaatattaataccatctattaatagataatattactgataattaataattgtttatcatatatttcctcattagcatgtaaactctatgaaaagtagagaaaatacctggactcttgttcactttcttctcagaacctagaaatgtccttatcacatagtagacactaaatatttactaaatgaaaaaatatatccttgaagatttactagtataaatggtgtaaacagaatttcttggtgaagaaaaatttttaggtttttgccttataatttaccatctccatccttccaagataccaattttctttcccgtcgtccattgtacgggagggccaaggttgctgcacctgctggccaaccttgcatacgtaaattttgttttgacggttcaggatacaatgtttgaca

SEQ ID NO: 118923 - DNA, 316 bp, Homo sapiens
tcagaggcagcttaaaaaaaaaaagcaaaactattttgaaaacatatgttaagtctgtagggtgaacgcacgcccattatgggcaacctgatctgggccatcccctgtgctctgcctccaattctcaacggttccctccagtgtcagtgacatttagtaacctgtccaagaccagacagaagactcagtccagcccagggctgcctaggattgtcctccaccagtggacagaccagtggtctctgtgtcccggtgtgccctcacaggagtgcctggagaggttctcttaccctgaacacggtgtcactagctctcc

SEQ ID NO: 118924 - DNA, 357 bp, Homo sapiens
actgagacaatatcaatacacatgaatagctaatatgcattacttaggaaatactaatgttccatgactattccaattcaaaaaccttgactttttatataacttgaaatcattactaatgaaattggcaatgttaaacaagattgtctttttattttttcttttgagaaagagtctcgctctgtcccccaggctagagtgcagtggctagatcacagcttactgcaacctcaacctcctcgggttcaggtgatcgtcctacctcctcagcctcccaccgagcagctgggactacacgtatgtgccaccatgcccaactaactcttgtattttttgcagaaacagggttttgccatg

SEQ ID NO: 118925 - DNA, 382 bp, Homo sapiens
tcaccatgaggccatgacccttgccccctataccagagacctgaaaggcagctccacacagaagtgaccctgacaccctgaaaaatactcctacaggttgaatttcagctggaatatttttcccacctccctctgcatccggctccaaaaatagtcaaatctccaggcaggcaaaatagctggtcacccaaagacctgtgaccatctgcctgctctgccatccttagcactggtttctttcctccacattgtcttatggcttcatgaaggctgttggagctccagccatcacgtctgcattccagacagggggaaggagagaattcaggtgcaaaatgctaagcctattacatgtcagtctcctttagagagcttttctaga

SEQ ID NO: 118926 - DNA, 163 bp, Homo sapiens
gaaaaaaacatgcagagaagaagcattgaatggtcttacttgtgcaaactagtgtccaggcaaggtggtgaggagggaggatgggggaagcattaggaaaaactcaggggcggggctgctgctcttctccgccaggtcaatggccatctgcaaggaacccacg

SEQ ID NO: 118927 - DNA, 300 bp, Homo sapiens
gggctgcactcagagctggttcacaggcacttccacccacgtgccttggaccaaagcaagtcacatggtgtattaatctactagggctgccactacaaggtaccacacactgggtgacttaaatgacagaaatttatttcctcacagttctgcaagctccaagtccaaaatcaaggtgtcagcaggtttggtttcttctgagacctctctccctggcttgtaaatgtctgcctactacagaaagacctggtctttcctctgtaagagtctgtgtccaaatttcctctacttgtaaggaca

SEQ ID NO: 118928 - DNA, 256 bp, Homo sapiens
cgactcgagccggtaccctagtttagaagttcatagcagcaactctatttcttagacatggaggcattgggttgccagctagaaccaactgccctgatactcttcatccagttaagtggaaaccttagcaactataataaactatgagatgggtaatcagtgggcattattatctcatgtcttcatttgtcactttatgtagcaattcagggatccttattttttcacatatgctatggaaacttctaaaactagg

SEQ ID NO: 118929 - DNA, 922 bp, Homo sapiens
tcctcacagacatcagctcgggtcaaccgcgggcctcgagcccgagtggctgagggctgttaccttcaaacctttgaatcccacgttttccccttgacttcctgtcaccgttagagaaaagtggacagcgtctcggtcacagagttggagaaatagtgcagggactcttcagggagagcgttttcctcatcaaagcaaactgcaaaatcgcttctgccggcgtggacctgatgagagtcggtcgtcgtgagggacaccctctgttccctaacgtcccccgctgcttatttttaaacgctcggttggcgggaacccctgtgccagctgaaactccttcagtttggccgcctaggaaacaccgagagtcacctacatgggctggctgggcaataaaaacgggaaaaaatgtaaaagacacagtctccgccttcgaagcttacacccccggggcaagacctacaggaaaatagataatcccattattctctgataaaagccgagctgcttgccatgagctctgggagcagacggggaggccttgttgagaaagccttcacctgggagtgacaattgcgctgaatcttaagcataagtaagttctccagtttagggaagagagggaagggcattgcaaggagaggaagcaaagaggaagaggacctggtttgagtaattgggtatgaaaacagatattgcagcaagaactttgttgaaaaacctttaaccactgtttagttcggatgagaacattcccaggctcctacgtgtgatacgcaaagtattttccaaatcagtgtttatgctaagaagatgagcagttgagctggacaattataagataacttcatctttctcctgtaaggacacttaaatatcagaaacctaagagaaacgggttattgtcgtaattcactaagttatt

SEQ ID NO: 118930 - DNA, 650 bp, Homo sapiens
gtggctcactctgtgtgagaaggaaaattaaataccaaagccatctataaagtagcaaaattgccctaaaagctgcaaattaggtcgtaatcatacatcaatgacagagaagtacatggaagacctggaaggatattctagaaatagctaccatcttgatggttcatctcttcttaattacttaagggaatttcgacaccttattaaaacagaggaagtccaaggtgaactctaaaaccctccttaagtatccaattctatgattcggtgtgaagcattatcacacttgtcccaagggaacttaaccagtaatttcaacgcttcagtggggagtcacacgtcagatggactcttgcgggccatgctctcaggtagtggcttgagtccccctgctcctccaacaaggccaccgtccagctattaatattactcccaattccctggacttgctatgtcctctggcgtgtggagtgcctggctgccgccttcattctctatctgactgtctcctgctcatgctcaaagcccacacccaatgtcaccttctgggggacgctggtcccaaacacctgccttcccaagccaagtcacagctgagccctgtgtccttagcaccctccaaagccactgtcttccctctccatccccca

SEQ ID NO: 118931 - DNA, 227 bp, Homo sapiens
tgctgggattacaggcgtgagccacagtgcttggcccatattttaaatcttaaacattgcttaaacattatgacatatctatatacagagatgccttgtttctcttaatagttttgttgtatctcattgtattgacttacatcattggctgtctccagtcttgctagtactaacactgaagtgaatatcctagtaagcacagcattttgtacctattaatgtgtctg

SEQ ID NO: 118932 - DNA, 217 bp, Homo sapiens
agtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagag

SEQ ID NO: 118933 - DNA, 250 bp, Homo sapiens
taccatccaaattctatctgacttaacagtatctgaccaactgtataaaaaacaagctaaaagttcctaatttaaaaatcaggccgggcaccgtggctcatgcctgtaatcccaacactttgggaggtcaaggtgggtggatcacttgaggtcaagagttcaagaccagcctggccaacatggtgaaaccccatctcttctaaaaatagaaaaactagccaggtgtgtgtggaggaaaagttaaatatta

SEQ ID NO: 118934 - DNA, 458 bp, Homo sapiens
gcaaaggcaccggggggccagccaagcatatttggggacttcgcagaagttcagtctgtgtagacaatgtttttggggaaaaagacggaaaatagagatgaggctgataagtgagttttgggactcctgtatcaggctaaggagattggactttgtgctttcaaagaggtttctgtgtgaaagcattgcatcccagttaggaaggtcactttggagagtgccctgaggatgggttttggtgggatgagaccagaaggcccagagagtctgactgaagtaaggagagacagagacaagggcgtgtcgccagtgatgatcatatccaggggcaggaacctccagttcttcataacccaccgaatgtttcgggaggaagaggagtgggattctttgaggatgagtcccaggttgcactcccaggctggctccgcagttagatccagatgatgcggctcccc

SEQ ID NO: 118935 - DNA, 828 bp, Homo sapiens
ggagcgcccagtggactcgatagcgctgtcctgggaacagaaccttcccggactgtgcacttttaaccctgcaggttctcagctgtctgccgtcagaaggaaagcattcacactccagttcccaggagactgcagccaggacgcttgggtttccaccacggattcctctgctgaggggctgctccgcggtaactttcctcccgagaagcacaggaatgaaacggcgatgagccccgtaggtgaagatgatcgtctgttcacctgcagttcacagaacctttgatgttactctatcgtctggatctcttttgcctgtgagggaggcagagaggtatttaggcatgaggcagcagaggtttagcaagaggtgctcctggagggccttgaacacccatcctaaaggggtcctggtgttgtcggtggtgagaccaggggtcaaggctgcactcaagcactaactctgtgaacctgactgctcagtagtttccatagctaggtaccacaccagcaatctgaaaagccttggacctccactccccaagcagctgcttcctggaatgaaaaagaaaggttcatagattcacaaactccctgcattggaagggaatttagaagtcacctctggcctgcccatatttcctgtgctttctgcctcaacaacatccgcccaaacactccagcctgcaagaaccttcttcacacctagccctcggggcccagccctctggaggtgcgctcccacctgctccagtgaaataggaccatcacctccttcattctagacatcatgctcctattaatgccccttagaattcatagggtgatttg

SEQ ID NO: 118936 - DNA, 699 bp, Homo sapiens
tgtacatggtgtgggacattccttattcctttggccctgatagccttgttaagcctggtatcaatgcacacatctggagtgcccatcttcatggcaaatttctgaatctctttgaatgcccacagagcatgcttcttgaagcccactccatggatgtgagctagtgacccaagtgtgttcttgggtcactaccttgttgatggcagaacagctcatcttcttgccacccttctttgcaggagccattctgccaggcccaagatggaaaggaagaacatgagggacggtgggagaaagaaggcctaaacttttaaaaagtggctgcaccattttacatttaagacattttgacacattgtatttttgttgttatttgactctctagataatttctgccatgactttttctgtaatgcacaaattgttttttgaagagttttaaatttcccaactaaaaaggcttttctagttatttttcttttataatgtctaacttggctgggcgtggtggctcatatctgtaatcccagtgctttgggaggccaaagcaggcggatcacctgaggtcaggattttaagaccagcctggtcaacatggtgaaaccctgccctctactaaaaatacaacatttgctaggcgtgttggcaggcacctgtagtcccagctattcgggaggttgaggcaggagaatcgcttga

SEQ ID NO: 118937 - DNA, 123 bp, Homo sapiens
ccaagagtctacatttgatctcccattcagaagtacttcttccccttttctaggtctctgggtcatgcctcctttcttttgagatatataaagccccatatgaattcatctgccattttgcct

SEQ ID NO: 118938 - DNA, 610 bp, Homo sapiens
ttttagtagagacgcagtttcaccatgttagcctggatggtctcaatctcctgacctcaagtgatccgcctgcttccgcctcccaaaatgctgggattatgggtgtgagccactgcgcctggcctgagagtagatcttaagtggtgagtggaagaccagaattcacagaattttaaagctggaagagacttcaagaaccagttcatttctcttatttcagagatcaggaaatagagccacaggcttgtcagtggtagaactgtaacaaggcctaacaatttcctcagtctgtgtgcctcctaccccattattctacccatcctataatttgggagaaaggagagagaggaggaaggcaagaacaactaaagagtaaagcttcaacttataataaatgcttcgaataggtgctcagttacacaggtaatgttagagggattttaacaagttcacaattcggttatgcttagttgtgtggctaactatgtacactggtaggaataatgatggaaatttatattaggaaatgtgtgattgcacctatagttggcctgataaccaggaagctgaaataatgcagcttttgttccctattgacactggcctagct

SEQ ID NO: 118939 - DNA, 263 bp, Homo sapiens
aaatgctagcagttatcaccacagtgggagccacagggagctctgaggataagcagggatgtcgagggatgggacagaacttgattgaaggcagacagacctccaaattcttgactcagacagaatgatcactgatccagcgagacgtcaggatcgagaggagtgtagcaaggagtcaggagggtgggcctgcgccagtgtcgccccgactctgttcagtaacatgaaggcaaacacagaagggcatgtgcggagacacacgt

SEQ ID NO: 118940 - DNA, 183 bp, Homo sapiens
tgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtat

SEQ ID NO: 118941 - DNA, 125 bp, Homo sapiens
gtatttcttcttaaaaaattatacaatggctatatgactgtttatgtccacaaagtccagccagattacttttcaaagaaattttagcagtttgattgccaaattcctgtgatctccatattaag

SEQ ID NO: 118942 - DNA, 339 bp, Homo sapiens
tgacatgattaattgccagtagccttgaacagaaaattttcgggagtgtttgccttatgagttgccttctctaagcctagtgtggcatttctgaaactatttctagtggccactctataatttctccttaaagtatctcaaaatctgaaatctccttaaagtatcttacatctgaaggtctatctagcttgaaatgattttgcattaattctattggaagaaaatgaaatacctcaacttcctaacctattagaagttaatatataacatttttgggaatgttatactttcatttaaaaatatgaaatcgtatctgaactgttccttaagtttagggac

SEQ ID NO: 118943 - DNA, 534 bp, Homo sapiens
ggtgatggaagctgttttattgtcagcaagacttagactatgtccctgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctga

SEQ ID NO: 118944 - DNA, 906 bp, Homo sapiens
ggtgatggaagctgttttattgtcagcaagacttagactatgtccctgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctgaatatgaagaactttgttaaatactcttactccagcaaaaagttggtcaggacgatggaattccttcctcagcactccctgttgcctggccatagagaaggcctgcttggcagtagcaataaatgtcctgtaagctgccacctgggagagattcttatgcaggtggtaaccaactgtcccagtttgcttggaactaaggggttttctgtgacttgaaactttcaatgccaaaactggggcagtctcaaaccaacatgattggtcagcctatatgtaggtgaggaaactgaatcataagcattgtaaaggcattggctgtcaaagtgtggttcttagaacagcagcatcagtatcacctgggaacttgacagga

SEQ ID NO: 118945 - DNA, 354 bp, Homo sapiens
  misc_feature (1)..(1): n is a, c, g, or t
  misc_feature (7)..(7): n is a, c, g, or t
  misc_feature (12)..(12): n is a, c, g, or t
  misc_feature (21)..(21): n is a, c, g, or t
  misc_feature (29)..(30): n is a, c, g, or t
  misc_feature (38)..(38): n is a, c, g, or t
  misc_feature (47)..(48): n is a, c, g, or t
  misc_feature (51)..(51): n is a, c, g, or t
nggaganggttnggcgcgcgnggggcggnngagtgggnggggggcgnngtnagtccttcccaaggaccatggcgtttaatgtcttgggcaccccttggaaatcacagaaagtcagctgtactggccgtgtggaactctcatcccaagacctactttgaactgagtaagaaggtcattgtgcccactgcatttgttccaacttctccttgtataaactcaccccagcaacacagggcaaggatatagatgcttttagtttgttcttaaaccagttttgttaaatgtttacaaggacctcagtactaaagcctgttctctggaggaaataaagaaaatatgtttggaggtgcctga

SEQ ID NO: 118946 - DNA, 901 bp, Homo sapiens
gatcaagaaacagaaccccagctgggcgtggtggctcacacctgtaatcctagcactctaggaggttgaggtgggagggtcgcttgagcccaggagttcgagaccagcctgggcaacatggagagaccctgttgctacaaaaaaattttaaaaattagctgggcatggtggtgtgtgcctgtagtcccagctactgggtggagatggaaagattgcttgagcccaggaagttgaagctgcagtgagccatgtgtgcgccagtgcattgcagcctgggtgacagagtaagaccctgtctaaaaaaaaaaataaaggaaaataaaggaaaaaagaaaggaaacagaaccccatctctaccccagaagtccgtcatgtgtgctagtcgttgctgaaaagtgtttttatttctattcatgctcatgcctcttcagcaggagtaatattccaccccttctagaaggcatcttctggggaagcctgagttcactggtcttcctatttagtctcctgagatcctgctgccccttacgggtggtgtcccaggcggcctggctgtcggctcctctggttacttctacaaccagtgcatcctggagatgctggaggggcctgctgtagcagggaggtgggggaaaatggtcctccctggctcaggcatggagggtaacaacccctgctccctggtgtggccaacctgcagagccgagcttgggcacgatgctcacaaagtcaccgtctcctctctgccgaggtgaccaccttctgtcctcctagtcagcaggtgtcaggatggggtcattgcctcagaagggcatgaggggaaagaggaagggttggccaacttcggtggtagcaactgtccccttcttacatggatcatgcggccctaatggccactgtg

SEQ ID NO: 118947 - DNA, 909 bp, Homo sapiens
taggattataggcatgagccacggcacctggcctcggccaacaatcttaacaaagaagaataaagttgaaggattaactcttcttaattttaaaatttactacaaagctactgttatcaaaacagcgtggtactcacacaagacagacataaagatcaatggaatagaatcgaggtccagaaataaacctatacatattgtcaattggttttcaacaagggtggtcaatacaattcattgcaggaaagaatagcttcttcaacaaatggtgctgggccaaatagatacctatatgcaaaggagtgaagttgcactccttcacgataaaagacaaaaattaactcagaaggaatcaaatgcccaaatgtaaaagctaaaagtattaaactcttagaagaaaacataggcataatcttggattggttgatgttttcttagatatgacatcaaaactgtaagcaatgaagggaaaatagataaattggagtttgtcaaaatcaaaagctttggccgggtgtggtggctcacacctataatcccagcactttagggggccaaggtgggtggatcacctgaggttgggagttcgagaccagattgaccaacatggagaaaccccatccctactaaaaatacaaaattagccgggtgtggtggcacatgcctgtaatcccagctactcgggaggctgaggcaggagaatagcttgaacctgggaggcagagactgcagtgagctgagatcatgccattgcactccagcctggccaacagagcgaaagtccatctcaaaaaataataataataaaataaaaataaaagctgtctttcttcaaagcacatcaagatagtgaagtgacaatctacagaatggcagaaaatatctgcaagtcatatatctgataaggga

SEQ ID NO: 118948 - DNA, 1412 bp, Homo sapiens
agtagaaacgaggttttgccatgttggccaggctggtcttgaagtcccaacctcaagtgatccgcctgccttggcctcccaaagtgctgggattacaggcatgagccactgtgcccaaccaccctgtcacatttctaatgatcaaaagtttttactccctgttctgggaaattggagaggcatttcttatagagtccattgcacagtgccatgcttatgctcagtgattagtaatctgctgctgcaaatcaaatgactccaaagttaggagtttaaaacaacaaacatatactgtctctggggcaggaatttgtgtgtgacttagctgggtgcctgcagctcagggtctctctcggggctgcagtcatctcagggccccacgtggggagaatctgcttccaggtttgctcatgttgctgttggcaggccccaggtcctccttggctgttggccagagacatcagttctttgccacatgggtctctccctagggcagctaacaacacggcagttggcttctctcagagtgaatgagcgagagagagagagattgagattgagagagggcgtccaagactcaagccacattctttttgtaacctaatcttagaagtgacactaggtccagcccacactcaagggaggcacatcatagaggccattcgcctcatgcagccttgaaagatgatgggcaggaagtaggcattgaagagggtaagagtgggattggcaagcccagcaaaagaaactgcccgggcaaagccctcaaggcatggaatggcagggagtgtttctgaagggcaggagcctgtcttgtgacctgtgttttcttcctgggccccaggtggggcagggaatcagaaggggctggcatcagcagctgtacctcacccaatcccttaacttagacaaggaagaactgagcaggagctgaccagccaaggccacggtgactggcaagttgctgttgggttttagcatctgcttttcccaggtggaaaagaattccatgtgggaatttgcattcaagcctggttgtcccttgcacatctcctaactgatctctaagctcccttctgttctctcctcaccctgctccagtctttacttttcatagactgcactagaaggattgttctgaagcctggagtaaccaggccatgcccctgcctgaaacttgtcttggctcccagtgcctgagagtacaagctgggcctagcttcttgatgtggacattcaataccccactccccctgcctattgcccctgcctgtgtgctgaggaaacagcctggaaaggctgcctttccctgaactcctgctgggtcatgcctccagccacactgtccaggctgccccctgccttgaggccgctcctccagccgggcacagtggctcacgcctgcaacccta

SEQ ID NO: 118949 - DNA, 2716 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtaaaactg

SEQ ID NO: 118950 - DNA, 1945 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacaccaactttatggactgcccatgggagtgctccaaatgtcagggtgtttgcccaataataaagccccagagaactgggctgggccctatgggattggtaaaactg

SEQ ID NO: 118951 - DNA, 1129 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctaaatcgaaggaccggtacttcgaagggtaaaccacatatcccgga

SEQ ID NO: 118952 - DNA, 2839 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtaaaactg

SEQ ID NO: 118953 - DNA, 2423 bp, Homo sapiens
gaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgccccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggtaaaactg

SEQ ID NO: 118954 - DNA, 336 bp, Homo sapiens
gccagggctctgagcccacctatcattctgtactgcgaagtccaggcgactccccgctgagatctgaggacatgccctctcccagcttggcaaaggaggccctatcatttggatgaagggagaagctgggcacggaagatcctagtagctgtggctagggtctagggccttggactcaggacactgatctcctgggcttgacagggtggaggagcagagggtggctgagggagaacctggtgatttgctttcctggggtctcctctttcctgggcacaagatccctgtgtccctgtcttgccagaccctcactgatggtacggtctctagcctttg

SEQ ID NO: 118955 - DNA, 553 bp, Homo sapiens
gctctgagaggtcccctttcttgcccacgatcgcacctccttgggtcaagcgattctccctcctcggcctcccgaagtgctgggcttacaggcgggagccactgtgccctgcctgtgttgtctttctttaagcttagagtcttgggttttattctcgcaggtaggtaatgagcttgtgcgtcagcttggtctgtttgaagcttgtttctaagctttgtttgggcagctctccagcacctctagagaagctccagggatagagcagcccaaggcgtgtggcctctccagggcttcagttggagttttgtgtctttgtgtcttcggtaaggtcttgccacactggctttttggaagtccagtatcttttagcattcctctagaatttgggttcagctcatagttttgtttttttttttttgaggcagagtctcactttgtctcccaggctggagtgcagtggcgcactctcggctcactgcagcctccacttcccatgttcaagcaattctcctgcctcagcctcccgagtagctgggattacaggtgcccgcca

SEQ ID NO: 118956 - DNA, 698 bp, Homo sapiens
accgtgccaacgccggcggggctgcaagcagggccactctgagcaagcaagggagcccagagccgctgttggccctgcccaccaactggccagagggaaggtgagctccagaagggaagggagttctttcacagctttctgtctctgtatctcctgtgacttgaatggactcagcacacagcaggcctgagtgaaggatgcttgtggttgctatggcttacatgacaacgaattgtctgtaatcctacaggactatggcacatgaaagctggaagcgcttctttccgactgcatcgcccagcaccagagcccgagttctgtaaagctctgttaaaggcacatgagctgtgctggcttcaactgccctgaacttggataagctgggccgctgatggacccttcccaaccggttgttgctgccttggtttcccgacagtccactgtgctgaccctgcagcagggactcccagctttgcatcaactccattcaacacctactgtgtgcagggaccagagggtgtggaggtggcattccctgctttatcttgataagtaaacgtttgtctcctgcccactcatcagtgaagcagaacaactacctagcagtctcctgggagccacccctccagaacctctggatgtcaacagacaccatctacttataggattcagccagcacatgtgtagactggagctgc

SEQ ID NO: 118957 - DNA, 316 bp, Homo sapiens
cctgattctcagaaactgagtgagctgggattacaggtgtgagccattgtgcccagtctgggtctgcttgttataactaattaactgtagtggtaatttgtggtggtgttttgttctgtttttttagtgtgtgtgtgttttactggtaaaagtaatacattaataatttcattttacacagtttaggaggtggggagaaaacacttctgattccatggccccacctcaagcaccaccatttgaatcattttggggctaatttttaatgtgcaatccaaggtgaatgaagatctctcagacacatgcaccttaattt

SEQ ID NO: 118958 - DNA, 339 bp, Homo sapiens
taatggtttgcctgaaggttttgagaaacacgaatgatgtgttacatgctttgtcttttttggagaccatttttgtgttggtaatctcctaaatgagaaggatgttagataatatattgtctgtttacctaagttaaagggcctttttattgctcctagagaatctaaggatgttaagaacatgcttctggctgagtgcagtgattcacgcctgtaatcccagcgcttgggaggccaaagcaggaggattgcttgaggccaggagtttgcgatcagcctgggcaatatagcaagacccccatctctacaaaaaataatttttaaaaattagctgggtgt

SEQ ID NO: 118959 - DNA, 343 bp, Homo sapiens
gcacgagtcaatagccaggtacgatcactcccttcattcaccctgggacttgtgcataggccagactcccgggatgtcagccgcatgtgatgtggagataactgtgatcttattatctgaaatgtttgaatacggagagggtcccagtcttcattagaaagaaacttaaccaggacagtaaatatgttcaattcctcttaaaatgtccaatttactgataagtggggcacattttttttcatttaaaaaaaattggaatggccaccttaaggcaaacatttgagaagaagaaaaataatacaaatatattacttacaaaacaatacaaaagtgtctcagacca

SEQ ID NO: 118960 - DNA, 193 bp, Homo sapiens
attggggtgctttaaattctcatcaaggaactcatcttttggagtaagatactgtgtctccgggaggcctttgctggaaagaaaatacatttgctgtgaaagttcataaaggtatttgtctccactctcaggagtggcttgattggtttattagaagtatttgctaatgtttcagaaagccgtgttctgagaa

SEQ ID NO: 118961 - DNA, 192 bp, Homo sapiens
gacgggttactgcgtgttggagagtctggtggagttttatatactgaaatctacattgacgtgatgtagacaggcaagatggcgagagaaaggacaagaattccactgtggtgaacgagagctgacacccatctgccaagtgtgtcacatcccccagaaaaatgctcatttctcccaccctctgaacccacc

SEQ ID NO: 118962 - DNA, 286 bp, Homo sapiens
cgtcgactttttagtaagactttgaccccgacgcaggcttcagtgattgccgcggatcagaagcctcagcttcccgccaggccctggccgtagcggtcaggaagagctgagcagtttttttgggagaattgagggagcgtcgccaggatgcactgagggtcggaggtggagccggcgcggctcagtgcaggcagtgccaggctggatgctggaaagccagcagcacctctcccggtggctcctgggaagttccacgtccttgcctggtcacagaggcccgggaatc

SEQ ID NO: 118963 - DNA, 435 bp, Homo sapiens
gccggctcctgtcctggtcagcctgatgtcagctgcacgttggggtcagcctcggtgctgtgtcttcatgccagagcaggggccaggtgtgggcagctcagtgacaccctcccgagggctgggcgatcgtgtgcactctcaagcctctactggaaggcttggccctctcaggggccccctgcccctgtgcattcagccactggggttcgtgccctcagcttcccgccaggccctggccgtagcggtcaggaagagctgagcagtttttttgggagaattgagggagcgtcgccaggatgcactgagggtcggaggtggagccggcgcggctcagtgcaggcagtgccaggctggatgctggaaagccagcagcacctctcccggtggctcctgggaagttccacgtccttgcctggtcacagaggcccgggaatc

SEQ ID NO: 118964 - DNA, 527 bp, Homo sapiens
aaacagtgaggatcgaggaaaacaatctggactttgagtggttgtttaccacttgtagggttgttctaacatggtgtttcagcgcagggctttagttctgttcctccaaccatgcccttattgccaagtatttttccccatttccctttccaacatgttttaccagttccaagaggatttgcatttagtgaggaagggggaagatcctaaatcattgcagaatttaatttttgtacacttttcaaataacactgtattgattatcttaatggtcattctgcattcctattcctatttctcctctcaaagatctcactccaagcaactgatctgcttcatcgttagtaagaggtctttggatatataaggatgtttgctagtccttgccaggtagatgtgagacctgaagcatacctgctcattgcatgccctgccacactcttggtttcctacttttgacacagtaggacttgttaggatacaaaactgtggggagttggcattttatatgcatgttaatttttgcc

SEQ ID NO: 118965 - DNA, 289 bp, Homo sapiens
gggaacgtggctgggaggcagctgttcctgtatcctaacatctagacgctcattcataaactttgaccctcacaatagcccagagagaggcgttcctagccccatttaaagagtgggaaaaccgaggctcaggaagtaactccttgagcacttaggctgtcccatgtgctgtcccagcccctgcatcgcaacatgacaagtgtatcaccctcattttgtacacaaacaaaggtccagggagattaatgtccaaggctatagcaccgaagctgggattcaaaaccaggac

SEQ ID NO: 118966 - DNA, 661 bp, Homo sapiens
gctcgacatctaaaggatcccctttaccacctctagtatcaccctccactgggctccagtgcacttaggatacagaacatggtctcgaagacattcgtctgtaaaggaatgctgcctcattttgggacagcccccgatataaatcaggatgggccttctttcaacatcttggactagcctagctttcccactgctgggccctcacacacgctgtcctcttgtcaggagcattcttccctccagtcctcagctgcccacctacttttccatcctttagatcctgactcaaacatcgcttctttacaggcaccttccttaaatcttaattatattaggtctctccgttagactctcaggtagtttttttcctcactgcatttgccaagtttataatcatgtatctgtagacaacaagagggaaggctcgtgtacagggtggcatttgaggggatagggtaagggcaaacactggagggccactgaggtttctatgtaagaggtatacgtaaggcaggattctgttacttcaattaatcctccttggaaaggcaacatgagcaaaattaagtcttttattccaggcagttcattttcttttgtaaatctctaaaataagcctttagaaatgaaaccaagttttttattccaggcagttcatttt

SEQ ID NO: 118967 - DNA, 465 bp, Homo sapiens
cagtgaccttctattccattccacttcatgctccccaggacataccctgacctttgtcattccctccacaattacatatttacctccacaatcacaaatttagacatctcctatcctaccaatcccctgtccttgccaaaagcttcccaccccaggaatcattaattctttcacctgttaactgtaatccacagattctcccattttcttcccaactaccagccctcttatcttcactggcttcttactcagcttaagatttaagagccatcaccatcctcactctcaagcaatcctctgcaaatcccctgtcctctcccctccaaaatgcccatctagcaaagctaccacaggaagcatcattcacatttgctcaacttggacttgagggtaccagtaggtaggcattcattcactcacacgaatattcttctgcagaaagggcactgtatcaggccctgagta

SEQ ID NO: 118968 - DNA, 405 bp, Homo sapiens
gttcaaagtttattttttgtattttttccctaaaatcaaatccaagattgtgtcatttctgtgtaatggaccgttggctatctgatgcaactggaagttcttgactcacttgccacatggctcaaataattacccgctcccttcccggtgctattttgattgacattttgtcgtatatatggcccttacagaggcagttaatcctcgttttttgacccatatcctcaggattttgatcttctttcagttaatctctttatgttaattctttcttttttctctttatgttaattcttaatgcaacatcaatgaaacttatagttataaatcttttgggaaaagtggtttgcacttccactgaattacagatctgagatatgggtgaatctttaaagtactggttca

SEQ ID NO: 118969 - DNA, 586 bp, Homo sapiens
  misc_feature (522)..(522): n is a, c, g, or t
  misc_feature (524)..(524): n is a, c, g, or t
ctcctgcctctttgtctgccccttgcttctgtgggggcaagtgagtcagtgtgagctcagcagagagtgcaattaaacatcagcaagtatgatcccaccagtgtggaatttctaataattcagtcgtggctctcctactgtgactccaggaaacaaagtctgaatctctttttccacgagagtttgaagaactgttgcctgaaattagtgggtttcttcaaagccaggcttttgatgtgctttcaacttttgcatccagcatgaacttgttagggtagaaaatttgcttatttgggatcaaacagtatagagggtgggctcgctgcaaattgtcacttaacgtgttcatctatgtaattattcctgctcagccggactcaggcatttcaatatctgagccaatagcctgtgccttctagtgaatttggggtttggtattgggctctttgttcatctctctgagatactattcagcatgctacattctgacacatggacatgtttctccccatccctttcttngnagactctcttaaacttttaagggcattatatctgaaataagagcaattagtgacaatagctt

SEQ ID NO: 118970 - DNA, 364 bp, Homo sapiens
tgcatgccacacatgcacactgtccaggagcccaaggacaggtccaccttgcctaccactgattcctgtgtgcatctcccagaggcccaggcactggcccacccagcctgctgctgccagtcagtaccagcacgccacccaggggcctggggactggcccaaacagattgctgttaccaccaccctgtccaaaaaaaaaaaagacccaattgtatgctgcctatcagaaattcacttcacccgtaaagacacacatagactgaaaatgaatagatgaaaaaaaaattccatgcaattccataaaattggggaaaaaatgactgttataagtgactgatatcctgcatgcttttatttatttatt

SEQ ID NO: 118971 - DNA, 538 bp, Homo sapiens
tctcagaggtggcagacgtgtccaaccagaggcatatagtccagctagactcagggctggcagtgaacgatttcaggacttagactaaaatgactgtggaaggttctgatgtctctgtcgaaaatcagaagaacagaagcacagctatctgccttctaaacacatgcttctctgtaagataaacatcaaaatatcagattgcttgggacacatctagatgtgtcctaaaattgccaatgcccagcccagtacagcccagtgaagcagattctaagggcaggctccgctgcctaggtggttctcacgatcgctaaacagaacaagctcctgcttccattagtaagctcaattcacaagcaaaacaaaacaaaacaaaacaaacaaacaaaaaacaatgaaaagctccagctgagaacagtggttctgcatttcagctgcaggttaggatcacacagagtgctcttttcccagccctaacactcagaatctctcccttgtaaagctctctagagagcttagcatacagccagatagagaa

SEQ ID NO: 118972 - DNA, 279 bp, Homo sapiens
acaagtctcagaaaattttttaaaattaaaatcatatcaagtgttcttcaaccacaatgcaataaaacaagaaattatgacaagaatttaagaaacctttcaaatacattgaaattaaacaacattcttctgaagaactgatggatcagtgaataaattaaggaggaaaatttttaaattcttgagataagtgataacgaatacaacatatcaaaacctgtaagagatagcaaaggctgttctaagaatgcagtttatagcaattaattcctacatgga

SEQ ID NO: 118973 - DNA, 344 bp, Homo sapiens
actcagtgaaggggaaacgtctccaggctcggaggtggactcagcgcggggggagcgtctccacgctcggaggtgggctcagcgcggggggaacgtctccaggctcggaggtggactcagcgaagggggaacgtctccaggctcggaggtgggctcagggcgggcggaacgtctccaggctcggaggtggactcagcgaggggggaacgtctccacgctcggaggtgggctcagcgcggggggagcgtctccaggctcgcaagtggactcagcgaagggggaacgtctccaggctcggaggtggactcagcgaggggggaacgtctccaggctcggaggtggac

SEQ ID NO: 118974 - DNA, 466 bp, Homo sapiens
gtgccagtgatagtcttggtggaaacagaagaagaaaagacttttgagcaaaatctggatatgattaaatgctggatttgcccaggaattgtttaggttttacagctaaatgttattgttatttattaaattcctgtagaaaataacttctattgtaaatttgaaattttatagaccctaaaccccttttccctatgagagcagttatattttataaaagttgtggattacacaagatatcttagaaatgcaaatattgtgtaatagcagaagagattgtgcttgctaaattttcctggatcctgtcaaacaaacacttaataacttatattaattttggttgtgctcaaatatgttcttattgaccttgtttatttttcacattttttaaaattatactttaagttctgggatacatgtgcgggacatgcaggtttgttacataggtatatacgtgccatggtgg

SEQ ID NO: 118975 - DNA, 878 bp, Homo sapiens
gtggaactaaactgtaaacaaagtttgtgttattattcagataaagcctctcaggtaataaaagttgttttggagcagcctccagaagaataggtagtagccagtctgggtgtggtgttgacttttaatatcttctgcagtgattaatcttccctggttgtttgatgagcttcctaaagaggtggatcaagacaattgcaatccttctggaaaatcttcccttggtcagatacatgaacctccctgcatttcaaaaaggaaagaggtggtggcgggctggatcaggagaagatcagagagagactttgattctgaggcttttaaatcacatttgttcaaagcgctcagcatgccaaagggccatattttgaggatttttttctgaaccccaacagaggatacagcaataaggcgtgatggctgcctgaaaaatcaggatgtgttttctccccaggaatcaaatcaaccagcaccttgatcttggacttctcagcctccaaactgtgggaaataaatttctattgtctaagccacctagactggtattttgttaggagtattttactttggtaccaaggatggtgtgctgccataagcaaatatctaaaaatgtggaagtggctttgaaactggataatgggtagagcatggaagagttttgaggtgtgtgctagaaatatggatgttaaaggcaattttggtgagggcttagaaagaaaggggagagctggagagaaaaccaccatctttgtagagaatacttaagtaatcatgaatgcaatgctggtagaaatatggacattaaaagcggttctggtgaggtctcagaaggaaatgagaaacaggttattagaaactggaggaaactgctactttat

SEQ ID NO: 118976 - DNA, 332 bp, Homo sapiens
cctgagtatctagcgctgggctcagggctgggagaagcacctggcttgctgggcagctctttggaggcaggaacagttggtgcaggtttggggctggtgggggatgatggagagggacagggagagaggaagagcagtttgagttgggtccaaagaggttagcgtactccatgggtgcatgggtgtctttagtttgtcttcatggagccctaaaacagactttcatatgatttaaccacagttctttctctgagggtacaacgctgcttggtcatggatttatttttctgaacaagctattattcctcattttgttcaaatcttgtaagctc

SEQ ID NO: 118977 - DNA, 440 bp, Homo sapiens
gcacgaggtggtgatggttgcacaactctgtgaatatactagaaaccattgaattaggccaggctcagtggcttatgcctgtagtcccagcactttgggaggccaaggtgggtggctcacttgagcccaggagttcaagaccagcttgggcaacatggcaaaactttatctctacaaaaaatacaaaaattacctgggcatggtggcatgagtctgtagtcccagctactcaggaggctgaggtgggaggatcacctgagcctgggaggtggaggctgcagtgagatgtgatcgcgccactgtacttcagcctgggtgccagagtaagactgtctcaaaagaaaaaaagaaagaaaagaaaccattgaagtatacactttaaatcactggattatatggtatgtacgttatttcacaataaagctgttttatttttaaag

SEQ ID NO: 118978 - DNA, 719 bp, Homo sapiens
gagggaaagttaagggaaaaggcatgggaacagtggtctctgggaaggtggcagggtccagcaatcactagtaaaggaggaagaaagggggatggggcatctgagggatcttcatctgtgtcatgattctgcttgagaccaggcctgcttccacttgcccaccatggagccaagaagctttagaggaaaaatgttccatcctggatgattttcctcggcccctgtgctgccaacaatggagacatccagagctggcagaggttggcaccagctacctgaagcctaataagtgcagcccttcaggccctaatccccagtgtttagccctctgtctcctggccctagctctaacaataggtgctacacacacagctatacttgaaggaagaggccactcaccatctagcaaaaaagaggatggttaggaaaggacatagatgatgccaggcgcggtggctcatgcctgtaatcccagcactttgggaggccaaggcaggtggatcatgaggtcaggagttcgagaccagcctgaccttgatgaaaccccatctctactaaaaatacaaaaattagccaggtgtggtgatgtgtgcctgtaatcccagctactcaggaggctgtggcaggagaatcgcttgaaccagggaggcggaggttgcagtgagctgagatcgcgctaatgcactccagcctgggcgacagtgagactctatctcaaa

SEQ ID NO: 118979 - DNA, 1554 bp, Homo sapiens
aaaaattttatcttttagtggtaagaaactgatctgatttattttcttctccaatgagttgactcattggatgattaagtgaagtatagacatagcaatatgtgctttaattttacaaagtcattttaccatatcacagagaattggcctccatgttaggtaacaatatttgttcatagtgttgtttatagtttcacttacagttgatcatagattaaaagctgatatttttcagtatttctatagtactggcaattttatcagttggcaatattaaattgtactgacacagtattcctagataggacgtgtaaagctggctggtgtaatgaagagaggcgctgaccttggagttagaagactaggtttctgcatcataatctgccactaaatagctttgggcatgtatctctttgtcatgctgtgacatattgtctgactgtgacaacatctgtgactctggttagaccttgacaactgatccaagaaaatctgaccaacatacctggttactaatggaaaatatgcttttgctaacaagcagagattttgagtacaataattttgtcagttgtgcattgcttatgatgaatgccatgaagaatacatattttttggctatcccacatcatatataactgtcaatcatacctgttcaaattctgattgtccattctgtataagatccttgcagattaaaggaagctttccaactactggaaagagagctgtggagctcatttctaccaatatattactatattaactggaacattatgttactgtattaaattagaaccattcatagctgtctatttagtgacagagttccttcctttttttttctttttttttttttaagaattaggtgaagtaatgatttgtttctcttgctagattgtaagctccatgatggcaaagactatgtctgccttgcttccatttgtaactaaaatctagcagaatgcctaggctaacaaaaaatttttggttaagtgaaaaaagataataaattaattccctcatctgttaatctattggcatgtcacagaattatcatctggtaccagtgaaagaattacttaaagtttgtatgacaactgttatttcaatttatacagatgattcaggattgagtaaaggttgaattaagacatttggtcaggtgtaatgctcaataaattgagcattcgctgagattagtaaatgctgttatttcagtggattgcaattatttaaagtctggtgtatgtaatctttattgtagtccactttaatcaggcataccagtgatctgtaatagaatcatgccacaaagagatttatttttacactcagaaaaattctcatatgtttggttgtttgcttctagacagtttgtggattaggccaggtgcagtgcctcacacctgtaatcccaacactttgggagagtgaggtgggagagtcgcttgaacccaggagtttgagacttgcctgggcaacatagtaagaactcgtctccattaaaaaaacaaaaacaaaaacaacctttttaaacctttttttaaatgt

SEQ ID NO: 118980 - DNA, 750 bp, Homo sapiens
agtacgtataatagacccatacgtctattatgacagattcctcctatcctgttttaagaattaggtgaagtaatgatttgtttctcttgctagattgtaagctccatgatggcaaagactatgtctgccttgcttccatttgtaactaaaatctagcagaatgcctaggctaacaaaaaatttttggttaagtgaaaaaagataataaattaattccctcatctgttaatctattggcatgtcacagaattatcatctggtaccagtgaaagaattacttaaagtttgtatgacaactgttatttcaatttatacagatgattcaggattgagtaaaggttgaattaagacatttggtcaggtgtaatgctcaataaattgagcattcgctgagattagtaaatgctgttatttcagtggattgcaattatttaaagtctggtgtatgtaatctttattgtagtccactttaatcaggcataccagtgatctgtaatagaatcatgccacaaagagatttatttttacactcagaaaaattctcatatgtttggttgtttgcttctagacagtttgtggattaggccaggtgcagtgcctcacacctgtaatcccaacactttgggagagtgaggtgggagagtcgcttgaacccaggagtttgagacttgcctgggcaacatagtaagaactcgtctccattaaaaaaacaaaaacaaaaacaacctttttaaacctttttttaaatgt

SEQ ID NO: 118981 - DNA, 276 bp, Homo sapiens
ggtaagcaataaaagtcagacagagatcacgcaagactttgttgaacatggcaaggagttatttttttcccagctgcaatggggagccactggaggaatttaagcaggagagtaacatgatctgatttacatttttaaaatatcactctggctgctgtgtggagaatggattatcagagggaaggacagaaacagggagaccatttaagaggctagcacacaaatccagcaagaaataaaactactttgaactacgatactaatagtgaagagggg

SEQ ID NO: 118982 - DNA, 193 bp, Homo sapiens
agactccaaccaaaaaaaacaaaaacacaccagttgactctgtatttacaaacatgtgaattagccagccccctaaagaaattcactatatccaggggagtactaaataaacaccattcctaaaaacaaaaacaaacaaaaccgtgcagctagttagttatatgccactaccattctaggcaagtagatgaga

SEQ ID NO: 118983 - DNA, 437 bp, Homo sapiens
agacagtccccactaccatcctgaagcgtggcagccccacagggcagctagacccagaagagcagcattcacagtagtctggccttcagggactcctgcggctaggggaagagggagtgcacaacattaaggaggcatcctgtgggacagaagaatccagatggcaggtcttgagtaccaaactttccacatgtgggaagtttctttcagcagaggcactggtgcagtgctgagctcagcaagaaaagtctgcagctctcccccaacagtcaggcagcccgggtgctcatgaaagatctttgagatggaaacttctcccccttgctcgccactgcagacacagttgaggcttctcccatgggagcttagcatgagtgtacctgtagacaccctttctggaacatttcagggtgactgcttttccacagaaggagcat

SEQ ID NO: 118984 - DNA, 317 bp, Homo sapiens
gagtttgttcctgggcagccctactgtggtcctacggtaccttccttcactgaagcacccttgcagggcccagtgaccaaggaagaatcagagaaaaagcaaattgccatggaaacaaagaagcagctgtgcccctttgctgcagtgggagagtgctgatatggggagaactgtgtgtatctccacggagattcatgtgacatgtatgggccacaggtcctgcatccgatggatactgcccagagatcacagcgtataaaatcgtgcattgagtcccatgagaaggacatagagctctcatttgctgtgcagcgcgg

SEQ ID NO: 118985 - DNA, 547 bp, Homo sapiens
tgcattgcagaacaggcagaggtggcgcacaatgattcccatggaatcattatggatttgtcccctaaggagatgtttagcttgaattgcacctctcagtctgtgtgccatggccacactatgttcaggtggtctaaacaaaacagtcagatggtagaaatgctaagaaatacagcaagagttcctgttatctggaaacatggcagtatagtggcacctcaacctcaactgatatggcctgctctaggagctaaacataaggatttgtggaaactgttaatagctcttaataagataaaatttgggaaagaataaaaaagcatctagaagaacactctacaaacttgtctttggatattgcaaaattaaaagaacaaatatttaaacatcccaggcacagctgaccttaatgccaggaactggagtgcttaaaggagctgcagatggattagcagctagtaacccattaaaatagataaaaatacttggaggctctgtgatttcaatgatgattgtgttattaatctgtgttgtttgtctttgtgtg

SEQ ID NO: 118986 - DNA, 247 bp, Homo sapiens
tacattgactggaaacctgaactgaacaggcacaggggaaaatccctgatttttcaaatcataatcctgactttatgtaggcttgcagacaaaatgtatactttaggtgttcacaaaaacctcaagccaaaaagttgattgaagatttaaagtgcatttgggttggtaattctcccagacacccaacagaaatcctccttttttttcttttcttttcttttttttttggggggggggggaggggggg

SEQ ID NO: 118987 - DNA, 371 bp, Homo sapiens
agggtcggcccgcattaaggcgcacatctaggttttgctgtgttgcccaggctagtctcaaactcctgagctcaagcaatcctccggcctcagcctcccaatgtcctgggattataggtgtgagccactgtgcttggcctgctggctgtttatcagtcctcaaatagaagttccagcttcagagggccaaggtcatgtgatgggagccaggggcttggagttctgagggaagaggagtgaagtattgggggatgtggcagtatcactgacagtgaggttttttggaggcttttttggtctgatttgtgagattgatattgtccttaatgataaggaaacaaagaaaatggcagaagtgaaaactgaaaatg

SEQ ID NO: 118988 - DNA, 864 bp, Homo sapiens
cactcctgcatcctctctcacctctctcctgcgtcctctctcagccattcagcactctcacgggatggacagagcagtgttcatgcagtgggtaggggagaatttatgtgaaccaacgttgagagacagtgccccattgagatgaatgccagtatgctgttgtgagatccctcttaggaagctaaagataatcaattaacattaacctatgtagccagtatggtaccttgtcttgcccgcaagaaaaagaggaatggatttttttcatcatttgtttttaatcaagtggtggacatcatgctaagtagtttatatgcagtagctcatgtaatacttgaaaaaggtaggtctaattactgtactcattttataaatgaaaaatacagagacttagtcaggtgaaataacttgcataatactatagtataaatgatagcagcgcatacattattctaggttctcctaccttggtcattctctgcttaatctcacaatcatggcggaaggcaaggaggagcaagtcatgtcttaatctctatgctatattatcctatattataaaatctttattaccataaagggatccatagagaagtgacattcagagctggatctttagggattgtgcctaggtccccacagtaccattaagataggatcagtctacatctagatgtactgaacactccttgtttaagaattgatcccctctgtaggtcactcaggacagttggtaagtaacctctttgggtaaaatgaaggtattaaataaaacactgccatccttctcactgtctaggatattccactatcctaaaaacacacttaaataccctctgaattaaagcactgaataaattactg

SEQ ID NO: 118989 - DNA, 152 bp, Homo sapiens
ttgctgcgtcatctagaggaccgatcacgtgcattgtgatccagtgcattgtggatccacgtgaattgtgcatttaaagtgtatatttgggtggtggtgggagtggagagaactcaattcagaaagattacaattagagaagtgagacatgg

SEQ ID NO: 118990 - DNA, 170 bp, Homo sapiens
tcgttacactgctgctctgacaaaatacttgaaaggtgaccagatagaaaaacaagagccttggaaagtttctgagtggatctgtagtaagagattatgttgagtgctgtatcattttgaatttaccccgacaaccctgaccttccctagttaatcattttcattgccag

SEQ ID NO: 118991 - DNA, 4036 bp, Homo sapiens
agcgggagagccaagcctgcgggcggtggcggctgcactcgcagggccctggcagccgaccctggccccaaggtccgatcgcccaggggaggagcagcaccgggaccccgcgtcggctgggcgccccacaagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaagatcaaacaaatctatatttaatggatggactcttcaaaacttaccaaatagttgaagaaaccaggtgccttctcatgatggaagacagattctgctttaaattaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttatgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctaacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgct

SEQ ID NO: 118992 - DNA, 4054 bp, Homo sapiens
gtgtgtgggtgtccaggtgcctttccagcggcttccccagtggagttcctggcatcaaggacatttcctgtaaaagggtccttgttgaagagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaagatcaaacaaatctatatttaatggatggactcttcaaaacttaccaaatagttgaagaaaccaggtgccttctcatgatggaagacagattctgctttaaattaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttatgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctaacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatgaattaa

SEQ ID NO: 118993 - DNA, 4094 bp, Homo sapiens
agcgggagagccaagcctgcgggcggtggcggctgcactcgcagggccctggcagccgaccctggccccaaggtccgatcgcccaggggaggagcagcaccgggaccccgcgtcggctgggcgccccacaagggaagccagtcttaatatgatggaaacatctctgaacttctaaaagaccaaggttggcgttttagctctattaattttacttcgtcttggccagaattcacaatgacaacagtgacagtgaccacagaaattcccccaagggataagatggaagataattctgccttgtatgagtctacgtccgctcacattattgaagaaaccgagtatgtgaaaaagattcgaactactctgcaaaagatcaggacccagatgtttaaagatgaaataagacatgacagtacaaatcacaaactagatgcaaagcactgtggaaaccttcaacagggctctgattctgaaatggatccttcttgttgcagtttggatttgcttatgaaaaagataaaaggaaaagacctacagctcttagaaatgaacaaagagaatgaagtattgaaaatcaagctgcaagcctccagagaagcaggagcagcagctctgagaaacgtggcccagagattatttgaaaactaccaaacgcaatctgaagaagtgagaaagaagcaggaggacagtaaacaattactccaggttaacaagcttgaaaaagaacagaaattgaaacaacatgttgaaaatctgaatcaagttgctgaaaaacttgaagaaaaacacagtcaaattacagaattggagaaccttgtacagagaatggaaaaggaaaagagaacactactagaaagaaaactgtctttggaaaacaagctactgcaactcaaatccagtgctacatatggaaaaagttgccaggatcttcagagggagatttccattctccaggagcagatctctcatctgcagtttgtgattcactcccaacatcagaacctgcgcagtgtcatccaggagatggaaggattaaaaaataatttaaaagaacaagacaaaagaattgaaaatctcagagaaaaggttaacatacttgaagcccagaataaagaactaaaaacccaggtagcactttcatctgaaactcctaggacaaaggtatctaaggctgtctctacaagtgaattgaagaccgaaggtgtttccccttatttaatgttgattaggttacggaaatgaactggctggatgaagatctgatttagaaagactgcgtgagtcttatttattctctgaaacacagcccaagtttcatgttaaaatggcaaaatgccattatttaaatggaacttattacataccaatggctttgcaagaagatgacatttcagaagatcaaacaaatctatatttaatggatggactcttcaaaacttaccaaatagttgaagaaaccaggtgccttctcatgatggaagacagattctgctttaaattaaaaaaaaaaaaaatctgaatcttgttttcagatttttttttctactgggattgttttaagattgtcaattctgacttttttatagtggtttttaagagtataaatagaagggagagtgtatatgtgtatgaatgaacatacatttcctgcatatatatgtatgaagggcatgtatatgtatgaatgagcaaacatatttgaaagttaacttttggatgataggaaagatcgtacagtgacataagttcatctcctgatccattgtttgtgggagaattatacttgactgaattatgggcaggagaaagagcagattccttttagctaattccccaacccatatgcccctctgaagttgagaatcatggctgcctcaccacacatcagagaatgactgttcttcttagttctgggattaaaaattggtttctagaggtaacctgtacacacaaacgcacagggatgcacatggtttcctctgcctttgtgactaattttcttcttgatagttattaatagtatctaaataaaatattggggggatagaaaaataatgctgttagctcatacttccatgaaaatgtatatattataggctcaaaggaataatgactgctgtctgcagccagaaagaatctgaatttatgaattggaaagatatatatagtgtatttgtgaaagtttgcttaaattctgatacatgccttctttgtaggtggagtttgtgattgcagtgaatagaacaaattctgacttgcagaaatgcagacatacagtcaggaaagaacaaacttcaattaaatgtataatgagagaccttggtccccctaaaggatgaatttcctttaggcctttgatcttcctctctagtgtataactttaaatatttgctcagaaaagatgctgactctttcattatggaatgtgaaatatcagtgttgtctataaatatttgaaggtatataaaaatgagatgatgtaatgtatttataaatttatccaagtactgtaatccttgaattgttgtgtaactgtgtgtgagttttatgcttcatggtatttttggaaacatttttattgcttgcttattttgaaggtatatttatctgttaacatttagggcatagttaccttataccagcaacaagtctaagcactttacttgtattaatttattttatcttccccaaggccctcagaagcagattattcctgttttacagagaaagatactgagagtggttgagtaatttgcccagctgctaactgtgaagcaaaaatttgaaccttttgacttggctattgatattcattctacttgctcacatggtggtctaagaaatttcccagctatagaaatctctctatttttgccactttaatcaacacatagcttcctggatgactgcctgtgttattttgtggatgacagtaagaaacaacaaatactgataaaatcaatattttgctgaaatgagttgatctttcaccagctggactaccattgtgagaactcagttcagacaaacttccctgctaaaaatctgtttatcatacatttattatttatgactttatgtcacattgaagaatttcttcatgatacattttcaggcacacttgtaggaaaattaggatcatgagtcctgctttaagtatttgcagtgtagtaagagaatccatcttttactaggagaccagattccttttatacctcattcatcatgctggattgtaataaatttcagattttggaatgggcttatttaactgacctaacaatcttgatgatttccattagaataacttattctaaggtcaaaagtggaaagacactgttggtttttattttgatttcactatactcatttttgaacatggaaatacagtggtgaaaccacctatgcaaaaatgataacagtgaggaaattatgacagtgaaagagatctgacctaactatctatcttgcctcgaaactgcccttggtcgttcctgagtgtgggccaagctaactttgggagaaatttactttataggttaaattataatagcccttcccaaaactaaacgattctcctgcctcagcctcccgagtagctgtctttataataccatcagccttatcatttattcgtcatgtatggattgtttcctatatccactatcataaaattatcatttgaaatatttttttatgaaaaaaaaaacacttctcagtgaaaaaacaagattacaagggggaataatatttattcagctaaaatagtacttcacaggaaatataggaaaagaaacactagttcagttttattccaaataatgtacttctaattatactcttgaatttattggataagaaggtctgaggtgggtctgaaattcatacatgaagtcaggaaaagaaaagaaacttagttctaccttgattacatatgttgttacaaattatcattataaaatgtttaaacaattagtatagtatatcttttgaataattgcttataatatgccttaccataaagaaaattgatgctacattgtgtgaattgtttggttttctttttatattaaaattatgcataaatgaattaa

SEQ ID NO: 118994 - DNA, 1116 bp, Homo sapiens
gcagagcagctacataaatattttcttcctctcgtcctgtccccttccctctcttcttcctccttctccatccctttctgtttttctccctaattatcccatcacctttctcttggtgttctaaaattaatctcttgcctctccttcccctcaacacaatatttcactgattcccatgatatttttgaaaggtgtctgggttgcatgtatttctgtgtcattctcatggccctttctttgcagagtttcacctgccacctggatcatttcctatttttctgcagccacttcagggcggggacccagtatcacgaagctgcaaggtaaaaaggatcaaaccttaactgcctacatgtgctcacaggaacataagtgagtgaggctcaccagcaaccaggaagtgagctgagcctaacatatgggagagatcctgtctcatctgcagggaagagctgctatataggaaagtatctgctcattgctgccatgtgggaatgctggtattgctggactttctgatgttttaggagaaactgctgatctgtgcatgaagtctgatatataaagatgatactatatttatgtgtctatggataaataaataatgtcaactggttccagaaaaaaaaaaaaaaaacaaacaacaacaacaacaacaaaaaaccactgtgtgggctaaacaagcctgctgattagatttggcacattgacagtgaggttaaggtgcctaagtgcctgaaaaacttatgtgtttttgtttatgagaacaacttcagcaaagtttcaagatacaaaatcaatttacaaaaatcagtagcatttctatacatcaacaacgtctaagatgagacccaaatcaagaatgaggtcccattcacaacagtcacacacacaaaatatctaggaatacagctagccaagaaggtgaaagatctctacaacaagattataaaacactgctcaaagaaatcagagatgacataaacaaatggaaaaatattacatgctcatagatagtaagaatcaatattgttaaaatgtccatattgcccaaagcaacttatagattcagtgctattcctagcaaactaccagtgatatttttcacagaattag

SEQ ID NO: 118995 - DNA, 180 bp, Homo sapiens
ctaagtaaatgccgctgctctcctttacagaattagtgaaacaacaatgtcccttctgaatttttcttgccatgaacatctcccaatccttgtgtgttgctcattaccctttaggccaaaggtgtgcagcactttctcggtctctgtcaccttcaactcctcatcaatagcctcacacct

SEQ ID NO: 118996 - DNA, 317 bp, Homo sapiens
tggtttccacgtcaccaactgacccatgccatatccaactgaaagcactctggtggctcctcacaccaccagaaataaaacccaaactgctcaccatgcatctgaggcccatgcgacctggaccccaccaacatgccaatctcatctcccttactctcccctccagccaccctggcctcttactgttcctcaaacaagcctggcacagtcctgcctcagggcctttgcatctgctgctcccactgcctggaacacacttttctccactctttccaccagggctccttctcctccttcaggacttggtcaaatgtcat

SEQ ID NO: 118997 - DNA, 656 bp, Homo sapiens
gttatggcatgagaagggagaagtgcgtgtgaggtgaggagctgaaggcagcgtgcgtggcctgttcacaagctgggctgtgtgttttaatctcttttggaacaaatccaagtatactgttgcatgcaacttgaattcagtatatagcttgagcttttatattatttctctgacttataatgagaattttgagaagataaacatttatgtaatttcagttattctaaagatacttgtttcttttttaaccgcttacagtcttaacttcttgccgtcattgaaccctgtaaataagagatgtggagagttgaggaaacagactgtgaaatgataccgatcaaacaggattcaatctgcataaaagcacacatacatgctttgagtggattttgctatttctaaactttttacttctagttttatccatagaataagaagctgtgaaaggaaaggaagttgtcatgcagttagaaaaggatattgacaaaagatggaaggaaggggaaaaatacagaactggggtaaaaattaaaagaaaataggcaagttgtgtggtgctttggtctaagttgcataatcctttatagatatttgtctgtgttgatcctttttccttgcctgcccaggtgttttccaggattaagagtgcaggcttt

SEQ ID NO: 118998 - DNA, 485 bp, Homo sapiens
gctggagaactgcacagctttggaggcttttcctggatatatttagaaacactagaacgggtctacatattaaacagtcatgaattattaccagccagtccttgagtaatctcaggcttaacagacatctttcttatttgctttctgtcgattccaaatatgagtaaacacagtatatcttattctagaggaaatgtccgcagaaaagaagtcactccctctcagggccttcagataagacttcatcaggtgtactaccagactgccattacagttcccaaaggtgattcatttccagtgggatttgtagagtaaatctcagttaagcaatcacaaaagagactaagtgtcccagaggatgtcaagtagcttgaaaggcataatgtaaaaatattatatctaccatggcagaaaaccagattgagaccagaggaaaggacttcacttataaatcaatgaccttgacagtagttgtcttcgaaaaa

SEQ ID NO: 118999 - DNA, 614 bp, Homo sapiens
tgcagtggaacaatcatggcttactgtagccttgaccttgagggcttaagcaatcctgccacctcagcctgcctagtactgggactacaggtacgcgccaccacgcccagaaattgccacagtcacctcaaccttcagcaaccaccaacttgatcaatcagcagccaataacgtgaagtcatgaccattcaccagcaaaaagtttatgattcaccaaaatattagatgatcattaacatttttagcaataatgtatttgtcattaaggtgttagtgcattggaaaatcatttaaagaatgtatcagctaattgaaggcttatgtgtaaacaagattcctgccaggctttgactactacccttggccttcctatacagggttgtaaagaatcatcatgatgtatgtttgaaattatgtttaacagtattacagtcaatatagactaaattttgatgcagtaacaacctcagaacttttacaatcattgctggactgagagagaaagagagagtgaacagggaatgtcacatgagcagagaatgtcactatctcaactgtaaaaaacaaacattacttctactcacatttcattgcccagaactagtcctatacct

SEQ ID NO: 119000 - DNA, 441 bp, Homo sapiens
aataacgtatggctgttggctcatcatttgtagcaaacgtatggaaacagagatgaaaggggtgagagaagatgggaactctctgtactttcccttcaatttttctctaaacctataactgctcaaaaaataaaagtcttaattaaaaaaaattagagcagaagagaagcacattatttctcagcatcatagcatctctgtagatgatggtctccttgtcatgggggaaagatcctctcaacacattataacaactcattgctcttattgtgacaaccaaggaatatatgagaggccaatttaaacatctcagtgggttggaaggacaaagcagactttgtgtcacaatagaattcatctcttggaacgtggagatggcaggagataaaacaatactctttatcaccggcagattaaccggcaaggacatgttctttctgt

SEQ ID NO: 119001 - DNA, 725 bp, Homo sapiens
aaccgaaattcagtcttttcttcaactgtgaatgtaggcagcaagccacagtggaacttgcagaacctataaatttgtcactgtgattgatgttataatgttacacctagatcttctttcagaaatgaggacttaccccagctactatgaaagctgttggcagagtgccctcagctggcagccccagggaaatggcctcagttgcagagagccacctcagctgggtaataaacacctggccctctttgattcagggcacttctgaagggtcatataatcttcagaccttctgtaaggttggctgaagcttcctctcagacttcatcacagctcaatgtcatccttctctgaccagttccaccttgccttcccctcatgttgatgtcaagagcgttccctagcaaactccccaaatgccaatctccagcttagattctgctttctggggaaactgaactgtgacagttactaatacaaagaatcaatatttttatgtcacattatacttagatagcttgaaatatatatgcatctagttacttaatacattattaaaaaactttttactatatcgaaaattactttttaaacattttagtaactgtatttcaagataattttctgtgttatcctatgccttttattttatgcatcttaaaacatcattctgagaaggagcctataggctttatcactgccaaaggagtccatggcaaaaaaaaaaa

SEQ ID NO: 119002 - DNA, 323 bp, Homo sapiens
  misc_feature (31)..(31): n is a, c, g, or t
  misc_feature (41)..(43): n is a, c, g, or t
  misc_feature (48)..(48): n is a, c, g, or t
  misc_feature (74)..(74): n is a, c, g, or t
  misc_feature (111)..(111): n is a, c, g, or t
gaggatcccggagtgccgcttagactcatanccatgtcacnnncgagnatgctaatacaccagctgcccgtctncacagattcaagaacaagggaaaagacagtacagaantgaggcagcaggaggtcaggagaaaatctgagaaaggagaaggccagaaaaggggagccccaacttctgaatataaactatccaaagctttgtctggtccctataccatgcatgtatagggcagacttcatgtagcccagctaaaataattaaattgagatttcagttatcatcaagcacagtgaagacaaagggaaacaacaaaacatatt

SEQ ID NO: 119003 - DNA, 632 bp, Homo sapiens
gtgcgtagagtttaagcagtgtggagatatttcttcacttttccttagggtgtccacatcaagaccctgaggccatcttaccacccttctggatcagaagaggccttcagagccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctggaccgtcctccctacccagcctggaggccggcgttccccggcccaacccggagacctccccgcctccctcctgggccgccgcgcgccccag

SEQ ID NO: 119004 - DNA, 332 bp, Homo sapiens
atttcatttccttgtggttgggggactgaggctctagctttttccttggccggaggctgctctcagctcctagagtctgctgcctgtattttcttggaggacacctatggttcttagagaccacccatacttagaaagcactcatacttctaaaccatgtgggctttcccaacacggctgcttccttcatgaatccagcaaggagagcctctaggataaatctgctaataatacagagtattttataacataccataatcatgggaatgacatcccattacatttgctatattccattgctcagaagcaagccattggtcctacccacaccc

SEQ ID NO: 119005 - DNA, 423 bp, Homo sapiens
tgccttctctttctcctggttcaggctcttcctgattagtttttgttgttgtctttcgtgattcagaacagttattattaacaagtctccgaacaacctggaaagtagatggtattattcacattttatgggtgaaaaaactgaggcgcagagagatagagtaacatagagctcacagaactggaaagtcgcagagtcaggattgaaacctacatgtatctacctccaaagcctgagcaactctaactgcacagtgttgccttcctatcttgctttgttttgaaaacaaaaagtctgtgttgccttatctttttgcaaggtagcaccccccacaccagtggccccaaaatggaaagatggaaggaagaattaaaataagggttgaagaggaaatggaaataggagtacatggagtttggaaat

SEQ ID NO: 119006 - DNA, 106 bp, Homo sapiens
ccaaggaactcggcccacaatgtctaattctaatgcttcctcttttacttgaaagtggaggggaaggctgggagcagtggctcacacctgaaatcccagctactca

SEQ ID NO: 119007 - DNA, 165 bp, Homo sapiens
tatgcccctagtttaaatccattgccccctaccttttcttagagaaactcaaaacctagctgtctttcatttccagaactcttcttctagatttctttttaccattaaccaccccctattcttcggggttttctcgagtgtggaataggagagaaaaacacacaa

SEQ ID NO: 119008 - DNA, 722 bp, Homo sapiens
ggtctaagttgctgctgaaattttggacacatgagcccaggtctgggacttggcaagcgaataggccagatgggaactgttgcttgacaaattgaaagttctttgtttcagagtgaaccaaacctggtctcagctaatctaccaaaacaaaaaagctgggggagggtatattgtagagcccattttgataattatttttttggcacaaactactgcttacaccaaaaagcattgtggatttatcatataaataatgacatccccaaagctgaacactgcaaatgtagctattagggacttgttggagtgcttgctgaaagtatgtttttgtagtattgaatatctctgtggcgtgctgcttcatcccaaggcaaactatgggtttaaaaatagatcagtccaactggatcttacagtcgctaaacagctaactgctttagaggagcaaactcaaattcgtttagaaaaatgaaaaaatgaagagttgatttccaccagacaatcaatacatattattaataccttgtatttacaaaatacttttatattaagacctaaaactctgattataaccttcataggggaatacaaaatggtgattttcctcaatttataaagcaaggtaattcagagtaagaaaatgcctccagaaggcctggtttttatttccctactagacttccaggccacatttgatttcttgtatgcattttgaaacattt

SEQ ID NO: 119009 - DNA, 232 bp, Homo sapiens
tttctgtttcttctctcattgtcagctgcagatgtatttcagcaggatcaagtacaatttgacttgagttaacccttcataccaattctagcaccttaattgtaccctgactgttagcagcaaacagtaacatctggagcctggagatatcctcaggaagcacatctgtagtgcactcccagcaggccatggactagtcactaaccccacactcaaaggggcatgggtggtg

SEQ ID NO: 119010 - DNA, 211 bp, Homo sapiens
tcaaaatagtgtgataacctgccgactggggtgatgtcagacagaattcattgattcatgaaagacatagccctaggaggtgccagggcctgtgttcagttctgtgggttctgttaattgttttgtttgtttggttttaacaactgctgtgtgccaggctctgggataagtaccttaagtaggtgatctcatttatccctcccagcagact

SEQ ID NO: 119011 - DNA, 725 bp, Homo sapiens
cagtcactgaaggctttgaaccacagattcaataaattgcctactctcatttgccacatggactatatactccttggcaattatttaattattcattattctgatcctttaggagcagaaaaatatagtaaatgcacatagaaagtgcctaagtatgctaagcataggatttcttctaagctctgctttgcacacaaaatattttgatcacatttgggaagacaacggaaaaaaattcacatcctaggggatactttgcacacataaaaccagatatatttatcacttttgaaaataaaatctgatatggcacatatacacacatattgtacatatacacaaataaccccaagttataactttacaaatttgtttcaagaaacacacacacacacacacaaatgttctaatgaaaatgtgtgtgaaagacacactgtaattaaggtctttcccccttccctagggaaatgaatgtctccattataatatcccaatattaacttattggccttggacaagtgccacatcccagccacttggttttggttctgggggggtgggtgtgtaaaaagcacgcaaacggctttatgagggagcctcaaatctctctgcttccttcgatgttgcctgtggcagaaatttacattatcccttcagcccgcttaaaaaattctgtacttcccaagcggctaaatttttaaagtccctcaaccacaaaaatctac

SEQ ID NO: 119012 - DNA, 116 bp, Homo sapiens
aaacaagaaaaacatgatttgccctgcatctacagtttgcaacactgctttatctttatggcctcctttaattctatgatctctatccccatttcgcagatgaagagatagaggct

SEQ ID NO: 119013 - DNA, 654 bp, Homo sapiens
aacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgtggtataaccagaagaattcacattcccagacttgtcaacttgcatcagtggagacagtggcattcatataatacacatgtgtatgctacacttgacacaatgtgaatactcatctttcctttaggaaaccttattgtcctgttcatgtatacttgaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaacc

SEQ ID NO: 119014 - DNA, 280 bp, Homo sapiens
caggctggtctcgaactcctgaccttgtgatccacccacctcggcctcccaaagtgttgggattactggcgtgagccactgtgcccagcggttatatatttttaatctgcttataatcattgtctattctatcctggaagactgaaaggtgtttagctttttttcacataagtatctgtttcttcagaataaccaaaggaagtatctatcactgtttcctggggctcatgactgagttccaagcatgtggcattttatcttctacaaaatgtgtcctcct

SEQ ID NO: 119015 - DNA, 656 bp, Homo sapiens
atgaaatgtgtctgtagaggaggagctggatggaatgtccctgtagaggaggagctggatgaaatgtgtctgtagaggaggagctggatggaatgtgtctgtagaggaggagctggatgaaatgtgtctgtagaggaggagctggatgcaatgtgtctgtagagcaggagctggatgaaatgtgtctgtagagaaggatctggatggagtgtccctgtagaggaggagctggatgaaatgtgtctgtagaggaggagctggatggaatgtgtctatagaggaggagctggatgaaatgtgtctgtagacaaggagctggaagaaaactgtctgtagaggaggagctggatgaagtgtgtctgtagaggaggagctggatgaaatctgtctgtagaggaggagctggatgaaatgtgtccgtagaggaggagctggatgaaatgtgtctgcagaggaggagctggatgaaatgtgtctgtagaggaggagctggatggaatgtgtctgcagaggaggagctggatgaaatgtgtctgtagaggaggagctggatggaatgtgtctgtagaggaggagctggaagaaatgtccctgtagaggaggagctggatgaaatgtgtccgtagaggagtagctggatgaaatgtatcctgtag

SEQ ID NO: 119016 - DNA, 277 bp, Homo sapiens
ttagaattgggcattgactccgtagaattcacctttgtacaaggtgagcaaatgtatattttgttaaaaataagtatctgactgccaaaacggacagaaagctctttgccagatgtgttttcaggccatttcctttcctgggaaacagccatttcccccgcattatagttgtgttttcatttgcgggtagatagagtaagcgcaggagttaaaggacgcgggcctccacagccaaggccttatctgggacaattatctttctccttgcagctgtgta

SEQ ID NO: 119017 - DNA, 218 bp, Homo sapiens
taaacaactacagcgaggccacagtatataagatcaatatacaaaaaccaattgtatttccataagcaagcaatagtctatcaaaagataaaaccggaacataattctatttgtaatagcatcaaaaatatatccagttaggaataaatttaacagaagcagtgcaagacctgcacaccaaaattacaaaggaaaatggtgctaggacaactagaaat

SEQ ID NO: 119018 - DNA, 386 bp, Homo sapiens
ctgggcatatatgtgttacgtatgttgtatgattcatttcataataaaatttaaaatcagtaatagtgtccttggtagttggaacagtataaaagggagtatggggagaagtgagtcttccttctacaacagacccctgtccattgtgcgagcagcagctgcttgcgaaaccatccagagactttctgtcctttcttgtggctcttggcacagatgggctcatgatccctgctttgctctgagccttcctttgctccatctgatatgaggtggaggcttggctgtagcagcatgctgagctgtccccgttgccagtggtcttgaggtcagtgcgataatgtaccataaatgaccttcctggtcttctgttgatggactttcatgtg

SEQ ID NO: 119019 - DNA, 335 bp, Homo sapiens
agaggttgcagtgagctgagatctcaccactgcactccagcctgggctggactgagactccatctcaaaaacaaaaacaaaaacaaaaaacaaaaaacaaacaaacaaaaaaactgattatcttacaatgctttgtaatagaaatgtgatcctgagatgctaagagttaaataaatttctggattgagtttccaatgattattaacaatgtatcaaaacaaatataaaatttgataaattagtaataatacatgcaaagtaaagcatgcttatttggaatgaatttcttgatctgttgatgaggctctttctttttaaaatgagtttgtgtattt

SEQ ID NO: 119020 - DNA, 688 bp, Homo sapiens
cacacagtatacatggcagatgtccactagacatatgctattagacagaaacgggaaaagaactgtaggatgggttggtggtatacagtagtaagtagacaagcattttctaatcagaaaagccttgtagaactaactctgccatttaggaccttagaaaagctactcaacctctccagacctcagtttcatcatctccttaacataatggttcttaactccatgaagttccctcctccagggacatctgataagtctggagacattctgattgtcacaaactagagtgaaggggttcctaccggcatctagtgagtagaggacagggaaactgataaacatcctatagtgcacaagacagcccccataacgattattcttaacccaaaatgtcagtagtgccaacactaaaaaattctgtcttaatggaatactaataattgtacctgtctgaaaaaaagcctttgtagctctcagtaatatttgctattgtagttatgatcattgccattacgttatcacatcctgaaaaagaactcacattaaaattacaatatatttctagggattgaatattaaattctccaagaaacatgtttgtattttaataagggtttgggctgggcgcagactcatgtctgtaatcccaacactttgggaggccgaggcaggcagatcacttgagccc

SEQ ID NO: 119021 - DNA, 429 bp, Homo sapiens
gaccttgacttcttaatcctctgcttgattggctctccagcatcttttagcagatctccccgctgccccattatttggactgctttcctggctgtttgcagtgggaggattggtctgagtggccccacctgccattaccgaagcagctgtcccagctcgttctgttcctgtgtgagcttggccacctttctgtcctccttgcttgagtttcattggctgtaaaatgggtaattagagaaaaactcataataatataagctggcatttagtatgtttttcctaagatccaggcattgggctgagtacttacattgtttcaattaatcctcccaatagccctgtgagctggggacagttgtatctattttgtgtccaagaaaactgaggtgaaggacacagttgcacagctgggagttgggactggaaccc

SEQ ID NO: 119022 - DNA, 285 bp, Homo sapiens
cgctaatgagaacgcaaacaaactccctccatgcagccccatcgtgttgtgggaactgtctgctctggtctccacactgcactgcgggcctcacaggtcctgccccaccatgtcctgaagagcacagggcacccagcctgtgccacaccccataggtgacgctggccaggtaccatgccctctgtgcctcagtttcccattgaggaaaacagtttccccactcacatcgtctcctcccaggagtttcataaagtcagcagtgagcactgtgcaaagggcagcttt

SEQ ID NO: 119023 - DNA, 216 bp, Homo sapiens
ggagtgcagacacgccactgccagggcggggagctagaggggtccggccgcgtttctggaaacggagcctggaagggaggcagtacttccatgaacaccaacactgctatcaggaagagggacagacctgatcaggagtgggagcagggaaggaaatggcaggtttcaccaagggtcattgaaattctggacgcacactcaaacgtgtcactcaca

SEQ ID NO: 119024 - DNA, 463 bp, Homo sapiens
aatttaaagtatcaagactaaatgggggagaggggacaatgataagaaacaatacaaactgtcagaaatgatcatcagtatttgtatgtgtgatggaatgtgccattgcctttggtgtcatacagagatgattttagatgcctgttcactcactgtctgtgtaactctgtgcaagtaagttaagctttcatttatttatgtatttatttattttgagatgaggtcttgttatgttttccaggagttcgagaccagcctggccaacatgacgaaacccctgtctctacaaaaaaatacaaaaattagttgggcatgatagcgcacgcctgtaatcccagtactcaggaggctgaggcacaagagttgcttgaacctgggaggtggaggttacagtgaactgagatcctgcctctgcactccagcctgggtgacaaaagctgagaaccctgtcttaaaaaaaaaa

SEQ ID NO: 119025 - DNA, 437 bp, Homo sapiens
tacgtagatgaaataaaattctgtgaagggattagaagacatcttaaagtcatcttataaataggaaaactgaagtccagaaagaataacccagtgataacactagagaatcatgcaagtttagaaagttaatctgcttatggtcaggcactgtggcccatacctgtaatcccagcactttggaaggccaagacaggcagataacttgaggccaggagttcgagaccagcctggccaacatgacgaaacccctgtctctacaaaaaaatacaaaaattagttgggcatgatagcgcacgcctgtaatcccagtactcaggaggctgaggcacaagagttgcttgaacctgggaggtggaggttacagtgaactgagatcctgcctctgcactccagcctgggtgacaaaagctgagaaccctgtcttaaaaaaaaaa

SEQ ID NO: 119026 - DNA, 612 bp, Homo sapiens
aacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaa

SEQ ID NO: 119027 - DNA, 837 bp, Homo sapiens
gcacatcttctcactgatatttaaatgctgagcttacactttccatggacatgcttaatgactaaacaatagttgaattctaaattaatcaactgaccaaccagtaagaatttattgagcaactcctttgaagccgtctatctgttaggtgctgtgggagcacaaaagaaataggacatcatctctgcctcagggaatttagtgttttggggaaaacctgagtggtatacacaaagcaattgaggaacaacctaggaccttgtagtccattaggatttccaaaaatagaaagagaatggaaagtcacctggctaggagaagccagtggaaacttgacacgatgaaaaaagagcagctaatttcattcctgtccaccagttatttatgtgtttatctttaattacatttgtttgatttcccttattaaagtctgatgtcttaaaaaagcagaaaagtgaggcaggtcagcaggggatgtaagttgggaagaaagacaggtgagggcaagaatttaggcaggagccacagtgttggttgtgcaggtgaaggtcaggtgacggagggtaaccagtcatggatgacccaggcaggagccataaccaaaatgttagaaaaagttggtaagaaattgttccaggccaggcgcagtggctcatgcttgtaattccagcactttgggaggccaaggtaggcggatcacttgaggtcaggagtttgaaaccagcctggccaacatggagataccctgtctctactaaaaatacaaaaactatctgggcatggtggcacgtgcctgtaatcccagctactcaggaggctgaggcaggagaatcactt

SEQ ID NO: 119028 - DNA, 222 bp, Homo sapiens
ggaggaatatacccaagggtaaataggaattaaggatttcaagacattgtatttctgaaactgtcttgattgatagtttggacatgtacaggattctagggatagagaagtaattctctcttagaatttggaaggcattgctgcacgggttttggcatctaatgttgcttttcttgagaagtctgatgccatcctgattcctgatcttgccttgcctccccc

SEQ ID NO: 119029 - DNA, 683 bp, Homo sapiens
gatttaatcacagaataatcaggactagaattttaaataggacatcattagcatgttaatgaattttcccaccttatgccagctgcctgagtagaaaagatactgcagatgtagctcaaaaatctggctggttccctggcccagtgagctgtcaggaatctgtgtagggtgatccataagctaagtgaagggattctaagtgagaataccaagcagcaagattttgtttttctgagaacgatggctaactgtgcccagcctaaactcatttgtctttcggtgagtaagaggggaatgggaggcagagaaggggcagttgaagggcaatgaggttggagtagaggcacctttccaattatggtttgggattaggaccttttgctttagatagaaaagttgtaagttcgcaatgacaagatcctgccctaattcttggcacagtctcacaatttttgagcttgaaatagctaatgaaaggaagcatgagtgtcttagtccatctgcgttgctatagaggaatacctgaggctgggtcatttataaagaaaagggaattctttggctcacagttttgcaggctgtctaagaagcatagtgccaacatctgcttctggtgagggcctcaggctgcttccactcatggcagaagatgaaggggagctggcctaggcagatcactggtg

SEQ ID NO: 119030 - DNA, 336 bp, Homo sapiens
atgaggtattttctcattctttatctcatggagtctgctaaatacccccatagaacacgtattatcaagcccagtgcacgggaggaaatgagactcctcagaaggtaaaatgatttggccaggcacggtggctcacgcctgtaatcccagcactttggaaggccaaggcgggtggatcacctgaggtcaggagttcaagaacagcctggccaacatggtgaaaccctgtctctaataaaaatacacacaaaaaaattagccaggcgtggtggtgcacatctgtagacccagctaccaggaggctgaggcaggagaatcgcttgaacctgggagatg

SEQ ID NO: 119031 - DNA, 576 bp, Homo sapiens
cttgaagatatgtctatgatacatggctaagcaaaatttttaaaaggcaagtgagaaaaatacatatggtataatcatatttatatgaatataaacaactatattaatatatgtcagtgtgtacaccagaaagaaaaagtttaaagcaatatacactaaatagaaaagaaattatggaatgggagatttatattttttatattaatgtatttctgtaggtttgagttttgtaaccttggattacatatgtcattagaaaaaaactttaaagaataaaaactgaattaaaattttaaaaaataactgtcatgttaggaaaaattctttggacatttattttatggtaacgagggttaaaatttaagaggagctttgaagggcagatggaggttagggcaggagacaggcagtgtaattaaggaaattaaaataagtggtcgataagctggactcttacttggccagtagtaaaccaatcaacactaagttgaggggtaacaggaatgagaaaatcacctgaacataaacataagagaaggtatttcatagagtacaacagatcactgttcatccata

SEQ ID NO: 119032 - DNA, 178 bp, Homo sapiens
aagcccaggtgccgaggtaactatcctctctctcctacaaggagcagccagttaaaatcccaccctgtgggcaatgaggttcaagccaccctggttctgctccggttatcaatgctggggaaagcacactccacataatgccagtgctccggagcagcgtcgttcatgcccaagcacg

SEQ ID NO: 119033 - DNA, 696 bp, Homo sapiens
caacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatccaaaagtctgaaaataacaaatgctggcaaggaagtggagaacacgggaacattcatacactgttggtgggaatgtaaattggtacagccactatggaaaacgtatgaaggttcctccaaaaactaaaatagaattaccctggcacacctccactg

SEQ ID NO: 119034 - DNA, 301 bp, Homo sapiens
aagtttctcactgtggaatggaaattcacggaagatcagcaaggggaggaggctagaataatccatgtggtaatgcagtagagatgaagaatcagaactcatgtttaatttaatataatacagagggttacatagagaagtatttatagatatgtatatacacaagagttaatatacacacacaaatttctttgctgtcagccgaaatggcctaaaagaaaccacaccctaatgcccagaatgcccagatcttggtctgtaaaaccaataaaggaaccagggacctttaaataaatggttg

SEQ ID NO: 119035 - DNA, 695 bp, Homo sapiens
agcggggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaaggtaagaattatctaa

SEQ ID NO: 119036 - DNA, 598 bp, Homo sapiens
agcggggttgccagggaaacagcggtcccacaggcaggagggatctggaccggcggcttcttccactaccagagaggctgaggtggcgggagagacccctctcctctgggggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaaggtaagaattatctaa

SEQ ID NO: 119037 - DNA, 314 bp, Homo sapiens
agtaagacagccatggtttctgccctgacagtactcacaggctagcaatttcattcattcattccacagatatttccagagtgctgtgtgccagaccctgtcccagggatacagcaagaaaaaaaaaatcttacattcctggctctcccattcgtgctgtgccccatctcactccctttcatttcttcattcatttgttcattcttccatttggtatttaccaggccagatcatgtgctaagcaaaggcatcagcagtggagaaggccagcatgtccccggccctcacgtcactcacagttaagccccaaaatg

SEQ ID NO: 119038 - DNA, 460 bp, Homo sapiens
agatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcaggtagagaccccgtctagagcccaaagccctcctgaaattattcaagccggtcaatcccaaactgtttgccctgccttgcctcacctttcctgtgggaaccccagtaaaggttctgggctagattttctccttactcctgtcttctgcctccaaaccaaaaaaccagggcctcctgctgtggccctgcaagcatgctgtgcctcttctttctagg

SEQ ID NO: 119039 - DNA, 287 bp, Homo sapiens
gcacgagattacattcctaatttactgttaaggttgattagaattcaagcctctcaaaagcatgcaccaaaggtcttgggctgtggaaaacatttttataaaataatccattaatgcagaggagtgcaactaaattagttagcaatttgctgagcatgaattaatgaacagagcttcttccagctcccagagttgtaattttcataataacctcagacctttatttggcaggttgtttagttttttcgtttgaaggttttcattagtctaatgaggactgtgcaagg

SEQ ID NO: 119040 - DNA, 229 bp, Homo sapiens
gcaacatgtggcagagcaacaagagaaaatgtcccctcctggccagcaacctgcatcagggcatagttctgggtggacatccccagcagcttggagttgatggagggtcccagattcacctgatcagagcgtgatggtgaatgacatggcagcattctggacgttaggactttgggcacaatttttggtgcaatggtcctaaactgactcttattctgcaaacctttcc

SEQ ID NO: 119041 - DNA, 725 bp, Homo sapiens
atattagtatagctgctgcagctttcttatagttgctcttttcatgatatatgtttttctgtttacttttaaatatgtcattaaatctaaagtgtatctcttgtagatagcacatcattggatcttatttttatccaatttgagaacctatgccttttgattgtttattcatatttaatgttattatttacatagttggattcacatctgctgtttttcttgtgttctatgtctcatttctttcttcctttttttttttgctcctctattccttttttactgctgcttttgcattaagcaaatattttctggtgtaatattttaattagtgattttttgggaatttagaaaaaagttagttcttagtggttgctctcagaatctacttcagaattagtctaatttccagtaaggtatagaaatgttactcttatatagctatattccttctttccctttttttgtgttattacaataatacattactataattgttactttttataattttttgtcttttaaagaagcagaaagaagaacagagaccaatatgtatttttaaagtttgttatattaagtttcttatttactgtttctgattcttttcatttgttgctgggtttttagttgtcatcttgtgtcattttcttactccagaatggctttgctcccacatacatcctttgtgttgtgattgtccattgtattacatatattctatatat

SEQ ID NO: 119042 - DNA, 359 bp, Homo sapiens
gcaagccacagagtgggagcaaatatttgcaattaatgcgctgaactagtaaaagactggtatccataaaattataaagaactaccaatcaataaaaaccacaacccaatagaaaaatgggcataaaatacaaacaggcaattctcagaacatgaaaacagagtagtcaataattacataaagagaagttcaaacttactcaaagtagggaaatgaaaatcaaagttataatgaatattacattccacacccatcaggttggcacgctcaaactgtatgtttaagatgctatatttaatgttattacaatcaaactatgttcaagttttttaatatgctattacaatcattataacagc

SEQ ID NO: 119043 - DNA, 376 bp, Homo sapiens
aagcagtgagaccagcattaatccaagacagggtgatgctggcttgagccaaaggtataacagtggaaatgatgggaagtggcccgctatatttcgtttgccctcctctgctccacttaccattgactgatgtcattgtctttgtctgtgtggtacctagttaagaggggctgagtgcgggcaggttaaagaagagaggcctgggtccctttgtgaaggcgcccggggctttgcagttggagttctgttaagtgtttctggaacgatttgattctgtggaggggcctgggtcaggtctggcaaatgccaaactctgtgggtagagggcaaattgggccccagccatttttacagtagaggtacatgttcctcccca

SEQ ID NO: 119044 - DNA, 442 bp, Homo sapiens
ttactcggaacacagaaagaaggcaatggtgttttatgaaactaacaatgaaggaaccctattatatcctttatttctcctattacttgcctatattaatcaaccacttatgctggatataataacataaaagtaaaggtagagatagggccacccataattccttttcttctcagtccttccctactcatcagtaagcagaaggtagaatgttggtagaatatgtattcatcaagaagtgaaatacaaaccactgagttcgtttgtacagagtttctactgttctagcaaaaacaaactacacatgcaagtgcaactacaaaatgactgtataatttcagtttccacaaatgaggtaaatattcttatatttgcattttaaatggacactacacaacatatagggatgaacagtaaaatacaggctaatgatttaaaattc

SEQ ID NO: 119045 - DNA, 333 bp, Homo sapiens
acttttgtttttcatccaatttttcttttctttaaacttccataatactgacagctataatatcatatactgccatgatggttccacatacatggatcttttttcttccgtatagtcataggtgtgcactctgatttcatagcacctggcctcatgctgactctagtaaagacttaatacagcggacccttgaacattgcaagggttagggatgctggtcctccgtgcagctgaaaatccacatgtaactttggacttccctaaaacttaactgctaatagcctcccgttgactagtagtcttaccaataacatagtcgattaacacatattt

SEQ ID NO: 119046 - DNA, 297 bp, Homo sapiens
cttacatttattccttaccataactctgtgagggagatgatgatattctcattttatagttgaagaaatttaggcatggagaaggaaagtaacttgctgcaagactagtaaagtggcagagccaggattagaacctagtctaactccaggacatgtttttgaccactgtgcatactgcctgcctctcaagaatttgcccgatgtagtcaaattgatgacaaagattaatctaccttctgctaacctgaaaactcaaaggtagggaaaaatagttgtcattattgctttttcctctaa

SEQ ID NO: 119047 - DNA, 902 bp, Homo sapiens
agataaggaaataaaagcaggccacccccgagccagctggggcaatctgcttgggtgcccttccgccctgtggaagctttgttcttttgctcttcatagtaagttttggtgctgcttgcaacttgggtccgtgccacctttatgagctgtaacactcactgcaaaggtctacagcttcattcctgaagcccgcgagattacaaacccaccaacccaccaacccaccagcaggaaagaacaactccagatgggaggaactaacaactccagacgcaccacctttatgaactgtaacactcaccgtgaaggtctgcagcttcactcctggagtcagcgagaccacgaacccaccagaaggaagaaactgcggagacaccatctttaagaactgtaaccctcactgcaaggggccgtggcttcattcttgaagtcagtgagaccaagaccccgagcatccttaacatcccagcaccccctctcctgctgcaattcagtccaattagcccctggcccaaaatctaattgtgtgcaaagcacaaattaacactaaaccggatcagtgttgtttctttttaatgctgaaacagttcagggctcactcatcctacttcatcagctagattgcaagctccatgtagggattttctcccttttatttaaaccaccaggctgccccttttagtggacctgatgcgccctaaacactcctgggccatgagctaagactcaaagaatattggtcacatgagtgtctgaagatgacttctgtgagtgcctgcagatttcctcatacatcccgcaaggaagagcaatgccccatgtccatgaacggggaccatgactccccactctggctgcgaccttcttttttattctcaccttgctgaaaataatcaactcat

SEQ ID NO: 119048 - DNA, 427 bp, Homo sapiens
ttaagacatggtcttgtagacttgtaaaagggtattatccctggaaaatatgctgttcaaaataagggcagctggaagcctacagatgactgtttgtgccagagcagtcaattgattaccgcagggagctttcccttctttttaaggactctggagagttcattatgaaatcttttgaaagatacatgagcaggaccaggctagacctggattccattagctttgtctattcacaaatagtggttagtattagaagagtcataaatctcttatttattttgctatcagagaccttcataaaactcagctctttaataaacaggttgagatactcagcaaactaaatggaaaaaatgataaactaatgtaaacacagcatttgccttgtttatcattgagtgcctgtctgtgcttgttgctttctgaa

SEQ ID NO: 119049 - DNA, 388 bp, Homo sapiens
tcaactgagcatgcttgcaggttgcagccctttatgagaaataaagctctgctttccaaatttatgaacctcatcattcttcagttgccatttttatgaagctgagtaactagaagtcaggtttttggcctttctagtcgttgctcctgtgcaaatttatagatatattgcccattaaagcattattattatctgagatctaaggccatatttgttttctagaagtagttatatttttactctttttcttcactattacatttttatttattaatactatttcatgaaatagcttctagtaggtatggttatgtaagttagtaaatacagaccattcactcatttgtaatctttttaccttccaaatgacaattagaaaactatatat

SEQ ID NO: 119050 - DNA, 172 bp, Homo sapiens
attgattatcttgatgcttcccatccttccagccccttatgagggaaggcaccttcgcgcctaatcccggaaatgggatgttgaccttcaagagctgacgcctgcgtttatcttgaaaggaagagtggcattagtgatgtggaaaagggggttttaactgtcaaggctggaa

SEQ ID NO: 119051 - DNA, 603 bp, Homo sapiens
ccattggtccttctcttctatgtccttgggctgttaaacaagcgcaaggcattgcatgtgtagatggtgtactttccaccctctaagcagtctctggatagggaaggctcccagtcctgagcggcactctgctgtgtgtgtctttgtgtctgcgtggtcaaggagagctgtgtgtgccacaacagggagcctgtggtcttcctgagatgaatgggttttccatgggaaggctgcaagtcgttgtgacatcttccagcgaggatttgggagtgtgacttgtgcgtaacagaaggtggtttgggaaagtagcactgtcaagtcctcagcagccggccaaccttctgagctgcagtgacagctcacgggggactatcagaataggaacacaccaaattcctaaggcttgagggatctgcctgaggctgcacagccttcaagtggcatagcgggctattcctaagaaggaaagtgttcctctcttacaggttaatgcccgtagtagcagtaggtagtagtaggtagtagtttcatcaaaccccacatcaaaactgctatgtctaaagcaatcgttgacaggcaaggctggttctgtgctgaggaacg

SEQ ID NO: 119052 - DNA, 288 bp, Homo sapiens
tccacaacaatgtgaatatacttaacaagactgaactgtacacttgaaaaattaagatggtgaattttatgttagcgtattttaccacaattaaaaacatttttaagggagactacctaaataaattatatctatgcaatggaatattatgcaaacatagcacttatgtactaagatgaaatgatatactttaagtaataaaagcaaagtgtagaataggatgatggatgccactagttgtgttttttgtttgtttggtttttttgtttttgagacggagtttcgctc

SEQ ID NO: 119053 - DNA, 587 bp, Homo sapiens
tactcatcaccctttccatctgctgctcaaacatcaatcacagtatttggtacagagtagcagcacaataagtggctgatgaatcagtgagcaagtgaaataaaaactaacgctttcaaataggtttttattaaagaggcagatgctgccttcagatgggactgacttagattgttctttaataagctgaataactaatatcaaattataatccattaaaatatgcttagacagctgaggtaatatagtcaaattacatttttcagagtaactaaagagatggataattaacatgattctcagatttactgattaatattagatgtgccaaataaccctgtgatcttaaggtacaattttgacaagcattgagtgcctgtgctactgattaaagaggaattcaggcactctagatgacagatgtgcaggatggcaaagttaaggttgataactgaaagtttagaaacatacttgtactttacttaagcagaaatacaattatcttatgcctgggaaagacgttctgagagatgcaccagtattccagcctgggaaagacgttctgtgagatgcaccagtattccatc

SEQ ID NO: 119054 - DNA, 209 bp, Homo sapiens
ttgtacccctacctcccaccatcgaaaaatgcttgaaactaaaaatcaagatgagaaattaaaataatcattagcatctttgtaaatgtacaaaaaaaagtcagcctacctacagatatacacaaatatgtacaggtcaactttccctagaaaattcataaagaataaaagtataattattgactaatttttttttttttttttgagat

SEQ ID NO: 119055 - DNA, 550 bp, Homo sapiens
ttggaggaaagacagccctgataacagaaggcagagacgtgtagaaacttttcctccctcagagatgatttgtcagaggctttgcagctccacaggaagggtctgcagagatcatgtttctagactacagtaggtgagcccaccctccagtttttgtttttaataacatttgttatttctctcactatgaaatcaatgtttattttagaaaataatagaaaggcaaagaaaaccctactcagagacaaccattggctgttagctttttaggtgttttcttaatatccagtaatttacatatatgtttattttcaaagtgtgtaaagtatagaaattatagaaaacagtaacagctcccatttattatggtttgcactgtaatcttactactcaaaggaaacactgtaaaccatttgatgcatttccttccagtcaaccaactttgctaggcttctctttttctttttctttgtagtttatttatgaatttatgctgtaattctttagcaggcactcccattgtgcctgggactgagctgtgagctttatg

SEQ ID NO: 119056 - DNA, 565 bp, Homo sapiens
tcattttttccttgtttctttggggagccaggcatttaaggtctacaacattaaaaagcaaccacatttatgggtgaatttagaatgtcactgtgcattagcagggaaaggtataggctaagaaaagacctcatttttatacctcagggtgactcctgacacagataaaacctacaatgatcaaaaaccaaaaatcagcaaactctggcaaagggggagaatctgatttccagttaccatattattaaatgtccagttttcaaaaaacatcacaagacatacaaagtagtaggaaagggtggcccattcaaagaaaatataagccaacaatagaaactatccctgagaaaggtcaaatggcagacctaaaagacaaagactaaatcaaacatcctaaagatgctcaaagaactagagtaagacgtgtaaaaagaaaaaaaaaatgtatgaacaaaacggaaatatcaatcaaaaagaaaaactaaaaaaaaagtttgggccgggcgcggtggctcacgcctgtaatcccagcactttgggaggccgaggcgggcagatcacgagg

SEQ ID NO: 119057 - DNA, 323 bp, Homo sapiens
ctaagaggccattgtagggttattaattggattaatttcaataggcaggcccaaggagagaaaaatggggaagggccagttggtggagcaatcagaacacatgcaacattcattaagttcgccataagggtgcaggtcatggcaccctaaaaagacttacaataggaacatcagagattatagatcaccataacagttataataataatgaaaaagcttgaaatattgtgagaagtatcgaaatgtgaaagagacaagacttgagcatatgttgttagaaaaatgatgctgacagacttgctttactcagggttttcacaaat

SEQ ID NO: 119058 - DNA, 173 bp, Homo sapiens
tgacagggggtggtctttttgtaggcgtaggaaatctctctgatgggagacctaaaggaagtaagggaacaagtcatggaagtgtttagtggaagtgtgttccagatgcaggaaacacaaatgcaagacccgaaggtgagaacgtctgcctgtgcaagggcagcactgtgtgt

SEQ ID NO: 119059 - DNA, 601 bp, Homo sapiens
cttgttctcatacattactagtgtaatgaaaactgatacaacctttctggaaagcattttgtcaatacacagaagagctctaaatgttcatatatattgacccagcaatgctagaattctatactaaggacatagaaatgtgggtaaggattcatatttttaaatgtttgtcataaaattattgataacatacaataattataaaccaaatttattggttataatgaagtagttaaaaatatgagtttatagagctacatagacctatcactatttacttcatgcattatattggaactccaaacatgtaaataacagaaaccaatttagattattttaagaagaaaaaaaggagatgcattaaaaggatagacagcgtctcacagaaccctaaggtggaatgaggctaagcttggagaagaaaccacaactataaacagaacagtcacaggatcatcttttctttctatatttccgcttcatttttctttttctacagaccagcttctctgcctttcagtccacatgacagacaaaggcttctgaatttacttcctcattgagaaaaccagcccagactctgtacctgttctcaaatcct

SEQ ID NO: 119060 - DNA, 336 bp, Homo sapiens
cttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtcca

SEQ ID NO: 119061 - DNA, 433 bp, Homo sapiens
ccttgtatcttttttctccacatcctctaatgactaataaaatgtggctttcattgcgaagtctttacactgattctcctggccaggtctgtcctcaaccaaatcacttccttattcaagtgcgtgtaaacagcctcctcctggctgcatacttctgtctaccctctggctcctgacattgtggttcacatgaagtttttggtcttttaaatacccattggaagacgctcaaaaaggctcagaaaactgttccttgattttggtctgcttcattttttgggaaagcaaaacaagtcccagcaccacatgcttctctactgctgcctttatttatttattaaaaaacatccaacacactacccaaagaattttcaagtgtctccttccacttttaccatctaccactgccaaaatctaaccactagcagagtaa

SEQ ID NO: 119062 - DNA, 181 bp, Homo sapiens
agcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactccc

SEQ ID NO: 119063 - DNA, 194 bp, Homo sapiens
ccgctttgactttccaaagtgctgggattatgggtgtgaggcaccatgccttgccaaatttgtttcaaggagtaggagtgatcagctctttcaaatgctgctggataggtaagtaagaggagaactgagactttgcccattagattttggcaatatagaagtcactggtggccttctcaagagtagttgcagtg

SEQ ID NO: 119064 - DNA, 492 bp, Homo sapiens
ccaaacaaaacaaaacacacttccgggccaagccctaaaggtagtaaccagccaggctaatagaaaagaaggcatggagccaagaatatctcagctgtagaacctgctagggccatcttggaaaaatcagtcattaacctctgcttcaggtgggtacctatattctgtgcctgtcatgagctgaaatagcatgaccatgaaatctgggatagctgtcatgataacgtattaatagaaggggcattggatggggagaggcaggatccacacgtggaaacaaccatgtcattctggacccaaatttccttctttgtaaaaagttgatttggaattacgtggtctgtaaggaacattgttcctttaacattctattattataggatgtcttatgcggcctatcaggcatgagacattgttgagattcccttgtctcaaaggtaatcacagcatatcatataccaaggatgggttctttggttttccgcaccacca

SEQ ID NO: 119065 - DNA, 835 bp, Homo sapiens
agaaactgtccaatcaggcatgcagctggaaagaacaggctacttccgtaattttgcgggtcctttgtgtttttctgcgtccagagctgcagttcttctcttcactgctctgtgtcctctgctcctagaggccaagcctatgtgtccttgtgtcctgcaggtatctgcagatttatggctaaaagaccgggaccccctggaagccgggaaatgggactgttgacattcagagacatagctatagaattctctctggaggaatggcaatgcctggattgtgctcagcggaatttatatagagatgtgatgttagagaactacagaaacttggtctccctgggtattgctgtctctaagccagacttgatcacctgtctggagcaaaataaagagtcccagaatataaagagaaatgagatggtagccaaacgcccagatgtccagttttcaacatcatctgttgaagggattatattttctccattgtctgctcatggcaaccttgaggcagattatttggtcatacacagaagagttcattgctgggctttctattttgttctatcatgtctttatctgtctttttgtgaataccacatagttattgttattgcagctttttattatgttttgaaattatgaagtatagtgcctctgtgtttttcatgtgtgtttctctagatttggttcataataaaatttaaaaattttaaacaatatttcaggaataaatatacttttggaattttgatacagattatattaaatttgttcaccactgtgggtcttaacaaattaagtcatcacttaaatatgttggcccttgagaaaaaat

SEQ ID NO: 119066 - DNA, 242 bp, Homo sapiens
agcctcagctggaccacatactagttgtgtgcgtggcacatacgtgcttattagaagtgagttgctctttccctcaaaatcactcaacgtaaacagctctatattctgtgtatgtctggtaccagccttggagtgattttttttctgtggtgtaatacctcgtactcgagccactgtttgaagtctgtgtaggtctcgtctctaggggaggtggccggctggattctagggcactgtggcgt

SEQ ID NO: 119067 - DNA, 684 bp, Homo sapiens
catggtggtgggcgcctgtaatcccagctactcgggaggctgaggcaggagaatcactggaacctgggggggcagatgttgcagtgaatgaagatcacgccattgcactccagcctgggtgacagagcgagactccatctcgaaaaacaaaaaagataaaagaatatttgagggccgatgcagaaggttcaccatccaagtaataaagtttcagaaagaaagaacacagaaaatggaaggggggaggggaatcaaagaacaaagtcaatgaaaagatctgagtcgcttcacagaaaaggcctaaccaagtatctgtcacgagaaacgaaaacagccccactccaagccacatcattgtgaaacttcagaactcaaggaaaaagttcagatcccattaggtccaggaagaacagcacagcctgcacacacagaagccggtgctggcagggcctccatcttcaacagcaacactggaagctaaaacacagtggagaaacacctttaaaattctggaggaaatgaatgtccaccctgcaattttacaccatgctaaaatatcaactgagggagaagaaaaaaaatttttgaaaagcctgtctcccacgctgctattcacagaaaatgggcactatatgcccaaccaacatcatggcataaaccaagaaagaaaatgacagcagagac

SEQ ID NO: 119068 - DNA, 829 bp, Homo sapiens
gaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccggggggcaacatgacataaacaggtaaacaaagaagtcaacaggatggccatggagagtaagtgccatggagacgaccgaacgtgcggtgtgctgaggagtaaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctg

SEQ ID NO: 119069 - DNA, 123 bp, Homo sapiens
ttaatcatggaggtctctgaggcagagagggaatcatacttggtaagagtttctaactagggtagtgaagacctggctatttccttattctcccacattcagagatttctgctttaattttgg

SEQ ID NO: 119070 - DNA, 248 bp, Homo sapiens
aatgtgcgtatactatagataaaggatgaaggagaaggaccagaggaggtgggaggaggaggaggagagagaggtctgggtgaatgtgcgtatactgtagacacattaaaggatgaaggaggagggcagaggaggcgggagaaggaggaggaggagagagaggtctgggtggattcccagcacagggattcccagatctgccatccatgacctcaagagggccatgcgaggccctgggagctgcatac

SEQ ID NO: 119071 - DNA, 515 bp, Homo sapiens
cacacacacacactcctagccctattcctccttgaagagaaaggctttcttgctcttatccccacctcacattgtaagaaggggccaggagctaaagaagataacatatgaaaaatgcaactacccccaggattttaagattcaaagaagtggaaatccttgggagtggtgcatccatacttgggaaagaaggaaatcccttcatctctgcattcatagtcccctgagacagaaagactttttctttcttaggcttccagttgatgtgggaagaatcatccaggtggacctggcaggatgacaggttgggtaatggaagccaggggagtactgtttaatcaagtattcactgttctccagctgggcttaccagtggagtgaagtaggagtggcatgtgtgggaaggggaaagaccaaaaaagcaaaagtgacatccatattctcgggccccagccatcttaactagtctcactttaattacttttagtaggtcctaccatactgtgagagaagac

SEQ ID NO: 119072 - DNA, 817 bp, Homo sapiens
  misc_feature (622)..(622): n is a, c, g, or t
gaataaatgttgatttagtgactcataaacttgttttggccaactagaatctaacaactactgaacagttgtgttagccacagtcctgagcactttgtttattagcttatttaaactttacaacaaccccataaagtaggcattattgttattctgatactcttttaaaattgtaaccaacttctgtgcctaaaatcttaactcttatgccaatagctttcaaactttattgaccacatcttatagtgagaaatatatttaacattttacatacatagcgacctagagtagatacatagatacatgtaagtgacagaaaacttcataaaatagcatttcctgtgaataatgcactgtaatattttctatttagttttattaaaaaagctgttttgggccaactaaattggtatcagaactcactaatgtgttgtgacttacagtttgaaaaaacacagcattgagccatagtgcttaccatctgtattttatatagacacaagatgactttcctcatgtgtgcaaaggcaagatggggcatgagacaaagtacaaaccaaaccaagacacatgctcagatttacagacatgagtcattgggcgccttggccaaggtttgttngggggatacatttttgaaaaaacacaaaagcatgatacgaaaagagagaaagaacttttgtgatgagagagttaatgggcccttgagaaagaggttattaaagaaccagtgtagtttgagggacgcagaggggcacccagatagagtgagagagagaaagtgggacaaaagagtgtattgcacaaaggaaaagag

SEQ ID NO: 119073 - DNA, 367 bp, Homo sapiens
aaaaagtgtgtctgtcctgactgtcattcaggcctaaccattatcctcggtaaaggggcatccaccaaacatcagcaaagcagggctcacggtgaaaggaaaactctccattcctggttcacacagttttcaaccaggaagtaccctgcaccaatcacctgggagaaatgcctgatctctcaccgtaaattgttcacagcttcttcttctccaaacccctgttcccacctgcaagtgcacacacagctcacagcatcagcaaggtatgcatgaagaggcagcgaaacctttggaaggggacgatgcagacagacctggtgtcggatagcagttctagccgcgcaaccctcagcaagtcacttagtct

SEQ ID NO: 119074 - DNA, 654 bp, Homo sapiens
cgcccggctgcttttttgtatttttagtagggaccgggtttctccatgttggtcagggtggtctcgaactcctaacctcaggtgatctgcctgtcttggcctcccaaagtgctgggatgacaggcgtgagtcactgtgcccagcttcagtcccttctcatcacccgaaaaggaaacccagtccccatcctgcatcaccctgatccatcccccaccccagcccccgagacccagttgtctctgtggatctgcctgtcctggacattcatagaaacaggatcacacactgcgtagccttctgtgtctggcatctcttactgagcgtgatgtcctcaaggtgcatccccgctgtggcctgagtcagagcctcgctttttaaaataaccaaatacattttttttgagacagagtcttgttctgtcaaccgggctggagtgcagtggtgcgatctcggctcacttgaaccggggaggcagaggttgcagtataagcccgagatcatggctactgacactctagcctgagcgaccaaagtgagacatctggtctcagaaaaaaagaggcagctgggcagaattgggctgcagggtatagatggatgagcttaatctagaagataggagtgggcgtaaaaactgggaatatttaggtagaa

SEQ ID NO: 119075 - DNA, 234 bp, Homo sapiens
cttgaagataagaacccagaacggggttatggagttaaaaggctggggatgttttgaaaggcttttgattaaaaattgttgaattgctctccagaaaggctgttccagtttacattttcagcaaaagtagatgagagagtgcctatttctctgcattcttgccagcactgggtattactgttttccttacttcttgccaattttatggggaggaaaagaggtggctcactgtgt

SEQ ID NO: 119076 - DNA, 588 bp, Homo sapiens
ttacacttgtctcccaacattttgttttctcctgtgaggaaaccttgctaattttcaatcaaacaacacttatttttaaccaagctatgaaaatattttccaaggtatgcaaattcagggtttcaaaacaaaattacaaagttaatttttattgctttacttaactgaaacaaagtaacaatgataacaaacatgactacattttgaggaaatgtagtaacagtcagccctccctatccacaggttctacatctgtggattcaagaccgcagatcaaaaatattcagaaaaaaaaaaatttaaaaaatacaaactttaaaaaccagtccagtatagcaactatttatatagcatttacattgtattaggtattataagtaatctagagatgatttaaagtatatggatgactgtgcataggttatatgcaaatattatattttacaccactttatattaaaggggagcatccaaggattttgttatatccaaggacctgcaatcaattccctgtggataccagggacttgtcacaagttcccaagatcctgttttctatttctgaaggagctcagtgagcccaatgct

SEQ ID NO: 119077 - DNA, 460 bp, Homo sapiens
agtatgcctggctcgctctgaacttaggagaattcttataaagaatacttgtagttcatcaaaactgtgacattcaggacctgttctctttattgtctttaagttaaatcctatcttttcttggctttcatcataaaattaggtttccaatgggagtagagggaaaaaaatctgttcttaggttctcttcttatcctgccttttcctagaccacagatttctttaaagccattccttggacctccaggtttcagttaagatttagggcagaggaaccaaaacttctatgctactaaaataaaaatcatgtgcggtcagggacctttttgttctactttgtaggcccggtacctgccacatagtaatcattgaatattccttgaataaattttattctcaatgagtgtgtaacacaaaaaagttctagagcactactatcctaagatttctgcctactctc

SEQ ID NO: 119078 - DNA, 736 bp, Homo sapiens
atactgcaatatgacattacactagcattgttggtaagattcaactatcttatgtagagaagttatataatgcttatattgataatcaaatgtattaagatattgagttaaagcctcttcagaatgtaatctgggtgaataataaatggcctgagaaaacagaattcagctaaccattatctaatttcaatgctaaatagttctgcacagatttatcaaaaagtaaaaataaaagcagattgagaggaggaatgaataattttgtttgtacaaaatattaaagtgtatgtaatgggcttgtaggatgcattagtaatttttaaaaatcaatctttaccctacactgtgtccataaaatgctaggcatattcatgttaatattactgttgttactgtcatataaatgccatattcaatgtagatgctcagaaaaatatgattgttttgctacaggagagattagaccagggacaataaatatggattaggcaagaatgtgttaactcagcagcccagggttttttcaaccctgcacattcaaaggtaaggtttgtttttaggactagctagcctctgagttctggaaatagtcttaccgtgaagagtgtttttgtatatctgaggccttgggtttatggtgaatgactgacttatatgcctgaggccctgagccatgctgtatttatttgaaccatgtggtatcaatttaaccagatacgtttattctaagatatga

SEQ ID NO: 119079 - DNA, 993 bp, Homo sapiens
tatgggccaggctggtttcgaacttctgacctcgtgatctgcctgcgtcggccttccaaagtgctaggattacaggcatgtgccaccgcgtctggcataaaaccctattattttgatatatgggcccagattctggccctgcatcagtatgcttttaatatttaatttatggaaaaaattaaataataccctttcgattttagccagcttgctcacacacagagttgttcacaaagttaatttttcacaaacctacaatttgcttaaactttcagttttattttgtctttcaaccaaaaataatctttaaactctctaaattagagaagattttctcttttaaaaaaacccatattcccatgtctttaagcagttttaattacataccaagtgcagagcctagaatacaggacagaactgcagataaagtctgactctctctggcctagctaggagtcatggctacctccatatgtccccaggccttatctggaatctaatggctctaaagtaggtaaattgaacaattacaaaagtcacagaagccacttatgaccttaaagcatccagcagaaacagtatctgatctgcctaattcagaccaaatgaagacagttttatttcatcaataatctttaaaactatctttatttaccaaagattactaacgtcatgtgaactaaaatgcattagagttgctatttctttgaaaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcacgactcacagagaccatctatgccatgcttggactgtctgacttgtcctatgtgtccctctttcgtgaataatcagtcgttctattttaggacaagaatttaccatacaagatcttttctca

SEQ ID NO: 119080 - DNA, 514 bp, Homo sapiens
agctctggaaaggcaatgcctttgtctgtgaaagaccatgaggcacaaaggtagcattttcctctcaaagtgatgcaagctttttcttggccccttcgccagacctgtggagtactgggcctaccgtgctcaaccccttgtgggagggagcacatgaatgagtgagtgcgggatccagccagctgctccaggcactgacacaggagcaagctccttgaggggaatgcagcagcacccaggtaagggtgtccatgaccctgaagccccagaggggctgttacagtgctcctttatttccaccgtctgcagatggtggcatgttagcagctcagttggccccttgcctcgctgcacggggcatgccactggtgaggggcaaagggccagtttgacagccttttctgggtacctgtacttggtgggccctgagctcttgtccagtgtccaagaagaatgaggtcacgcagatgattgaaggatggtgaaggtggagaattttactgagcaatgaaaa

SEQ ID NO: 119081 - DNA, 599 bp, Homo sapiens
gaggttgggagtttgagaccagcctggccaaaatagtgaaaccctgtctctactaaaaatacaaaaattagctggatgtaatggtggtgcatgcctgtaattccagttgctcaagaggctgagacacaagaatctcttgaactcaggaggtggaagttgcagtgagcagaaatcacaacactgcattccagcttgggcaacaagagtgaaactccatctcaacataataataataataaaataaataaaaagagaaaaaactaaatatgaatactatttgaagtgctaatataacaataataaaacatatcataacacatatctatattagcacaacatgtaacatagtatgaactctatgtaagcacataaaacaaattgtagatacttatgagacttctgcttcaagatgacaatatcagttatgtatttaatttccatctttccaaattcctatgcaaataacaaaataaatataatactacaaataaaaaagtgtttaaaaagctagaaactgaggtatttccataaggtacaatgcccaggttagaatgtatttagtggatggacatgcaaaacatgattcacagcatgcacag

SEQ ID NO: 119082 - DNA, 305 bp, Homo sapiens
gcaatggccaattctgatgcaaaaccaactgtgtcagtcacccctggagtatgtgtgggctcaaggcatggcaggggcaaagccctccagcagatggcaaagttagttccaaccactaactttggagcccatcccctgacacgagacaaaggacctgcttaaagcactttccaggccccagggcagccccagcaggcccggcgcacagaggagcatctggtggcgaccttccttgagcacagtgatggtgagacagacacgcggcaggtatggagctgaggcccagcatgatgcagtgcctgagg

SEQ ID NO: 119083 - DNA, 163 bp, Homo sapiens
gagcgcccggacttcaagtggaagtttatctgagcccagatctcagtagccagaccccgtccctgccccctgaagggagagcatttgggggtgagtcctttcaaagaagagccaatgcattagtaatttgttcttcaggcctgacagaagcttagcttccaaa

SEQ ID NO: 119084 - DNA, 514 bp, Homo sapiens
ttcacaatatctcttaaattcattaatacctctaaatttaacttagttgcatgaaaagaaaggggtttctgaagacaatggaacacatattttccatggccctttaagttatctaaaacctttacatattttatggcagtagccacagctttaaacatacgctaatacacacacaaactctatcaacagcatgagcatgagcactggacctatgtccaaatgacttagaaaaattcagtaaagaacaactttgttctggactgaaaagggttataagcatcttccctaaattgagtaaattaccagctatttggaaagtacaatatattggcttttattcaaaagagcaacatttaattctggcaacactgccaaattcctcctttcctctattctccttttcttagagaaagtgattaagagaccaattcccatgccagctgaatgcttataagagcatcaaaggtcctctgtcagaattcagaacctgatatggcttagaaaccactacacc

SEQ ID NO: 119085 - DNA, 351 bp, Homo sapiens
ccaggagagaaaagaactgaaacaggaacccggcaccttcccaggggctgaggcccaccgctgactgcactcaagggaaggattaggtctggcttagctcagacaatgtggtagaatgggggcctcagcactgcacctgcattcccttcccccacctcaccatgaggtttgtggggagagccaggtagagctgggaagctggaggcaggtggagagaggggagcagctgcctgggacccagtgggctgtggggtggatccagctcttcttccctctcgccagtaccccccttcctcaggcccttgggccctgccacccaccctgagctgaaagtcagtcccactcaggaga

SEQ ID NO: 119086 - DNA, 307 bp, Homo sapiens
  misc_feature (18)..(18): n is a, c, g, or t
  misc_feature (24)..(24): n is a, c, g, or t
  misc_feature (28)..(28): n is a, c, g, or t
  misc_feature (52)..(52): n is a, c, g, or t
  misc_feature (55)..(55): n is a, c, g, or t
  misc_feature (62)..(62): n is a, c, g, or t
  misc_feature (67)..(67): n is a, c, g, or t
  misc_feature (78)..(78): n is a, c, g, or t
  misc_feature (84)..(85): n is a, c, g, or t
cctagttttagaagttcnatagcnggcnttgggtctcaatctcagctgcccncgnataaccngagangcttgtagccnggtgcnntggtgtgtgagggaggctgaggtggggggtggggagttgcggggagctctcccgtggacagagggcttggggaatggccagcaaagcaatgcctgatgacccgtccttagaaaaagaagtgtgtagtgttacagctctgttagaatttgtctagccccgttaaaaaaaaaaagaaacaggaatacgtgtgtgtgaaatagtggttaacagtggctttcctgg

SEQ ID NO: 119087 - DNA, 439 bp, Homo sapiens
atgcacagctgcctgtcataaaattaaccacaatttgctgtccaagtctttccctggaagttacaagccttcaatagaacccagagttacaaaaaattatatgagactgatttttccagtgtaattattgttcagatatggagacagatttttggtgcttcctactgtgccatcttcccagctccacaatatacatttacttctcaaaacaattagatgagagacagatatggaaattgaggaaaagaagtgctcaatagattgaccaagatttcatatttggctgtagagctgggatttaaatctagcaggtctgattcctgaacccacactcttaaccaccatgctatacaacctctctctgtgactcttcatgtcctctgtggccctctatgatgatatactttacactgtattaataagtactagaaaactgaag

SEQ ID NO: 119088 - DNA, 687 bp, Homo sapiens
atgtacacactgaagaagttccctaaaaatgtggccaagggaccaccactgaagacattccctaagcatgtggctaagggaccaccgccctgtacacaaaccgtgtacacactgaagatattccctaagaatgtggccaaggaacagcactgaagacgttccctaagcttgtggctaagggaccaccgccctgtacacaaaccgtgtacacactgaagatattccctaagaatgtggccaaggaacaccactgaagacgttccctaagcatgcagccaagggactgccaccgtgtacacactgaagacattcactaagaatgtggctaagggactgctgccatgtacacactgaagatgttcccaagcatgtgaccaagggaccaacgccgtatacacactgaagatgtttccaaagaatatgaccaagggaccgccaccttgtacacagtaaagacattccccaaggttcagtcatgggcctgtgaaacatcacaggaaagaatgatgtgcaggatccagttattccaccataaggtgtgtacccaaaggaaaggaaatcagcccatcaacgggatacctgcaccccctgtgcactgcagcactactcacagtttccaagatatagaatcaacccatgtgtcaatcaacacatgagtgcctcaagcaaatgtggcatagacacaca

SEQ ID NO: 119089 - DNA, 475 bp, Homo sapiens
cagtatacggtagcctgtgtgaagggttctggattttatgtgcagggctcagagcagccacagaagagttttaagtagctcagacatgatcagatttgtactaaaagttattactctggctgcagacgatgaggtaggagcacagctagtggggtgaccaagcagaaaccacagcggtttcctgtctgagagacggatgaggtttggaccagagagatgatggagatggaggcagtggatggatcggagaggcatggcaagacacggtgatttagaataggaagggagcagtctgcccatgagagaggaattaaggaggacaaagaagtgtttagcttgagcaccccgatcatgccatctgctaaagtagggatctacagggaaatatatttgctggataagatcatcgtgtcatcataaagatcattctcctcccatatgcgtaagaaattcaatttcagaagtcttttgagaa

SEQ ID NO: 119090 - DNA, 469 bp, Homo sapiens
tttcctggacgttgcaagcttgttctgacctcggaacctccgtacgtgcagttcctgctaccaagtcttctctcccccaagacactcacaggctcagctcctctccttattctggtctctgtccgaatattgcaaatgtccccatgttgcagcccctccctggtgctccttcatcctcttccttcggctccatctttccttgtggccctcagcatcatattttgtattcactgtctctctccctctaacgtcagcttcctggaggcagagacctcttctgtcttgcttatctttgtgctgccaaaactgtgaggtatccccaaatgttagtcagctccctcatttcaccaatgggaagggacctccctcaatgtttttggtaaacttacatataaactttgggtgggggcgtatgcatagtccaaagttcacttgcacatttatattagtggtagagttacacatgcct

SEQ ID NO: 119091 - DNA, 445 bp, Homo sapiens
acatgttggaagtgggcactcaagatggcgaggggtctggaaatgctgtctaatgagaaacacaggaaaatgaaaggatggtcttcctgtgcataggggaagtagaccagtttcatgggctccagagggcagaacttgggagctgtagaacaaccggtttcagttccattccatgcaggggagtcatttcaacggagtctccccatccagcaataaatacctccgtgcaggtcatgagcttcctaccgctaaaggtgtgcgagcagggcctggatgccccttggtcagggaagcagaggggaaaagattgattgaggtgctcttgaaggtctcttctagtgatcagcttctgatttttattatgattatgatattactctaattatagaaccatagcggctatgactctacgtgtctgcatacatttttaaaaccagacctcccc

SEQ ID NO: 119092 - DNA, 678 bp, Homo sapiens
ggaaaacattttttttttgtattatttacattaacaacagctaaaatgtatttcatatttttctacattctgatattccctaataataaattactctggacagaaaatcatcaccatgtatagacctgggcctgttgattggttgtaataacatcgattggtccaggcaattgcagctgtgtctactataaagaaaaatttaaaatcccaggacccccaaacttaagcctggaggctgaatcatgcaacagtatactttagcgaggtcctcctggaaaggaaaaaagccttaggcatgtgggaagggctaccccacagactattcataagtaaattctttgctagcctcccataaacaaggacatgccaattataactttaggtatacagtctaagtctagctcctaaaactaaagtgtgttaaattctacactgataatgtgaattacaaatgtatctcccaggggaagtacaaagagaaaaggactactccctttctctccactcaccttatcttctgtaaaatgtagattcacttggcactaacggaagtctcacaggaatgtaaccattcgccttacccctacctgcccctcttcctacatgccctccctcattttaaggaaatgtataaatactaaaactcctgaaaacctccagaaaaacagccacagatac

SEQ ID NO: 119093 - DNA, 324 bp, Homo sapiens
cagaatactaatgattttaatgaagatgcagcatcttgcaaacaaataattagtttttcgcatgaaaggataaatagaatcctaactaacaaatcggtaatttttcttagagcttttaggttttgatcataacaagtggcagtttttatgtgtagtttgaagaatttattttgttattctatagtcaccgagagtgattataactccaaagtttgtgtaatacagtgtatgtttattttgagttaacagagttgtaagcctgagacaatcaaggctctttgattcttcttttgaacaccacacctaaacacctggaatagtgct

SEQ ID NO: 119094 - DNA, 329 bp, Homo sapiens
ctggagcttctgagagtatgtgtctccaaatttctgtatcacgttcctgtgccacgttttacctactccctggcacacagtctatttggctccaggtcagtctgtctagaacacatttgttcatgcctctctatagatgcaggcctgtagaggcaaatatgggtgtacaaatgcagatataggtctctctatagagatcagcagagctgcctagatacagaactacagatggagttcatgcgaaaagatggtcacttaacctacttcatttcataacacaagttaatactgaattggtaacgatcatatcaggtgccgatgaatagcga

SEQ ID NO: 119095 - DNA, 381 bp, Homo sapiens
tccagaactctgaaagttaaccaaagaattacagtagcacggggagcatttattcaagaaaaacagctgaatcttagtaagaacagtgggctttgtgaactttttttttttctgagacaaggtcttgctcaggctggagtgcaccagcaccaacatggctcactgcagcctctgcatcccagttcaagcgattctcgtgcctcagcctcccagttcaagcgattctcgtgcctcagcctcccgagttcaagcgattctcctgcctcagcctcccgagtagctgactataggcgccaccacgcccggctcatttctgtatttttaggagagatggggtttcaccatgttgcccagactggtctcgaattcctgacctcaatc

SEQ ID NO: 119096 - DNA, 468 bp, Homo sapiens
tggacaacgatgaacttgaatgactttatgtatgcatgagcattaattttaaataaaccagaaagctacttttatatttcgaaaaataattcatttgggttttcctgttcaaactttgccatgttactcctaagtgataccttacttactgagatggatcagccttagggagaggtttgtcatactttgttacacactgaatagcctataattatcaagattatatccagttagcataaagtgctgtttagtttctgttatgtcgttgttaccatagctggagtcgggtgggtgtttaaacctttgtgaactcaaaattctttaatgatgatggaatatttcatgttttagtattctcttgatctagagtatatgttcaaatgttttaccaggtatgtgttttttacaggttcatataatatataaaatgcatttctgttccaagaaaaatacaagtggtaaacagtt

SEQ ID NO: 119097 - DNA, 366 bp, Homo sapiens
taagggttattcctttattctctctataagttcttttgaagtgtggtgttagggaaccatgcctcagtttccttattaactcttccggtgtttatcagatcattttttccctacgctatgtcatcttaaacatcttaagcaattcattgacattttctgtttcttttgtattttcattgactatatttccagttctagattagctgattaatgtacaaattgaattattttgcatatccttggtgatataggctgttgatgccaaaggaggaaaaacaaatagacttgaaaactggtcgaatgcgtcagaaagccatttttggagatgattctgtgcgaacgtcttctctcctttcttgatctctt

SEQ ID NO: 119098 - DNA, 651 bp, Homo sapiens
atctttgtcaggctaaatttatcatataacttttcagtgtctgccagaatacaagggagtgggatggttggtggaagcataaatgcagtgggtcttgattagaggagaagcaaggatgggagaagaggaagagtaataatggaaagttataggtgaggagaaattccagaagaattgaggaatgctaaagacaagatttattcacctcacgattttgctatgagcaagctccctgacccctaacattttcacaacaaagttggacatgcatatgatatcaacagaaccctttcaaaatggaagctatgtcacatagccagattagccaccatttgtacactgttccctccaatggactctggtgcttgtataacataatgtattttcagatacaaacaggtttatttcccttgtgcttgtccttgtattctttgcccttcagttggtggcatccattgccttagagaagagttactacagaagaaagagagggaaaaacagaacccatatgagtttcaaggatcaagacattttaaaacagctttattgacataaagtaaataatatgtattgaaaatatgtaatattatgagtttgaacatatgtaaacactcatgaaaccatcatcacaattagcacaataaacatgat

SEQ ID NO: 119099 - DNA, 150 bp, Homo sapiens
ccccagtcagcccttggaaaggtagcactaagctacattctcttggttccccactcctcaataccagtgaattttattaatttttagctaccagatgggccaaaaaatgctgcttttcttaggatagtagggcagttgagtattttctaa

SEQ ID NO: 119100 - DNA, 117 bp, Homo sapiens
aacataaactttatgagctttttgttattttggctctcttagcatgcactataggtatcaaaccagcctagctatgtcatcaactgttcaaatttccacaactaaaaaagagccctc

SEQ ID NO: 119101 - DNA, 306 bp, Homo sapiens
tccctcaaggtgatgtaaggatgagatgagttgtaggtaggttggtgcccactggaactggcacatggaaggcccctgaaaacagtcaatgaacatcatccctgcttatcagcattgagttgatgccaagggcctgccctttgtgagtgtcatgggatggaaaaggagaaacagagggaagaggcatgatgcgagaggaaggagggactaaaaggcacaggagcagggtgaggtgcaggcacctctgggacaatgtatgagttggtgccgcccagtgtgtcaagcctgcagaaaatggtgccacca

SEQ ID NO: 119102 - DNA, 320 bp, Homo sapiens
catatctcagttatgtaccaatggagatgaataacagtgcaagatggtgaggactgtgtctgaggagaagggtaaaaaagggaaagtggaagggatcttcactttataatttttctttaggattaactctggtgtgaagattatataaagtaagggaagggatctaacattcatttctatgtgcccacactttgtactggacacattatctttattatctctcttaattttcatagcaactgtggaataagttatcaccatgatacagtacaggatgaacaaattctgagattaacaaatctgcctatggctgctcaact

SEQ ID NO: 119103 - DNA, 122 bp, Homo sapiens
tattctttttgagcttacacagaacattcataaaaactgaccatataatagcccaaagagacacttcaattaccttcccaaatcaatgaaatacagactctgtacacaaagtatagagcaat

SEQ ID NO: 119104 - DNA, 166 bp, Homo sapiens
tggtattaacacagtgaataattctttttgttcaggttttcaaaataatggcccctagctataacgattctgaaataacagacctaaaaatcatcagcagttaccccggcaggaagtgtgctttgcgatgcctgggtcagcacccagacatccccactcggcctga

SEQ ID NO: 119105 - DNA, 729 bp, Homo sapiens
ctagtatattgcccaggctgctcttgacctcctgcgctcaattcatccatctgcttcagcctcccaaagtgctgggattataggcatgagccttcatgcccagccagattattatttttcaattccactgactaaaatatttgcaaatgaacttgcaacatagttaataagaaagtgttcctaaagataatcgttgtcagtaattcaatcatttcaagttaattatgatcaatgtttcatatgatcaacttgtagcatcacatctcactgtttatattaacctgaccaccggaggttgccatctcccatccaagtgttctgtgaaggtggtattccaccatcagatgtggtaattctcatgtttgctaccaaaatagaaaaagagttataccctttaaagttattttagggaaaaagaattttcagggtttgatttattgatggttgcttttatttgtgtaaaagtcccaaaattaactcaaaggatttttagtaagataaaaggaaaaaggtaacacttttagaaatttgtgtttttccaactgtttaaagctatgtgcatgactaattagaaattttgtttaaagttcacgtcagtgagccagaaggtatttttttaaaataactgttatgtggcccagcattgcactgtatatgttgagttttgcatggtgtatagtagcacatcaaagtacaatcctatagactgatagtgataggtatggctgc

SEQ ID NO: 119106 - DNA, 626 bp, Homo sapiens
agcgggggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaagccaaatctcacctggcgagatatgcagcacctggttgtctggacctctgagtatgacccgctggccaataaccctggatggaaaaagaatggagcaggcttgatggtgaatagtcgattcggatctggcttgctaaatgccaaagctctggtggcatttagctgaacccaggacctggaggagcgtgcctgagtact

SEQ ID NO: 119107 - DNA, 545 bp, Homo sapiens
actctcggacactgggtaaggggtggggggcgggcacggcggactacatttcccatcatgcctagcactgcggtcctcactaaacaaaaaaggaagtcaattccttcacctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacagaagaaa

SEQ ID NO: 119108 - DNA, 2212 bp, Homo sapiens
gagcgcgagcccgcgggtggcgcgcggcgcatggtggcggctcctttcggagcgcagccgaacctctgacccggactccgttacccctgcccggcgcgccccggcggccggctggaggcagaaacagcagaagcgttaacagcagcagcggcggcggctgctccgccgccgtctccgcgggagcatggagtgcgccctggacgcccagagcctgatcagcatctccctgcgcaagatccacagctcccgaacccagcgcggcggcatcaagctgcacaagaacctcctggtgtcctacgtgctccgcaacgcgcgccagctctacctgagcgagcgctacgccgagctctaccggcgccagcagcagcagcaacagcagcagccgccccaccaccagcaccagcacctagcgtacgcggcgccgggcatgccggccagcgcggccgacttcggcccgctccaacttggcggcggcggggacgcggaggcgcgcgagtcggccgcccggcaccagctgcaccagctccaccagctccaccagctgcacctccagcagcagctgcaccagcaccagcacccggcgcccaggggctgcgcggcggcggcggcggccggagcgcccgcgggcgtgcgcggggggcgctctcggagctgcccgggtgcgccgcgctccagccgccgcacgggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttgccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacagaagaaa

SEQ ID NO: 119109 - DNA, 2311 bp, Homo sapiens
gagcgcgagcccgcgggtggcgcgcggcgcatggtggcggctcctttcggagcgcagccgaacctctgacccggactccgttacccctgcccggcgcgccccggcggccggctggaggcagaaacagcagaagcgttaacagcagcagcggcggcggctgctccgccgccgtctccgcgggagcatggagtgcgccctggacgcccagagcctgatcagcatctccctgcgcaagatccacagctcccgaacccagcgcggcggcatcaagctgcacaagaacctcctggtgtcctacgtgctccgcaacgcgcgccagctctacctgagcgagcgctacgccgagctctaccggcgccagcagcagcagcaacagcagcagccgccccaccaccagcaccagcacctagcgtacgcggcgccgggcatgccggccagcgcggccgacttcggcccgctccaacttggcggcggcggggacgcggaggcgcgcgagtcggccgcccggcaccagctgcaccagctccaccagctccaccagctgcacctccagcagcagctgcaccagcaccagcacccggcgcccaggggctgcgcggcggcggcggcggccggagcgcccgcgggcgtgcgcggggggcgctctcggagctgcccgggtgcgccgcgctccagccgccgcacgggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcacagggacccggggccccgcggggctggggccagacaaagactcggcaaaggggcgagaggagggaacgagcgggcgccgggccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacagaagaaa

SEQ ID NO: 119110 - DNA, 2007 bp, Homo sapiens
gagcgcgagcccgcgggtggcgcgcggcgcatggtggcggctcctttcggagcgcagccgaacctctgacccggactccgttacccctgcccggcgcgccccggcggccggctggaggcagaaacagcagaagcgttaacagcagcagcggcggcggctgctccgccgccgtctccgcgggagcatggagtgcgccctggacgcccagagcctgatcagcatctccctgcgcaagatccacagctcccgaacccagcgcggcggcatcaagctgcacaagaacctcctggtgtcctacgtgctccgcaacgcgcgccagctctacctgagcgagcgctacgccgagctctaccggcgccagcagcagcagcaacagcagcagccgccccaccaccagcaccagcacctagcgtacgcggcgccgggcatgccggccagcgcggccgacttcggcccgctccaacttggcggcggcggggacgcggaggcgcgcgagtcggccgcccggcaccagctgcaccagctccaccagctccaccagctgcacctccagcagcagctgcaccagcaccagcacccggcgcccaggggctgcgcggcggcggcggcggccggagcgcccgcgggcgtgcgcggggggcgctctcggagctgcccgggtgcgccgcgctccagccgccgcacgggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattacagaagaaa

SEQ ID NO: 119111 - DNA, 634 bp, Homo sapiens
aaattgatcttgataaagacctagcatctctcaatgtggatcacttgagaaagaatagccaataaattggtttattttctaaattaggagcagacaggattgcacctaatttaggtgctttctgcctctgttttcctaagattaaagcatgtttcaaatagaatatctaaatacaggtactattttatctgccaatttagaaacctctggattcaattatagaaaatactatattttccattgtgtataagacacaatggatatggttgtaatagcttgagtactttcatataaagtaaaatcaaacatacttttaccattctttcatgagttcaagtcataaaagaaggtataccatttatttctgaatagtatctgtactagtgatgatttcttgactccataatgaaagaactaaatttatcagatatcaatatcaatactataaaatccttcatgccacttgttttagaaaagaactcacattgatgttataatagaacaatgtcatgtcagatttttactatctgtgattaacattgcagaggacctaatttgttatattatagttaaatgtatagcaaaaaaaaaagataatgaaattccaatgtccttagaagggtcttgcctatta

SEQ ID NO: 119112 - DNA, 761 bp, Homo sapiens
gggaccacgaagaaaccacacctactgattgatgccttgatcttgaactttcggtcttcagagctgtgagaaaataaatttcagttaagtcactcaatctatggttttctgttatggcagccctaggaaactgatgtaggtatatacccagaggtgagattgctggatcatatggtaattctattttaattttttgggaaactgtcatactcttttccacagtaggtgcaccattttacattgccatcagtagatcacaagggttccaatttctccacaatctcattgacacttgtgtgctgtttgttcgtttgtttatagtagccatcctactctctgtgatgtggcatctcatcgtggttttgatttgcatttccgtaatgcaatgtagtgatgttgagcaccttttaaagtgcttgttggccatttgtgtatcttctttgggtaaatgtctattcaggtcctttgcccatttttaaataaagtgtttgcttttttgttgttgagttgtaggtttcttatcctttaaaaaccctcttgttggacctaaaccctgggagaactgatgaccatagaagttttcaaggaacctaattttagaaagagagggggctacagatatgtagattaattgtgtgacttactgtccaaaccggacacttttgagaagggggtgctaaacatcattataattttatattttaaaaaatatttattgaccaacaaattcatgttattatattggtggacttataacaatt

SEQ ID NO: 119113 - DNA, 495 bp, Homo sapiens
aagaaaaaaaaatcccaagtcaaaataactagaaatttactggagacctacttatcaaactttaaataacttaaaggaaaaaaggcactgtcaatctgattactgcacagtaattaagaactcaagctcttggacaaggtctctcaacgctgacactcatatattttggcgagaagtctttgtttggggaagggggctgcatcctatgcactgcaggatgtgtagcagtattcctagcctctacttgttagatgccattagcagcctgtccactcccataccccagttgtgacaaccaaatctctccagacattgctaagtgtcccttgagaggcaaaatcaccctagtgaaggctttaaaaccgcctgtgtttaaattcttaccccacaatatttaactgtgtgacaagctttttaacctctctgtctcagtttcctgtttgcaaaatggcacataacagtacttacctcagagttttgctgtgatgattatgg

SEQ ID NO: 119114 - DNA, 410 bp, Homo sapiens
atgagtcttttcccttggcttactttaaattgtattcattccctgtaataaaccataatcatcagtgtaacagcttaaagtgagttctgtgagtcattcctgtgaatcactgaacctaagagtggttttcggaacccactgaactagtatattggtgccaaaactgaggcagtcctgggcagtgttccctgtaatttatagttcactgaactttattttttgtctgctgttctgaaggtacatcatgactaaacttttgaagatggtgtcagaggtgagaacagtgttagggactgtgccttctaactctcgcaaaatcctttttaattacaaaagtaaaccacattataaagaatttggaaggttttctatgaccaccctattaaaaaaaaaagagtctcttgaattca

SEQ ID NO: 119115 - DNA, 418 bp, Homo sapiens
atatcacttgtgctgttctctgacagtgttaagggcaacacatatagacctggagccaagtggattttgccttttcaatgggttttctgactatgattaataatactatattgtatactagaaatttgctaagagaatttcaggttctcttaccacacacacccaaagaagggcaactatgtgagatgatgtatatgtgcataagaatatcataacatcattttgtacaccttaattatagatcattttaaataaataaatcagtttcctaagatgaggtcagaggtcaatgacttcctgagcctccttttaacttcatcctggagagtcagggtaaaaggtggtgtcatcctagtctaaacatcatcttttcttctcctatagatcatatattaacaacaacaacaacaacaacaac

SEQ ID NO: 119116 - DNA, 1063 bp, Homo sapiens
agttctttcttatctcaggacattgcattcacaacacattctgcaatcattcttgagaactctaagtgagaaaatggggagaaacgggttggtctaaggtcacccagagaattattctccagtcaacatatttcagtatatctgcagcaagatcatatttcaagtgtgctggtagagcttctcctttgatggaaacatttgttatacagttctgcttccttcacttgcagagagttgttgttatgatgagtctccaatgaacctgctgcatccctgctgcatatctattatctggggtaatcttcctaaaaagcagagtgtcaagcagcatgcctggttattccaacttatgcagaaatagaagtgtcctaagcttggggcaagatggccgactagacacagcaagtggaattaccgccagcaagggactgagacaactggcgcactcctaacaaatcatccgatggaaggcaccaggagtggccgagggaagacacagaaggaagctgggctgaaacaggaggaacattgcactgggctaccatgcgctgggacttgttcctggcccccaaggactctcagggaatggatctaacggtgggaacctaagtcacacaactacaaaatttaaatacaatgggaataattggatgctgaggtggtaggcaccaagtgacagcactcaactatcaacctcaaggtcaatcctaaattgggcaaaggaataaacggaagaatgacccgcgctccaatggactggctatctctgacttattctggatttcctaacgtgccaggtgttagattcccttttgcttagtcattcaaaccaaaggagctttaagtatggaactccgcgagatcctaactcaatccagccattcataattccaggcgtataaaaactcatactggcgcccgaaacaacagaacgcaacaaaaatctcccagggggaggacgcgcaaaggggggaagcccaagagggggcggagacaccgttggccctcaagggggagacaccgacgcggggcgacaagggccacacacggcccgcggaaaggc

SEQ ID NO: 119117 - DNA, 251 bp, Homo sapiens
ctgctttttggaagtctctgcttagggcagatctctgattcctccctggctgagcggggagccaggctggcattccagtttgtgctgaggactgggcaggtctggggatcatagaggagggtggctaggggccacatagagggctgcccctccctgtgagcctctgggtgtgactgaggctgtggtcaaaggagtggccgggaaacagccaagatggcttcgtgccaggggcaagaggcacaggtgtgggg

SEQ ID NO: 119118 - DNA, 250 bp, Homo sapiens
taatcagagttgacttctggataaaggtttttccacattcactgcattcatagggcttctcccctgtgtgagttctctggtgtgctatgagggttgacttctggctgaaggcttttgcacattcgcagcattcataaggtttctctccggtgtgagttctttgatgtacaactaagtttgctttctggataaacacttttccacattcagtacatttgtagagtttctccccagtttgacttctctgact

SEQ ID NO: 119119 - DNA, 383 bp, Homo sapiens
ctactactactaaattcgcggccgcgtcgacgtaagaatgtctgggatacttttgtctaagtgaaaaaaaccaaagttcagaaaagcatagtaggagcagccgggcatggtgactcacacctgtaatcccagcactttgggaggccgaggtgggtggatcacctgagatcaggagttcaagaccagcctggccaacatggtgaaaccctgtctctgctggaggtacaaaaaattggccgggcatggtggcgcatgcctgtaatcccacctactcatgaggctgaagcgggagaattgcttgggcctggggggcggaggttgcagtgagccaagatagtgccacggcactccagcctgggcaacagagcgagactgtctcaaaa

SEQ ID NO: 119120 - DNA, 761 bp, Homo sapiens
gtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttgcaagatattaatgatgaaaagtctttaagtcatcttaaatctgagtcaaaggagccattaaaggattctgaatttgagtctttgaaaacctgtaataagagctttgaagaagatccaaagtggtccaacccagaaccaaacgatctgaaggaagaaaatgaggatgagatccccactggaatgccatgcctggagtcagtgaccataggtgatgatatttgggatgagaactg

SEQ ID NO: 119121 - DNA, 184 bp, Homo sapiens
ggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatc

SEQ ID NO: 119122 - DNA, 451 bp, Homo sapiens
caatttcttactacagagttagacaaactttttctttaatgggggagtgggagactgggagactgatcatacatattttagaccttgtgggaaccacatgtgatctctgttgcatagtcttctttgtgtccccgcccccacctttaacaattttaaagtgtgaagaactcagcactttgacccagggccatagcttatataaccttggggcagtgggaagggaaggaaggatggtggaagggcaggtaatggtggaatccaaacattttaccatgttattaaaggcctttcaagatttggatatctctctggtcttactgtcttaatcttctatcctgttgatgagaagagtgaaactctataaaatatttgaagagatttatttggagccaaatatgagtagccagtggctaatgacacaacctaggagaccctgagaacatgtgcccaa

SEQ ID NO: 119123 - DNA, 432 bp, Homo sapiens
tcactctagagtatcccctgcggaccctatcatgtgatatactctacaaaaagcctgctgagtattttgattgggattatgttgaatctagatcaatttagggtgaaaaacttttgttagattaatcccttagtatttcacatttttaaatgctaaatggcatttttcaaaaattttcttttttcttttttttgagacagagtcttgctctgttgcccaggctggagtgcaatggcgaaatcttggttcactgcaacctccgcctcctgggttcaagcgattctcaaactgcctcagcctcccaagtagctgggattacaggcatgtgccaccatgcccggctaattttttaaactatttatagtagagagggtgtttcaccatgttggccaggctggtcttgaactcctgacctcaggtgatctgcccacc

SEQ ID NO: 119124 - DNA, 415 bp, Homo sapiens
ttacaagatattcatagattactcaagtattccttgttaaatgtagaacagagtaattcatgatatcaaataattagaaacaatgtatttgtccaacagtagtggaatggttaggttctctgtggcctatcttctggatggaataaaatgcagccattaaaaatgctgtctgtgaagactatgtgatgacatcaaagtactcctgataacaatgtaaagtgaaacaatcaggatgtgaagtgtataaaaatatgcttataactatgtaaaaactatatattatccaaagtacttcagtccctggattttggtgtagtaatttttttccatttctcatatgtttcataatgtgcttattattgcttttatcattagaagtgaattgttaatatgctaaagtaaagtgattggaatg

SEQ ID NO: 119125 - DNA, 608 bp, Homo sapiens
cattataacatggtggttaaaatcatgggctctggatccagtctttttgggtttgaatcacaattttgccacttaccaggtttgcgatcttaggaaagttcacttttcaatgccttgttttcttcacccataaaatggggattataaaagtacctatttcaaggggtgttgtgagcattaaatgtaaagcactattctgagtagtccctgaaacataataaatgttctataaaattagtgattatatattatataatgtatgtatagacctacatagaaaaaaattgttcatatatatacacatatatatacacatacatatatatacacacacacacactgtggtcatatgtaggctagatttttttcattgctttcataaaaatcagttttattgaagtataatttacatgtgatatgatgtacccattttaagcaaacagtttaatgagtttgaaaaatatatacactcctgtaactactgcagtcacaatcaggatataaggcatttctgtcatcctcccaaattccctcctacatagtgtcccagtcaacatctatctacccttaacccctggccctaggcaaccactgatctcctttctgtg

SEQ ID NO: 119126 - DNA, 259 bp, Homo sapiens
gctaggttggagttagcctggaggccttatataccaagagtttgaatttcagactgaaggcttctgaatgggattaaaatgacaggaaagtaagcagcagtgcacatatacagagatcagagactgatgttcaggacggaatggggaggaagagcctggaggttagttctcaggggatgtttactttagcaatcataaagagtccaggcctggcgcggtggctattctttcttttttaaagcaagaatttcatttaatg

SEQ ID NO: 119127 - DNA, 274 bp, Homo sapiens
tggggaagggttggtggtcaagacttttgacccagggatgggagctcatggcaacactgtgctgtaggtgtcccgagctcatacctcagagctttgatctagaattctcccctggctttcttctccgacagggccaattagaagcagggtaggcccgatcgtgaggtctcagtagaaaatgtaaggggaggctgctttaccccagagtgccctccatcacccttggtgcttcacggtgtgcccagcactgtgcgaggccctgagatcagtcaga

SEQ ID NO: 119128 - DNA, 481 bp, Homo sapiens
attactgtactcagggttttcctgtgcccctttccccagaaagatgagtgctacatgcttttggccgacctcatgcttcagtgcttgacagctgcatccaggtcctggcaggccggcactgtggtgagatccagctccgaggtgacttcatatagcatgtgcttgaagcccgcctacccagacttggatatttatagcaggggagcagctagaaaaaaaaaattaaatatgctacacccttctttatacgatgtgggacagagacaggcattgtgaggaatttcaaaggcagagctgtataatccagcaggatatttttaaatgctgtttgttgccattggcagggccggtgtttcaaagaggagggaaaatgagagtaactgaggatgacaggctgccaggaatgctgaaggccgagacatggagctccatgctccgaggtatacaggctctgaaccctgatgtacttcacagtcacata

SEQ ID NO: 119129 - DNA, 487 bp, Homo sapiens
caacaggtttgtaaaataggaattcttagtttcattttataggtgaacaaatgaagcattgaagggttatgtagtgaataaggtcatagagtgaataagtggtagagccaggattcaaattcaagtctgcctgactccttgcttgtaccactaggccatgcagcctccccagcaggaaatttctaagactgcttctcccaggaatttagctgtctaggagatactactataccgaatccaaataggacttagaaattccaataattggggtgttgcttctgccacaatctatgagcactcagagttgatctattgtttttgtattgttttgttttgttttgtttttttggagacaggatcttgctctgttgcccagcctggagagcagcggcatgatcttggcttactgcaacctctgccctgcctcccctgctcaagcaatcctgccacctcagcctcctgagtaggtgggactacagacatgcac

SEQ ID NO: 119130 - DNA, 605 bp, Homo sapiens
actcgcatagacactgctcagcaatagtggggatcaaaagaagaaaaaggtcgctgcagtggaagaagaaaattccaagctgtactttttccccaccccacgtgtgggggcgctgccctctccccagctgagcctgtgaaggggtggcaggacaaaaagggcagccacaagggtctgcgaagtccactcgatgaccacggaggccgcctgaacatgctaatgaggggatggcggtgctgccagcgagttgggagcctcaggcaggtgggctccttggtggtgatagatcccaatctgaatcagggctcccgcctcacctagaagctcagccttagcctggcaaaccccacccccagcaagtgttgagacaaaggtgggcagagcagagaaggcagaggaagggaggctgcaaatcctgggcagcttgggggctgcagggggtgctgggaaagggagggagaagcaggaaaagaggaacgggcccagtccctgaggttcagcgggcctctcctgacagactggatgtttctctcccagtgacctctgtttagcagacaataactcagtggattaatgaccaatcagcgaaaggccttccgaattgc

SEQ ID NO: 119131 - DNA, 760 bp, Homo sapiens
gtctcaaagtcctgacctcatgatccgcctgccttggtctcccagagtgctgagatttacaggtgtgagccaccatgcccaactgcttcatagactcttagccttataaaatgctagagaacattagctagtttcaaacttcgtgttttccactgtactctttagagatccacttctataagttgaaagggagagggggacaagtatgtcctccctacttgtgctttaaccagagctctccttttatttatcaaaaaaacatgcacgcgtgcacacacacacacccccctcagtgtaagatttcagttaaaagggttttattgctaaaacaaaaaaggttgaaaaccatgagtctggtctctctcttttacttatggatgaagacatttagattacagggctcatacctgtaatcccaacactttgggaggttgaggtgggaggatagcttgaggctagggttggagaccaacctgagcaatatagcaagatcccatctctacagaaaattttaaaattagccaggtgcggtggcttacacctgtaatcccaacactttgggaggctgaggcgggcagattgcttgagcccaggagttgaagaccagcctgggaaacatggtgaagccccatctctacaaaagttagttgggtgtggtggcacgcacctgtagtcccagctcctcaggagactgaggtgggaggatcctgagcctgggaagttaaggctacagtgagctgtgattatgcgactgcactat

SEQ ID NO: 119132 - DNA, 811 bp, Homo sapiens
acagaagtagagatgcattaaagagggtaggaaggacagtttcacatgatgtctcccaagctcagtgtcaagaaagatactcctcctgggggaaggagagtgaagtgagcaccaacttcactgtggaccccagcaccaggctcatgccactgaaccctcgtgcaaggctggcctcccaagctccagccccaggctctttgaccaatggatcaaagaagaaatcaaaaggaaaattttaaaaatcttaagacagaaatggcaacacaacatacctaatttatgggactcagcaagagcattcctaagagggaagttaccatgataaatgtctatgttaaggaaaaagaaatacttcagataaataacctcaacctcacttcacacttcaaggaactaaaaaagaacaaactaagcccaaagttagcagatggaaggaaataataaagatcagagcagaaataaatgacactgagactagaaaaacaatagaaaagatcaatggatctaagagttagcttttgaaaagttaagcaaaattgacaaacgtttagttgactaacaaaaaagagcacactcaaataagcaaaatcataaatgaaagaggagacactacatccgatactacagaactacaaaggatcgtaaaaactactattaaaattatatgtcaataaatggcataacctgaaacaatagataagtttctagaaacataccacttgtcaaggctgaatcatgaagaaatagaaaatctgaaaagatcagtgagtaaggagatacaatcagtaatcaaaagtctcccaaccaagaa

SEQ ID NO: 119133 - DNA, 611 bp, Homo sapiens
ggaaggaacactgtatagtggattttgtatggctagtacacagattctattgtagtttcagttaagtaagagttgtttacaaagtctctgcgctatacattctgctttagttaacacgaaagagtgaataaatgtatgcctttgatgatttattatttccatagtatctgaggagccgtcatcattctgaatagccaagattttaggcacaacagacagaaatgaattataaactaacctcaaaatagaatatcttatcatttataatacagaaattattcatgctgcagttctttagtaaacagcttgctttcttgtcgtctgacactttcaaaaatggagaagaagagaaaacttgaattcagagttctgggtagtaatgtcttgtgaatgagcttacactatgtttcgcttcacttttttccaattagatttcagttctctctcctttggcaccccctcattctgcaacatattttattgcctattttttttattagtcaactattgaaacaggtgaattggctacaaagaagagcttagtcactcagagtcaactaagcagcaaacactggccaccaagacttggactcttgtgaatcagcttcaga

SEQ ID NO: 119134 - DNA, 163 bp, Homo sapiens
cttcgaatcacatcttcacaggcagtggaggttttattggcagctctggcagatgaagtttgaaatatatcaacagtcagatagattagaaatgggtagtggcatcaccagctttctctcctccgcctttgtcttggtgtctcaaccctgtcgtaaaatgccc

SEQ ID NO: 119135 - DNA, 412 bp, Homo sapiens
acagttttgcacaagctacaaagagtaatcatattggtttttgatgatttgcaaggcatttaatataatatttacatctcagatcctgtggttataatgcgctgccatctttgctgaatctaaaaccctttgatttagagtcatgatacgataaaatttttcatatatgaaagctcattttttgaacttataaaaaaggaactaaggcaatgacttcagcccttagtgctgttgagcttaatattattgagaatataaccacggtgtatcaaaagtagaaatgataaatatatctcattttaatggtaccctctttatagatgtaagtgttgtattggcagaatgaattgtgccagaaattgaattttaattttattataaatgaagtagactgcttagatttttggatttc

SEQ ID NO: 119136 - DNA, 499 bp, Homo sapiens
taatgtttttccttttccaggatatcatataaatggaataatcctctgggtaacttttggagtctgtcttcttttacttcacatgtgcatttgagatttatccatgttgtgtatatcagtagtccattcctttttgattgctgaatggtaatctattgtatagatcaacttattttttaacttcagaaacaaaatcatagaacttcattataagatttttattacatatcacatttatatgtattcttaacattttaagttatatataattaaagtctgagatacaatggttaatttttaattcttgtattcctcttttaaacattgttatatagggttttgttttgttttactgttattttcagtttatcttattcactacaatatgaagtctagaaggccagtggggctcaggactgtctgcaagacaatctataggtcaatctgtataataggcctctactccaatcatattaaagtaagattttctaatttttta

SEQ ID NO: 119137 - DNA, 286 bp, Homo sapiens
atttttagtagagacagggtttcaccatattggccaggctggtctcaaactcctgaccttgtgatcctcctgcctcggcctcccaaagtgctgggattacaaatgtgagccactgtgcccagccccactcaagtagtttttatgatagaatgattagaataaagccattccttttccagtgaattctccttttgcctctcccacccatgcaaagatacatcctagtccaaaatagggggatagtcaccaaacattttgttaaatatgagagaaaaacaagtgacct

SEQ ID NO: 119138 - DNA, 249 bp, Homo sapiens
gatgagctgggcattgtggcacatgcctgtaatcccagctactcgggaggctgaggcaggagaatcacttgagcccaggaggcggaggttgcggtgagccgagattgcgccattccactccagcctgggcaacaaaagtgaaactccatctcaaaaaaaaaaagcagcagcattgtgtaatattatgtagatgttgtgtctcatgatctatcctgagaaagcttttgggaggaactgcatcatagtcat

SEQ ID NO: 119139 - DNA, 573 bp, Homo sapiens
cctgacagactactgtggccaccatgggcatgtcagttaatcactaaacattgcttttcccatcccatctgtgaaaagattggacaacatcatcttgttttcctctttagatgaagatacttggatatggacagaactcgggtgtggtgatagaagagaattacatagtttaaatcataacctagaacttgggaactaaacgatagaagagctgaactatggtagtctagtgtatttccctcttgaggcttccataactggcctggttgatttttctaggtcatttgggagcctgaattctcttgataaacatgcttttgataatatggtacaacctcactgtacaggcagtcctttgaacggcagttggcagaggtaaaaatggccatgcaaaaaactacccaaagtgctgggattacaggcgtgagccaccgcgcccggcccacatgaaacgttttacatttatcacttaggtaatattaatggtatagtgaagctctagtctctgactgtagatgcctggaaaatgtctttgaggtaatggagaactcagaaaaaattgatgaaagaata

SEQ ID NO: 119140 - DNA, 230 bp, Homo sapiens
aatggcatacacgatgatcccagtgctgcacttcttttgctgtgaaacaagttccttagttagaaccaaggttgtgtgggaagccatcaatatggtattcgcaaagtccatgaatggtggtcctgacagatgcattgctgtcaggcaagtcaagttcctatttagaaaagtgtctttttcagagaagatagatcactgccccctccatgatggaaatattttattaccag

SEQ ID NO: 119141 - DNA, 3267 bp, Homo sapiens
ccacgcgatcgcggacggcgtgggctggagatgagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaacagccacttggcctttgtccccattccttctccaagaagaatgttctgggtgctaagtctccaccaatgatccctgtggtttatgctgctgctgtgctaagactgcctatgaaggaaaatattccagatccctcctcctccccgcagctcttctcttccctctatgagagatctgaagtacgtgtttacaaagtaactggcttctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatgggcaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgaatggtcatcctttttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgtattatg

SEQ ID NO: 119142 - DNA, 469 bp, Homo sapiens
tgcaggacaaagggctctttaattcttccaactgcaggggtagcttggtccccactatttccggtgaacttccagaaatgctctttctgtggaagaaatatttaactccgtattgccgctttcttcaggatctgcttcctggtcatgtcctcatcctacctggcgttccgtatttctcggctagagcagcagttatgctccttgagttgggatgacccagtccctgggcacaggtgaggccttttctctttctaatgcctttgatattgagggttgaggacaggagccaagaacctcaggccaggctgcctggctggacttggtcctgttttgagctggcttctgaccctaagcaaggttgggcagcgtgcagggtacaccagtcccaccctggcccactcttgggggaagtaaagttatcactggcccttctgcccacgtccgtctgcattctgggccctttccctga

SEQ ID NO: 119143 - DNA, 3271 bp, Homo sapiens
gaccgctttaagccggagcgaggccaccgaggagggcggcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaacagccacttggcctttgtccccattccttctccaagaagaatgttctgggtgctaagtctccaccaatgatccctgtggtttatgctgctgctgtgctaagactgcctatgaaggaaaatattccagatccctcctcctccccgcagctcttctcttccctctatgagagatctgaagtacgtgtttacaaagtaactggcttctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatgggcaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgaatggtcatcctttttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgtattatg

SEQ ID NO: 119144 - DNA, 461 bp, Homo sapiens
gtggtcattcctgtggtgtctgtgcaaatgatcaaaaaacacaagatggcacggctccttcccaatggactggccatcaccaccaacaccagccagaaggtcagtgcactgggcccatgctcccttgtcagtctcccgctcccagccctgacagcccacagtctgactcgggcacattcccaggtctttatttcaccccaccctgcagctctccagtaggtatttcaggccgtacaacaagctggaagagaagttcctaggcagagcttctgttggctctcatggcctgatacccctgtgggcctgtgcccaatccacaagggggctggctggcacagcaaggagtctcatctcaccctacccctgtctgttttctttccatgtcccagtatatctttgtgtcactgctctcccgggacagtgtatatgacctgctgaggagagtctgcacccacctacag

SEQ ID NO: 119145 - DNA, 411 bp, Homo sapiens
aaacaaaacaaaacaaaaaaaaccccaaatcccaaaaaactggttaggatttcctgtataggcctaactagaagcagtactaacacacatttttatcttgtttctgattttaaagagaatgctttaaaattttactattaaatatcaggttaagagaattttcttgtattcttagtttgctaaaagtttcttaatataatatatggatgttgaattttttttcctgtgtcttttgaaatgatcttatggtttttctcctaaatctgttaatatggcagattacattactaaatttagcaatgtcagtctatccttgaattcctgggataaatcttacttgattatgacacagttaagtagatatgtgtatgtagacatagacatttagatgatatagatggacacactttg

SEQ ID NO: 119146 - DNA, 300 bp, Homo sapiens
tcgcaagttccacccacacagctgattatgtcctttccagaagcaggcgtctcttccctggccacagccgcttttgtggcttcagtctctccatcagtttcatcccctctgcagagtatgccccccacccaagctaatccagcgttgccctctcttccgactctcctctctcccttggccacacctcctctgtcagccatgtctcctctacaaggccctgtttctccggcaacatctctggggaattcggcttttcccctggccgcactccctcagccaggcctttctgctctgaccacg

SEQ ID NO: 119147 - DNA, 395 bp, Homo sapiens
caaataccctatcaacaacaatttcattaaagacttccaaaacaaaacactcgttaagactaatctcttcacaataaatgacaaacatcaactttggtcatattttgagggccactggcttttggactcaaaaataatggctgctccttacatttaagtcatctactgtttcaattaaaatgtaaaactaatctatttaaggcatttaaatggatgagttttcatatcagtctaaaacgtttctgtgtattatcatcatagcaaaatagcaagcaagttaaaacaaatatacaaaatgaggttttttttttaaaagaggatattttgacatttttccaaaatgcattcaaaagaaaggtttcacagttttatttctatggatattaactcacgta

SEQ ID NO: 119148 - DNA, 731 bp, Homo sapiens
tgttgaaaagattattatttgccctaatttattagcttagcaactttccagaaattcagttgcccatatgtataggtctgtttctggaattccttctgttccattgttctatatgtctgtctttatgccagtatcacactgtctttattattggtgctttattaatctttttttttttttttcttgaggcagggtctcactttgtgctccacctcgaggctgtggagttgccaggggttcgccagctcagtgggcttccacttgccgacgcctttgaacccctctttaggcctcagagcgagctcctctcccgccttcagcctctcccaagttggctgggcactataaagggttggcacacacaaccaacaaccccaggtataactttatagggtgagataagggggaataatggtcatgatagtgtggtgcctctcaaagcacttccccaaaggtgcgcctgggactataccagtgtttgcatttgccccaccaaattacccccaagctataaaataataagagctgatttgttgcgcgagaggcgcctgattgatgtggaagaacatcagtgagtagtcgctcagtagaagaaccttcaacaataaatcgttatttgtaaaacgaattgccgtataaagcagcacaaacattattgccccggagactaggttatctcaaaaacccccaataggaccttaaaacgcacacttaattattcccaattgttg

SEQ ID NO: 119149 - DNA, 354 bp, Homo sapiens
gctgggtgactctagcaggatcctcatccacgtgcattgtggatccacgtgcatagtgtgaaatgcctatggacaactactctgtctaccacagagccttcccatgccaagtatcttgctcagcaccgaagctgtctaggaaaggaggtttggaacctttttcaggcccaaaggaaacaacgctggagaggaagttgtggggagctgactccctctgtgaacccccagccccatccatatatgcaaggagaaggacttgcaggaaacggtggctggctgagtttctctgtcaggctggttggaaggactgggagccttctccacaaggagtaaccgctgcacaagggcactggt

SEQ ID NO: 119150 - DNA, 484 bp, Homo sapiens
aaaaacaatagaaaaacaaccctgtaagctgatcatgcttgagaaactatataagctagtatattttaaaagattaattttatgctaatcttttaatttacattagtgaccaaaaatagaagatagataaagagtatttaacgttttgacttcatccagtgttccattcacctttatccttggcctggaaacactgactccggtatgagggaagaaaaatggagagtcacagagtctgtggtcatattctgagaggtagcatcttggggggtagatctgataaaaattcaagcatatcatcaaggaatatataaatcctcagtggcagagagtgagaggcattccagagagatcctgatgataccagataagaagagttagaatatagacaggaaggtccttagaatagttgctggttagacaggatgttaggggattttatataggcatttatggtctgggatttgacaaggaaggagtagat

SEQ ID NO: 119151 - DNA, 685 bp, Homo sapiens
ggatctctgacctctggggacctgtttgctacttttaagcattactcaccagttaataattgaaaagccaatcctacaaagtgctttccaggcctctggaaaaggtctgctccatccaggctccaccggtcttattggacccacatcgtgacctgcaagtagagttggtttttaaagggggggaccagtctccttctatctaactcatactgtgaagcaatgtttaatcctgtgagagatcagctgggtatcattctaaaggagaattattttagggttagaaagatttatgacttcagcttgtaaaagtggcaaatagcactgcaagagaagaaacaaatcacttgtgaaaagttgtatttgccatgttaggtaggattttaggtaggattaagtaatgaatatgttttgtggagctttctgaatctgagattgaacaaggtggagagatacaaatcatccctatttacctttttaaaaattgatctgtttattgatgtttttgttattattcaccaccgtatttggaataggactgttattaaaccaaagcctgaaaacaaaaccagtcagtatttgctgctgatattcctaagaagttcagcatctgagcacttacagtcttttcataaaatatgtgtcactttacttttcgagaatgttcaaaatgtatcatttgtagtgg

SEQ ID NO: 119152 - DNA, 361 bp, Homo sapiens
agtaaaaggtagtacaagaattaggaagtgatgagttttgaagatttactgtattacctttgttcgtttttacaaaattttatttttttaaatttatttatttagagacagagtctccctatgttgcccaggctggactcttactgggctcaagcaatcatcttgcctcgtcctcctgagtagctgggattataggtgtacaccaccatgcccagtttacctttttaaaaaaatataattaactgaattgtaagtttctttaatttgatttttaataatggttgtgtttaacaactggcttgcacaatttttgacagtttgaccaactgctcttgtgagctggtataagcccagtacgagc

SEQ ID NO: 119153 - DNA, 457 bp, Homo sapiens
aatatcatgccgggagcatgcatgtgggagcagatgtttggcatgtgtcaggctacttctgggaatagtctgtattgaagaaaggaaagtatgcttcagatctttacacataatttatgcaagtgaataaggatttctcacaaaggaagaatgccagacagactattatatttagcaagataaagtgtgctgtgtgcaaattcccaaagtcggccagtatagcagaggacaaagaaatattaataaattcctgttttataggagattagttctctaacgagcaaacaagcaagaaaataggggagtctcttagggttttctgaagattggttcacctcccttaggctaaccatttgttttcattgtctttatgagagaaagtcttttgtaaggatttaatgtgcaccacaggaaaatgtttacatattggaatcttaaggtttggagggactttcaa

SEQ ID NO: 119154 - DNA, 196 bp, Homo sapiens
acttccctacaaactgtgttcacctaggaggctggcataatgactttgctgagctgaaagatcctccaacatcacacttttaaatactttaaaatacagaagaaagtaaactaatagacatagttaatagattctatagcaccttcactagtgcagagcagagtagaaattaccagtttatctttcttcagctcag

SEQ ID NO: 119155 - DNA, 402 bp, Homo sapiens
gatggttgtgaggcgggtcgagttcagtctgtggccctataaagaataggcctgtgtgaagttcaaatccaaaatgaagttccaaaaaatactacgttctagctgcttaaacagtctgtattttccacattatgatggattcaaagcaaataagagtcacacttcaaagtcagaagttgcattcctcttaaaggatatttgtactcggctgctactataagacaaaggttaacttgacaggctcaatgtctctgttatatattgtggaaaaattacctaaaatagctatcatttattaaatttctattttctgttaggtgctttacaaatgccatgtaaagggccgggcgcagtggctcacgcctgtaatcccagcactttgggaggccgaggcaggtagat

SEQ ID NO: 119156 - DNA, 201 bp, Homo sapiens
tagtgtgaactctgctaagaagaaaaaaaaatcactataagaaagtatactacttaatagctaaaataaaaaccacacttactaagattttagttcccacgctataacctccaccttgcacatgattagaataaaagtacggtttgcaaatcagatcaaagacaagattccgtcttcatgctggctcagaattctgacttc

SEQ ID NO: 119157 - DNA, 405 bp, Homo sapiens
tcagaggaacagaaaatcaaaaaaggctccaggagacctaatagagaagagagaagtttaatggggaatctagatttgtataggtagagagatgagaggaagatgtttactaacaaggtttaaaaaaaaaaaaggtaagaatagaggcaaggcaaagtgtttctccaaaaatggttcgtaagatattaataggtattattaaatgttataaaaatgcttattagcatgttaaagtttctgagaaatcctgtgggaaataaacctatttaaggaaaggaagcagcatttttttcttttttagattatacatctgtattgattagtatttcattgggttacttgtgaggaactactttgggaaatgctgttatagcatgaatagaaatctgggcagtttggtgactg

SEQ ID NO: 119158 - DNA, 431 bp, Homo sapiens
ctcttgaactcctgacctcaggggatccgcctaccttggcctcccaaagtgctgggattacaggcatgagccaccacctggccagcatctcaatttttaataaataactaaaaaataacttgtttgaacaggtatatcttggccagcaatgctggactgggttcctttgaggtgagggaaactcttggacatgggacctagtgggggcctctgcttgcctccctgctgggttaacagtacagctggcccagccagtcttgaaaccttaccctgcaacaaaaacttgacacctccaggctggtaattctggaggtgtcttctctgccaagtcggtgactccccaacccgctattatggctggactctgctcttgcagtcttagtgtacaccctggttcttcaagggcagcaagcaggactattccggtagca

SEQ ID NO: 119159 - DNA, 391 bp, Homo sapiens
ctattgagtatgatgttagctgtgagtttgtcatatatggcctttctcatgttgaagtatttttttatatctaatgtgttgacaattattataatgagaggatatttaattttgtcagatgtttttttctgtgtctttagagatgatcatagtgttttgtccttcattctgttatgtgccatgttttgtttatagatttgcatatgctgaaccatccctggtatgaatctgactttatcatcatgagtgatccttttaatgtgctgtttaatttggtttcctagtattttgttgaggaattttgcatatgtgttcattatggatattgtcctctaattttttttttcttgtagtgtcctagtgtggctttggaatccgggtcatggttgtt

SEQ ID NO: 119160 - DNA, 604 bp, Homo sapiens
catttatattcatcagtgctgccctcactttggatctattgtattcttacagtttaatcaactggcaaagtgctttcatgctttggagattaactataaaagcaagattaagaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaacatttactgtgcccggcagcaaattaagtatttgacaaacattatttcattaaacgagactgtcaatcattactcaaagaatgatgaaggtatttggtgtatgccaaagaataaaggcgttttatttcacagtgacatctt

SEQ ID NO: 119161 - DNA, 809 bp, Homo sapiens
ggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaacaattagatgaccactgcaattatttctagcttaataattctaaaatttatgatctataaataatctattcctacccctgatgattttcccttttttggcatttagcaggcttgataattgcttctttatttaagctctctcttgtgagagattctgcttttaaggggacaaacttacctgtttgttacttattttatctccaacagttagcacagtgcctgacatgtagtagtctcttaaaaactacctgcagaactgtaa

SEQ ID NO: 119162 - DNA, 357 bp, Homo sapiens
gattgcatcatatagtatgaatgcacaggatgatgtcagcatcccaacatctctatcccaaatattcacttgatgtgtactttggacatcacttttcctgctgagaacagtgtgtccctgcattctgatatcatggatcggttataagcaacacagctcctttacatcccatcagagcagctgagaatctatctaacatggttcctctaatgaaagagctttggtgggttatgttcagaggcttccttgatgctaactggatactcttcaatggtgcacatgaaaatacatcctgcctcttgcagaacgacagaccaggctagggatgttttcccatttgttaggaggtggcagtgt

SEQ ID NO: 119163 - DNA, 196 bp, Homo sapiens
tttgagaccagcctgggcaacatggtgaaatcccatctctacaaaaaatacaaaaattaggccgggcacatgctgggattacaggcctgagccaccgtgcccggccaaatacccatattattaagagaaatgtttacaaaaggttaggacgaagccaccttggctgcgggagagaggaattgacagccatgattgt

SEQ ID NO: 119164 - DNA, 115 bp, Homo sapiens
ctgccgccctgggggttgggggcccctgatatagtctatctcctgttttcaggcatggagtatttgaaatattaaaagtaaatcatttttccatgattttaaatagagaaaagga

SEQ ID NO: 119165 - DNA, 181 bp, Homo sapiens
cccgaccagcccgacagccgactagcccgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgc

SEQ ID NO: 119166 - DNA, 330 bp, Homo sapiens
gcactccagcctggcgacagagcaagactctgtctcaaaaagaaaaaaaaagaaaaaactcagcaaatggctgacacatgatgggcattcagtagccgatggttattacggtcaaatccaaccacagcaacttactagctgcgtggccttgggcaagtgacttgatcttctgagactcagtttaccccctgtgaagtgaagggattggactagatgatctctgcgtttcctcccccatgtgatatttcaaagtactttttttcgaacagctggttgtggcctgtcaataggttttaaaatccgtttatagagaattgtgatcaacattta

SEQ ID NO: 119167 - DNA, 102 bp, Homo sapiens
tgatagattgttatgggaacttgaggtggaatttccaactctgtctggggtagggaagtaagagtaacaatagccaacattcaatgagctctcactgtagac

SEQ ID NO: 119168 - DNA, 114 bp, Homo sapiens
gcaaggcccgagctgagtagatgaggctgggagccagaccagtctcaggctgaccagtgctctgtcttgagaggagctgctggtcagctttttgtcttgggattcagaacgagg

SEQ ID NO: 119169 - DNA, 314 bp, Homo sapiens
accatctggcacacttttcattttattttttgttcatctgtctccactccctggaatgtaagctccacgaaagcagggacttgtgtctgatcaattcatattatatacctggcacataacagtcactctttgctgaaatgaatgaagaaatgtgtgaatgttatcttctagatgtaactgaattgtggctgggagaaatcttctagtttgagagattcactaccagagccatatttataacccattttgtattaaaactgagagacctataagaataattcccaaatgaacgcaaaatgccttcatgtaaaaca

SEQ ID NO: 119170 - DNA, 426 bp, Homo sapiens
atttccagaaacaggtggtaggcctgccggtgataattttccaactcttggcttagagaaatgttcccattacagggtgacgctcttgctctccccagaaccttgtccacattctgtatgtgtctaagtttaggatgcatctgacgaccccattgtaacaactgcctgactgacagaaaggtctgcccagaacaagcctcctgaaggtcttcagtggagggcgtgcctgggtgaggcacatgttcccctgaagaccaggatgtgatggattgcagacaagagggtccatggtgcatgtaagatgtctaataattgggtgatcagcttcacatgtattagaaaaaaatagaactagcttatcaatttaaagaaaatgatttaattatcacctgagctcaggagttcgagaccagcctggccaacatg

SEQ ID NO: 119171 - DNA, 589 bp, Homo sapiens
ttattccactaccaccctgtttggattactatagatgtgtaataagttttaaaatcaggcagtatgagacttccaactttgttcttcttattcaagattgtttgggctatttgcatctcttgatatttcatatacattttaggataggtttttctacttctgaaaaaatatcactgggattttggagggaatgtattgaatctgtaagtcactttaggtagtattgacaacctaacactattacgccttccaatctatgaacaagaaatgtctttctgtttactggtgtattctttcctttcttttgtgttttgtagttttcagcatacaaatctttggcctcctttgttatgtttatccctaagtatttcattatttttgatgctattgtaaatgcaatctttttcttaatttcctttttggaaattcattgttagaaatgcaactaatttgtgttgttgattttctgtcctgcaactttgcagaattttttagttgtgtgtgtgtgtatgtgtaatttttacagttttctgcatatagatcacatcagagagaactttacttcttcctttccgatctgggtgccttt

SEQ ID NO: 119172 - DNA, 199 bp, Homo sapiens
caaacaccatagtctggccttcaatgtgctcaaaaagcttacactagcttacattagcttacagttaggtgaaatcacctagcaacacagtacaccgtagagtactggttgtttacccctgtgattgggcaggtgactgggagctgtgggttcctgctgagtattgcaacagagtattgtaccacacattgctagcttg

SEQ ID NO: 119173 - DNA, 171 bp, Homo sapiens
ccagggaatgagcccttcagagttctgattgggtttggtggcttcccttatctcattcctgatcccagaacagcacatggatttctcagcgccttccagtttgaagaggctgttctctgttacgttgattctgtcagctttaggtgcttggtgttgcatttttcggacttg

SEQ ID NO: 119174 - DNA, 1174 bp, Homo sapiens
ggaggccgagcgcggtggctcatacctgtaatcccagcactttgggagacccaggcgggcagatcaccctaaggtcaggagtttgagagcagcgtggccaacatggcaaaatcctgtctctactaaaaatataaaaattagctgggtgtggtggcgcgtgcctgtaatcccagctactcggaaggctgaggcaggagaatcactttaacgcaggagacaaaggttgcagtgagccaagattgtgccattgtacttcagcctgggcaacagagcaagactccatctcaaaaaaaaaaaaaaaaaagattttggaaaagagttatttttgacaaaggcattgggaaataaagagtaaatgatggatgatgctagtagttaccatttaaagaatacctactaagtgccaaacactaagttgtaagtttataatcacattgtaagcatgttttcattgaaaccaatataacaatcctaagagatagataccattttcattattttactgctgaggaaactgaaccatggagaagttagctaacttatccaagttcacatacctggtacacagtagaagccagatttgaagccagatatgtctaattatatcaaaacttgacctacctctgaaggatacatagctagaaggattttttaaagacgttattatgcctttgtgttcatgctgattacaagagagaagagagtaaatgatggaattcaggacatgctaccccaaaatatggcacgttggcattggatacaacaacagaagcaggaaggtctctctgaccttctcctcacccttcttgcctgaagcaagctataaagaattttctgacctgcctctaaagtaagtcataaaaccttcattgcagaggtacccaccccatagctgaaggaaaagaatgtccttatctctgaagacagaggaacacaaagaacaacaggccttgttaattcctcccagtttattactgttattagattagacccaattgtcctcaaatcaatttctccatgactgtctcctcttcatcatacacagatttccttcttttctgaagtcttcattttctttctttctttctttctttctctttctttctttctttctttctttctttctttctttctttctttctttctttctctctctctctctctctctttcttt

SEQ ID NO: 119175 - DNA, 667 bp, Homo sapiens
ctgagctaagcagctcagaactgtcatgtgtagagtgactggtacaatacaacatcagtggtggtaaaagatttgtatggacaatgacatgtggcaaagaagaatgtcaacagctgccactgctatgacatcgtccctcaaggagtctttctgcatctctgccatgtaactgtctcagccaaagagaaggcactaacatgaacttcttccccagaatgctactcccaactagcgaccacgtaagactcgcttgagtcttttttgagggtgcaagtcctgggtgccatttgtcaccggaaagaacatttaagtttggagttttatgtatagagggagggattattctttgatttatttcgaaagaacatgttcttaatgtccttttgcagataatacacacaccctatcagtttttggactccagactgtctccatccatatgtcattatgaagcaggtttttatcttattatgatttaggtaattgtactagcctctaaaattttataatgtacctttcagaagctcatagatgccaagatcagaggctcctttggagttccatctaatatatcttccttagccaactggtacagataattttatctttcctctagatagttacacatatagctctagaaataaaatgtagttatcctaaatcagct

SEQ ID NO: 119176 - DNA, 134 bp, Homo sapiens
ggctacagaatgcaatcaaatggctatattttaatttcattcgcttccttacactaacatgatgggatgacaggtagctggaatcagtgagctggctcctttagtgcataaagagtcggctgcagctgcatctg

SEQ ID NO: 119177 - DNA, 489 bp, Homo sapiens
taaagaaatgaaaatgaaaacagtatcttgtgctctgtaacgattgttattaaatatatcatagaaatgagaagagtaggctcaggagctgaactgcctagttcaaaaggccaaatttactactttttgttccgtgaatttgttgtgctcctgtttccttagttgtaaaacagagataacaataggacgtgcccataagcttttcatgaggattaaatgagttaatgtgtttggtggggaccaggtggacatggtactggtagggccctatttgacattggctttaagtatcactggttttaagtgcatcagtagatatatgatgacaataattgtattatcatggtgatatggatttcttataaatacttgtattatgttagtcacttctagaaaagaatacatctatacagtagaatataattcaaaaaataatgtcatatttttgtaaagaaattttttgtaaaacttttcagtcttcaaagagtt

SEQ ID NO: 119178 - DNA, 431 bp, Homo sapiens
atatctgtagtaccattggtggaaaggagaaaaatgtagtaccgttggtggaaaggactattggtgagaaagtcctcaaaggctgatttaactccagtgacccacttctgttcttacatgagtgatcctgaatcagtttctgcaccctgttgttgatcagatagtactagataaactcaccttgggttcacacatagaaaaacaaatgtaacctttgctacatgtacaaaagtttaaaggttgtagtaaataccattaagatctacgtagcctgattgttaacctaacagaagcatgagaccatcagaagacttgggctctggcatagctgaagggtgttggccaatctaagaaatccacctagttccaaaagctgtttattgacattgtcatctcagagataagagatggttgcatacacaatctggatt

SEQ ID NO: 119179 - DNA, 105 bp, Homo sapiens
cacaaagtatatctaacgtaaatagtgaatggctctagttagaatgcagaccaaggaagaaatggccacaaaggtagtttgagggccaaatggtagaaggctgaa

SEQ ID NO: 119180 - DNA, 265 bp, Homo sapiens
  misc_feature (10)..(10): n is a, c, g, or t
ccccatctgnaggtcagactcagagactctgcctctagctgctgctgagcccccccacagaggggtgctgtgggcagtctctccggtccttccccccttttctcaccaactgtcctgtacttgctctcccttcttgcagtcactgtgtccccagttatatccactgccctgacctctctaaaggctttgtcacttcattaagcaatatgaccttcctcttctaaagttggttccctgcctctctgcctgatccgtcctcccctcc

SEQ ID NO: 119181 - DNA, 382 bp, Homo sapiens
ttatgcctccatcgtatctgtaaagtggggataaaaatagtaccactcctttcgagttcatgtaaggagtaaatgaatgagtaggtgaaagtgttagcatagtgactgccatattgtaatgtttattaagtgttagttactagccaggcaaggagaatcatctcttgacataggcaggctcaggacctttgtaaatacttgtggtctgaccattcagtcagatcaacccagaggccaagctgcatatgcgtcccatggactgactgcatccctaggaggtactcctctgctgggttgaaggcatctctcagttggtgaggactggctccatgacctccacctgaccctggtgtactctgattctcttgcccacctccctcta

SEQ ID NO: 119182 - DNA, 305 bp, Homo sapiens
acttgaaccagggagtcggaggttgcagtgagccgagatcgtgccactgcactccagcctggcgacagagctggactccgtctcaaaaagaagttttttctctttaaaaataaaaaagcggggaggggggcattaaaattagaaagattgtgttcaagtttcttttgtttttttttaagtattaacctaagaatattaaggccggtcgcggtggctcacgcctgtaatcccagcactttgggaggccgaggcgggtgaatcacctgaggtcaggagtttgagaacagcctcaccaacatggtgaa

SEQ ID NO: 119183 - DNA, 403 bp, Homo sapiens
ctatcctatgcagaggcattccatggctgattttattcacttcgatccctcttccctaaatccatcatatttgtcatttcgactcattttgatacctagtcatatatttccatatgtgcatgtttgtcttgttgtatcctgttttccactaaagtttgtttctttgataataacttagtagtagatggcagtgaaagaggaaggaatttactgggcagagaattttggagcaagacaaagaaatgtgttgtaactttcagatggtatttcagagaaaagcttgtagctctcctgagacctcactgtacgaacacactgaccagtcctttttgctagtttatttgctcacccttcttgaggaaagtcagctttattatttcttattctgcgtaagtgttacact

SEQ ID NO: 119184 - DNA, 329 bp, Homo sapiens
atttgacatacaaggggagtacaacgatctgggttttttttttttctttttttggtgctatagagttactggtctaatctttcaagcacgggaatctaaaagaaaacattaattcagtcatttattaaataagtatttgtagccttccatgtgccagacactgtctgggtgcagcagcaaaacagacaagaacctgtcttggtagagtttattttccagttagagaagacagattgtaaaaagatacaggatggtagatgactttatgcgctatagaaaaaaaaatgatgaagcaggaataggattgtcgttgttacacattctggagg

SEQ ID NO: 119185 - DNA, 451 bp, Homo sapiens
aagcccccactgcttcttttctgtgtatttatttctcctagccactttcttgttcttccatgttttgacatttaaaaatggcttattatctcagtgttatttgtatagcaccttcaagaaacaggtactatatcaatggaataaaaatactgcaataatgatacttcttttttatgtcatgtaatctcattagctctcctatgtcaataatcattgtgtccctcccataaccatctgtctaccatttaattggaaatgttatatgatcctgaaagaactgaaactgagtcatcactgtaccatctagcataatccccaatgcctggagacagatgcacacacagaaacttactcactcaggcacaataagcctttgaaggtgaaggatgttggtatctaaagacaattatgaataccaggtcccacccacacactctccagcccatgcttg

SEQ ID NO: 119186 - DNA, 552 bp, Homo sapiens
  misc_feature (78)..(78): n is a, c, g, or t
attcgatcctcacgctcccagacctgtccgggcctcactgccgactctgccttcccaggtgtatgacgtgctacgcgngccccgtgtcctgaaggagccagagaagcagcagttatatgacataccagccagccccaagaaggcaggactccatcacacctaggagggctcctgacttactgcgcctcaccacactagtctaaattaggtgaccacccctaccaccagtgctccaactgcaccttgtttatcttgatcatagcacttagatattgtaacataatctctgtttacctgtctataaactgtattagactataatatgggtgggctgaagtcttttatttctttttctttttgtggtttttgagatggagtctcgctctttgcccaggccagagtgcagtggtgctatcttggctcactgcaagctctgcctcccgggttcatgccgttctcctgcctcagcctcccaagcagctggaactacaggcgcccgccactgtgcctggctaattttttgtatttttagtagagacgaggtttcactgt

SEQ ID NO: 119187 - DNA, 513 bp, Homo sapiens
gtcgagtccgcgtggttcttgcagagacggggtctgaagtggagtggtggctgcgtgtggtgcctggccttggatctgcacctggaccgggatgggttgctcagtaggctggtgaacggtgagttgtggggagagctgagccgagacctgttgcggagactgctgtacctgcacctggacctgaacctgctgcggctgctgaacctggatctgctgttcttgctgggtttgtggctgaacactggtggtgactggacaggcaagttcaagcaaagacccagccacttcagtgctgtctgtgtatatgcagttcccaccctgttggtacaccatggtagtggtggttgtctgcaaggaacccacgctcatggggttctgggtagcaggggcattgtctaatattgtattaggctgttcctgtgttgctaaaagaagtgcctaagactaggtaatttaacaaggaaagaggcttaattggctcactgttctgcaggctgtacaagcatggcactg

SEQ ID NO: 119188 - DNA, 290 bp, Homo sapiens
atcacaaggacaatttcttctccaccacatctatcccaccccatctattcctcttcacagtcctatccagttggcccactcctacttgctctccaggggagaccacattcaacccttacctgtgtcacttcctccagggcagaaattaatgtctctctttctgcagacttatacctcctacaaccaggtccacatgttcacttctgcaggactgaattcagtaccctcctctccagatttactcctcttactctacttcctttttcagtttcatttagcctatgttcttt

SEQ ID NO: 119189 - DNA, 898 bp, Homo sapiens
gtcctcgattgccttagaatttggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattagttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtgg

SEQ ID NO: 119190 - DNA, 262 bp, Homo sapiens
ctaatcttgaaagaaatagttaagaagtgaccatttgttctctaaaaagattagctgcttcacaaaaggattagctatggtcttctgaaaggtattaagcttacccagtgtatataaagcacaattccaattaacataacttttcaggagtatgttaatactgtaataccaggtatacttgtagtcaaaaatgacacttgagctcagtatagacagggtaaccttttgtcctttgtgggctggtgaggtgccctttacctat

SEQ ID NO: 119191 - DNA, 429 bp, Homo sapiens
gcaccatcccatagggggcactgaaacaccactaatcaattagaaatacagcgccggttaactcaggtttctaccctcaaactccttactcattggtaaaatgtaaacaagagccattcccataaaagcacacaatataccctgagcaaagagatcaagtgccggtatccacggaaatgacctctatccgtggtgcgtatgactaatcatatccaattatgagtgctttttaaaaaatgaaagacaagtccaaataggttaaaatgtcatgttgcattcccagcatataacagacatcttattttgaaaataaagaaagaactatttgggtatacctattttattaatagaaaaccattctttcctttactcttccactagaaaatgtcaaatatttaaggagtcaaatgattagctcatcaggggcac

SEQ ID NO: 119192 - DNA, 650 bp, Homo sapiens
ctattatcaggacagagggagtgggctcctctacagttggggccatccacagaaaaacatgtgggtctgcagtcaggggatctgcagcaagatgtgggcttccctacttggaagcagcctagcaaagcccaagcggctctcccatctggggcttgggttttccatccagtatccttacagccatggtctctagttgggagggggcctcctctcagagacccgagagagacagctccttagggtaaaagcaatgctgggatgaggggatatgaagggatgacacgtttcccttcacagcctccatcccctcttcccacaaccctcagctttccctctgatccttgaactcatgtccccagctctgaagtgggtaggagtcactcccatcaatgaagaaatatcctagaaagggccaggtcaggtaatcacctggcctcggggaagtaaactgcccccatgagactaagggatcacttgctgtttttggcagaggagggcccttggctgggtacagtggctcacgcctgtaaccccagaactttgggaggccaaggcgggtggatcacttgcagtctggagttcgagaccagcctggccaacatggtgaaatcccatttctactaaaaatacaaattagctgggtgtgttgg

SEQ ID NO: 119193 - DNA, 201 bp, Homo sapiens
ttaggcccactgtgtttatactacccatctatcaggacacagcatatagagaaggcaatgaataggcaatctccaactacagaaaaaaagagatatgctaaaacaaaagatggaagaaatgttataacaccaacaacactcaagattaactttaagaaaataaagcaaattcattatcagcattacgtggttaaacatgct

SEQ ID NO: 119194 - DNA, 318 bp, Homo sapiens
ttttgtatttttagtagagatggggtttcaccctattagtcaggatggtctcaatctcctgacctcgtgatctgcccgcctcggcctcccaaagtgctgggattataggcgtgagccaccgcgcccagcaaaagagggcaattctaattcacatagagttcttaacctctgggggcttaacctctgtaatcccctgcaaaacctttcttaaggttctgtaacatgcattttaatagagtaagttttgatgattagatgactttccttttatttttcttcttgaaatttttttttaacacagtttctagcggagtgggc

SEQ ID NO: 119195 - DNA, 388 bp, Homo sapiens
catcacctgtgcaggccaccaagctcatgatcctagactctgcccgacagcccagcctctatgaagtcttctggggcaactcctcactccttaacacccaatgcttatcttttgttagtaaagagtaacttgactcggatttgtaccccttgcccattgtaaggaataacaataaatagttaatgaatgaataaattggtgatttgggaggtggtacaaggaaaggaatatgagggaagtactatttatttagcacatttgaacaaccctgctgagtaggcatgatctctctcacttcacaattgaggaaactgagggtcagagaggattaataacttatccaaagtcacatagccaggaaggggcagagcaaggtttagaatccagg

SEQ ID NO: 119196 - DNA, 303 bp, Homo sapiens
tctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtgg

SEQ ID NO: 119197 - DNA, 462 bp, Homo sapiens
ccgtcggctcccaaagtgctgggatttacaggcgtacatttataaggcccgcatgatctagcatcagcttgcctgtccagccgtctatgaaccatcctgaccattttcttgttttcagctgtgccatgctccctttaacctttttgcctttgcctgctctgttcctgcgctgttcctaccccctttcatccacactggttaactcttactcattctttaggtcccagctttagatatcccttcctcaggacacctatcctgattttccattaatggggtacgtttgatgcctcctctataatcctgttttccctgctctagcactagcacactgtttgtaattgtcttcttactctctggattgtgaacactaagaagggagacacttagttgtgtggtcttatttatcatcgtatctttagtacttatttaggcctacacctggcagaataggtgtttgat

SEQ ID NO: 119198 - DNA, 831 bp, Homo sapiens
cagactcttctatgggaggacctttctccagaattatgttagggcaactccctggtaaacctttcaaagcaattcaacaaacatttattgagtgcccagtatgtgccagtgttaggtactattcttggcaatgggatgtaaagatgagtaacacatagtccttaacaccctgaggggacccagtctagtatgagaaacacagactataaaatacaataggaaaacgccacagcagagataagacaccatgggaacacaggtgaaggaacaggtaattatgcagggggtgagggaaaaaggtgaggttggagaatccacagaaatgcaattccagccccctcctaacacacatgctcacactccctctaaaacaatacagaagccccccttatctgcagtttcactttccatggtttcagttacccacagtcatccaaggtctaaaaatattaaatggaaaattccacaaataagcaattcataagttttaaattgcacacaattctaagtagtgtgatgaaatttctcgctgtcctctccgtcccacctgggacgtgaatcatccctttgtccagtatatctacactacagatactactcacctgtaagtcactcagtagctgtttcagttatgagattgaaaatacatactatatagtgtatagggtgcagtactatctgtgacttcaggactcactgggggtcttagaatgtatctgtctcatatggggggactacttactgtatttgaaaaacagaaacatgatcaagttattccactgcaaataggccttcatggatttccaacaggtcaaagattatttccatgca

SEQ ID NO: 119199 - DNA, 334 bp, Homo sapiens
atgtggacgggtgtcatgcgtcctggacccaaatgtcctctccgtcccacctgggacgtgaatcatccctttgtccagtatatctacactacagatactactcacctgtaagtcactcagtagctgtttcagttatgagattgaaaatacatactatatagtgtatagggtgcagtactatctgtgacttcaggactcactgggggtcttagaatgtatctgtctcatatggggggactacttactgtatttgaaaaacagaaacatgatcaagttattccactgcaaataggccttcatggatttccaacaggtcaaagattatttccatgca

SEQ ID NO: 119200 - DNA, 222 bp, Homo sapiens
actgtaaagagaagaaaatgattcaaggctcctaagacttcaaattaagtaaatattccatatttgctttctaggtattacaacatcagtgttttttttttaagttcaattacttcattctatgctcacatttctagctatcattttaaatgacttttacaacatatggttataaaattgactactttttcagtacatcaaaagttagaaagtttctaatag

SEQ ID NO: 119201 - DNA, 285 bp, Homo sapiens
attttcctggatctgatgtgagagacgacttagccgggtgttgtggcacacgcctgtagttccagatacttgagaggctgaggcaggagaactgctttaacccgggaggcgtaggttgcagtgagcagagattgcatcactgcactccagcctgggggacagagcaagaccttgtctcaaaaacaacaacaacaaattttctggcttgtattatgtgctacttcagaaaatcctttgataagccataaaaatactttgtgtacagcaattctttacaaaggggta

SEQ ID NO: 119202 - DNA, 338 bp, Homo sapiens
aggcaaatgcaaagtttttatttacagacaaacagtatttgaaaagtgccttatcaaccttgacaagtgtgataagcatttttagtaagttagggctgctctgctgaacatactactactgctacagctattcctacttctcaggagttctcaatgcaggcagaacagaagctctctaggtcactaactctcatactgtctcaatatgctaatgttccctagaagatgctaaaaatgtaatgagtctgcaaagtacgcaggtaaataccttggcttcctgtccctggccaactcttctatttatctcctaagcattgatgaggctttaaagtagctga

SEQ ID NO: 119203 - DNA, 254 bp, Homo sapiens
caagtgatccttccgcctcagcctctcaaactgctggtattacaggtgtaagccacagtgctgggccctccaataaaacagtaatggatttcggaaagctatcctctcaagtcagccagaattgcaaggaaactgaaatctgactttgaaaaatgacctaacaaacctgaatttatatactcataaagagcttagggcattgcaggctttttaaagagaatgtccaaatacaagaacattgacatttattgaag

SEQ ID NO: 119204 - DNA, 505 bp, Homo sapiens
tacactctctgcaattcatacacaagggttcttgacatggtgacaggacaggacagatcaagacagaggctctccaaggcagtgaaaagacccttcctatctcctctggcttaacctgggtttatgctcctttcctggccctgttggtataatcggcaacatctgtgttgttagagggtggagagcgcatggatcatcttagctcaaaggtaggttctaacagcatagaagatggagtagagaaaaataaatagtgtttttttttctctctgctacttactagagccatgctatctaatatggcagacactaaccacatgtgacttttgagcacttgaatgtggttagttcaaattaagacggactgtaaaacatacaccccctgcccccagacatcatatttcattaaggcaacataaaaatgccaattatctcatttataacttttataattattgcattttgaagtaatattttttaaaacattagcttaaataaaatgtat

SEQ ID NO: 119205 - DNA, 193 bp, Homo sapiens
ctcttattgcggttgatatggagagattaatctctcaccaaaaggcaaaatctggagaagatgaaatagcaaaactaaggaccaatgggaagggggaggcaaagtcaatcgacaaccgtacctaacaggagagattccaaggcttccatcagataaacaaaggaagctgatttttctacggaggctgcatgtg

SEQ ID NO: 119206 - DNA, 454 bp, Homo sapiens
atttgacttgctaatactgtgttaagaaatttgttttttgtgtgtgtttttgttttttttgtgtgtggttttttttgggtaatgtctttgtctggttttggtatcagggtaatgctggcctcatagaatgagttgggaagtgttcttgtctcctgtattttccaagagtttgtataggattattttatctggttcagtgaattttatcagtgaagctcatgtagatgtagttttctttgtgggaaattttaaataatgaattcagttatttaatacatgtagtgctattaacattttctgtttcttgtgtcagggttagtaatctgtgtctttcaaagaatttttccatttcatctgagttaagtttattggcaaagttttttgtaacattcccttgtatccttttatccttgtgtctgtagggtctgtactgatgtcgttgttacacattcat

SEQ ID NO: 119207 - DNA, 461 bp, Homo sapiens
tgaagatgttgagagcaggccaggcccaaagtaggctggtggtcctgggcactcgggctgcttggagcctcactgaaatcattaggggttctttcatggtcacccacaaaagactctccctcttcatatgctgagggtttagcgccaactttgggctcagcatccccacctctattaccttcccggggaaggctccgagatcttgtgcggctgctcactgcaggagtaaacatggtgtcacctttgtctgctagggcagaaatgttgccagcagaatgagaaagggaagctgcaatgctttgacccctttgagctctgattctccttctggatggggcagcaatcagaatatcctcggtttggcactcagagtccctggttccggatatcctattgacagtgttggaggggtctgggtttgtgtgcacaatcacattcctttccctggccactggtgattc

SEQ ID NO: 119208 - DNA, 459 bp, Homo sapiens
ttagaaaacatagtcccacagaattttgcacttaatttgtgatttcccagccttcccctaattgagtcaagctcatcttatggacttctacattaattcagttttaaggaagagcaggctgacctgtgaaatgctaaacacttctgtcttaaatcagttttaaatactttcaacaaagacttctttgtggctgttctttgtattgggggtatacatgcagtggtgaaggatcaagacatcttctctgacttgtgccaatgtcgaaaagaaaaagaactggccaggcgtggtggcctgcacctgtagtcccagctacttgagaggcagaggcaggaggatcacttgagcctgggaagttgaggctgcaatgagacatagtaaacatagtagtgtcattgcactccagcctgggtgacagagcaagtctccgttcccccccccccccgccccacccacaaa

SEQ ID NO: 119209 - DNA, 876 bp, Homo sapiens
tgccaggctcatggaaggcccttcctatacagggagtgtctgtctggagtagctccctgcaggactgggcagccaggtaaattctcctcttcctgaagaatgaaggtatgtgctggtcgtggtggctcatgcctgtaatcccagcactttgggaggccgaggtgggcggatcacctggagttgggagttccagaccaccccgacaaacatggagaaaccccgtctctactaaaaatacaaaattagttgggtgtggtgcctgtaatcccagctgcttaggaggctgagatgggagaatcgcttgaacccaggaggctgaggttgcggtgagccggagatcgcgccattgcactccaacctgggcaacaagagtgaaactcagtctcaaaaaaaacaaaaacaaaaacaaaagaagaagaaggaaggtatggtagaggaaatctggtcgaatgtgatttgaggacaatataggagaaagtaaaatcaaggtggactcctcatgaaaatagcttcattttttttcctcataaatataatgtatgcagattataaaaacttcaaataatacataaaagtacaaagaagaagccaggcggggtggctcatgcctgtaatcccagcactttggggggctgaggcgggaggatcacgaggtcaggagatcgagaccatcctggccgacatggtgaaaccctctctactaaaaatacaaaaattagccgggagtggtgctatgcacctgcagtcccagcttctcaggaggctgaggcaggagaatcacttgaatctgggagtcggatgttgcagtgagccaacatcacaccattgcactccagcctgggcgacagagcaagactccgtctcaaaaaagaaaaa

SEQ ID NO: 119210 - DNA, 325 bp, Homo sapiens
gacatgatacgaaccgagctgggtacccctagttttagaaagtttcaagtagcaactacattagcaaatgctgcctttacatgaagtgaaaattactaaaacaacaatttcagaacaaaggtaattaatattaagagacagcgaccacaaactaccaaagactcttaagagatttggtaacgctattttgaaacttcagccaataccttaatactgtttagtaagtcatgcatttggaaggcatatttcaagttagtagagattaacacaataaaatgaactttctatgcaatacttaaactagaaaatttcagagtaattcatg

SEQ ID NO: 119211 - DNA, 479 bp, Homo sapiens
cacaggttttctaattccctttatctaaaggagacattttccagaattcagactttatgcaaggtcacagtttcaaatgtatgatatatctcttatcctcaggtgagcattaaaactccagttttgagttattacggtttatttagttcatatatattagcactagcttataagttgattgatctgccttcaggtgtctgctacatttctttcacccagagatttccaattcttgtgtttgcgctcagctatgtatttaaaatatttatttccacattttgtgcctaatttttatacattggtagtaagacggtcagtcatttatagaagtccatatagtccatattcctgtgttcagtcaacaataaccatttactgagcatctacttcacaaaggtactgaaggtacaatgatgaataaaacagaacaatttcctgtcttaacaaagtttacattcaagtgagagtagacagacaat

SEQ ID NO: 119212 - DNA, 196 bp, Homo sapiens
cattgtgctaccagggacgttgtagcagggcaggtggatgcatcccaagagtggatgttggtgaaatgaagaaaatggctatgacagctgtagtgaccaagaccaggggaacacttgctttggagacaaaagctgagaacaaacagaagcaagagagtggaagaaaactgaacacaggtgccgatgatagcgaggt

SEQ ID NO: 119213 - DNA, 451 bp, Homo sapiens
agatatctttgcataaatcactattaaaacatggtgggggccgggcacggtggctcacgcctcggcttcccaaagtgttgggattacaggtgtgagactccaggcctgaccaaacattgtggctagagtagtatttacatcttctgcatttagcagtgggaatttgtgactgtccaggaaacaaaacttcaatagaaactggtacccctctccaaaacagcattttgcctactcatcattttgtaaaggctaaataggcaactgtgtaacctgcggttaatagagtattaagttaaattcttttgagctaatgaagtcatgttcttcatgtttgttgttatcaatggctataacccagctgattctacatctatatacccattgtttgttgtttaaaaaagaaagagttgtttcatctgattttttttgagcccagacttgggcatttatt

SEQ ID NO: 119214 - DNA, 425 bp, Homo sapiens
gaatcaggaaagccctgaaggcaggcagctccggagtcgggtttagacgaggaggctgcagttctccaggaagggaagcaggaccagataacggatgagattgtgtcaaacaatgaggaggcctgcatagtcacacaggcgcatgaggtctgctcgtaaaggaccaggagggccaggctcaggggtgtggactggattctctgggccgtagggagccactggacagctgtgctcaggagggtcatgtgatcacaaatgcttattagaaatgtcactggctatggaggaccatgtctgtggttgtaagttacgcctttccgtttagtctggacttcctggtcaaggtacttttggtattagagtggggaagagaggcccagagagttggacaggttttctgaccattggcttatagtcagtgagca

SEQ ID NO: 119215 - DNA, 313 bp, Homo sapiens
ctgtctctagaggatccactctccctactgtatcctacaataagggaaaaagtcaatctatatggagcaaaattgaagacagcaatagaaactatccaaaatgcactagaaagatgaataagatcaaataaaatgaacaaaactattcatcaatgacctaaagaacaacttcaactagcctaagagatatgtaactggaattcccaaagtggaagaggggacataaaaatatttgaagaaataatggctgaaaattttctaaatctgaagcaaactataaatctacagatctaaaaaattcaaagaacccaat

SEQ ID NO: 119216 - DNA, 222 bp, Homo sapiens
aattgggatacacaaataagccagttgagagagatgacttttaagaatatttctagctctcaactgaggatcctaagaagacagaggcataaacaaacatacttgttcaatcagagaatgaatgatcaagagcattagctttggagttgacagatctacttacagaccccagctttgccccttgatagctgtaaactataatccacattccttctctgagtt

SEQ ID NO: 119217 - DNA, 652 bp, Homo sapiens
attccttaaaaactttttgccagcaatttgttttgtgtacttaacaaatgcttattcaaggtacatgttatgaaaatgagttgcctctggttctgtatggaatgggttggaagagcaacattcgtatcttatcctggagatgagggggatgtcagcaggtccttcccaggtgagggagcaagagaacaaggttaagagaggtgcaggaaacctgaacacacagttgagttacgaccgagagccctcactctagaggaactcaagtcttgagccagtagcactcccattccttctcctctgggcccctaggatggctcatagccttgggccatcttccagccagcccgtaggctttcctcagcgttgacttcctccaccagttgaacagttgctgtatcactgagaacctttgtcctgttggttttcttcatgactccatattagctgaagcttttgcacacaagacaagcacatttattgagcatcattttcctaatattaactgaattatgcacaaacaggcaatcagaagtttgattcacacaaatgtgatgctagcacaaagagggctagctggaacacagggccctagcacttgggccctgccccacagggatgatttcagggactgagaccaaaagaactgttcaaa

SEQ ID NO: 119218 - DNA, 405 bp, Homo sapiens
cttgcttccaccatgccacttttttgctcttctcacaagagcatctgtcccttatagcatcatgtctgaattcctctttctcacttctaactccccaaaacatgcctctgctatttaaaatattccactcctgcaaacatttttttttttttactagaacctgatctgtccagtaaatagacttggaatccaggtcctagacccttcccactgccatgactttgttcacttttgcacaaattttgaatgtgcttcatgtctaggaaccctatctatccttcaaggttatgtggaattactacctcttctctgaaaccttcaaccttctctgactcatccagcccttcctgaatgttcttttccatatacacagttgagcctcaaaggtttggtttgtgcacttca

SEQ ID NO: 119219 - DNA, 218 bp, Homo sapiens
ttatagttattaaatttgtgcaaaaacttgcattatttgtaaaattcaaaatcactgaaaaacaggctatcaaaaatataccagtctaaactaagaaccatgctctttttgcacattcctttatagtctgttttatttttatgttttttacatagatgtgatcatactgtacaacttaacattaggttgtaagcattttttatgtggctatgtagact

SEQ ID NO: 119220 - DNA, 614 bp, Homo sapiens
actctgaattagtacctttgtttcctagattttggtttatatttctcaatccaataccaaaaccaaagcatgaaataagaggagtgactgcagtagtgcattttcagtaagttagaatccagatagtgttatatatgattaacagtgaatacacatgggtttttacagatattttaaacataaactttgcagattcttttagtaatttaacaagactcctatcttttgtcctattcacttttataaccattataaatataaactacttcactaattcctaaccattttattccaaagagcaacaaggccaaacttctgaccactggtgaaaggaatggtatgctttttttggttactatgaattaggcatattttctaaactgattttgaattctgtagaaataacttctctctccaccttcctgttcacaaatctacatataccctcttaaagtgtcaaggtattgagttctaaactgtggccaagaataatgaaagtagctctagagaggcttgtgacttttcaaatagaatggaaatttgtacacatggtgtacgtgtgaaaggcaacttcatttatggattttattgaaactaatacattgatgtatgta

SEQ ID NO: 119221 - DNA, 785 bp, Homo sapiens
ttaagagcaaggactgggtcttatttttcattttgttccctagtgtcttcgatccttattgcattcagtggtttgatttgaacagaactttggaagcatgagacagactctgtacattaaaatgcttccatagcactcaccatggtgtccaaagtgtcactaaatctctgcttgcttgagatttctctatcttaattaatcttgatttgtgctgtttttttgtgaaagagtaaatgcctgtgggagggctgggccccacctacggagaactctggtagtgtgccaagagcaggactgcataattggtgcatgtgacaaggaacagaggagggtggaggggtccctggatgatgggggtgccttccccttggctgtctttattgtgtccccattggcattactgttactgatcactaaatcagggaacagacggaggcgtgaggtaggatcctacgacagacagcctttagtgagttaccaatgacgccagagttgaccatcaagtaaatctgttgccttttgaaagacatgtctgtctgtacaatgctagggcctgagttgcttaaccttctagtaaaccatgaatttctctcacatgtccttggggtgatgaaaatcttcccgagttgtgcggagcacaaagtagaacctgacagggaatgttctgaaataattgtgtggatggtgacaggtaaaaaaatacactgtagagatatcgatcctgtacgaatgcaacctaagttgttgctctgttaagaaatgtttttggagttctctatacacta

SEQ ID NO: 119222 - DNA, 620 bp, Homo sapiens
gtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctccttttgtgaaagtgacaggtacttctggtctgagtccataaatcagctatatctaaatggaaaactatatcccactgggatggtaatcacccttttgatagaaaggttagaagccagattcttcaacagaaatggaacttatcaatttaattaagattcctcaacagtagatttttaggtcagtggaacccctgtgtaaagcgatgtgctactgccatgcctagaatcctatatcactgatagctgaaaaagaggcagagcacttacattttcattagtactgtatccccttgaatgtaagccttctgaaggggaattctacttaggatggaaattttgttcgtgagaaaggggaacaataaaaaaaggatgtggagtagttacatttagctgtttgccc

SEQ ID NO: 119223 - DNA, 401 bp, Homo sapiens
ttttaatactcaggctaacattcttcgttattgctgttaagataaaagattgttctggtatatatggcattcattgaaaatgcactttagacttagaatgtagggaacattctcatactaaatcatatttagacaaatacaccgattataattctctatatggtgacacattctcaaaaatcagaatttcaaaatagtgtaaattatgcttgtgaaataaatttgcctgtgcttttacttcattgtgtagttatttgtccagttgtacatgtttgtgtcagaaaagctactctctgtagaggtactttacatgcctaagacaaagtgacggaatgaattattctgtgctttgtgggagacagcagctctgggctcgagcctaaccctgcagacttctagtt

SEQ ID NO: 119224 - DNA, 419 bp, Homo sapiens
  misc_feature (405)..(405): n is a, c, g, or t
atccttccctttctcacgatccttcctctctcacgatccttccctctctctcgaaagtgtcttggacaaaagtctttctaacacccagcaccctggcaggccctgccccagccatgtgatgtggcaacggtgaccaggacaagcttctttctcacagggtttagaggtcatgactcttttggaggatttccctctctgagtaactttgctttttgctgatcctatgtattcatcaaatacaactgattacatttcattttggaacagttgttattaatgaataacagttgttattatagtttatgtggaggctccaggttcctcacacatggtctcttgacttaagctccttcctttctgctctgaaaatagcacagttccccgtgagagagggaaggatgggtnccgagctaagattc

SEQ ID NO: 119225 - DNA, 308 bp, Homo sapiens
cacttatttggagtgactaactcagtatgtaagtagatgagatttgttgattttgcccctaaaacgggctttagtcattttaggagtgagttgcacaaaaggacctaaaatgcattgttttttgccatctctactaaaaatacaaaaattagccaggcatggtggcgcatgcctgtaatcccagctactcgagaggctgaggcaggagaatcgcttgaacccgggagcgcggaggttgcagttagccgagatcgtgccattgcactccagcctgggcaacaagagtaaaactctgtctcaaaaaaaaa

SEQ ID NO: 119226 - DNA, 1514 bp, Homo sapiens
cacttatttggagtgactaactcagtatgtaagtagatgagatttgttgattttgcccctaaaacgggctttagtcattttaggagtgagttgcacaaaaggacctaaaatgcattgttttttgccttcttttaagagatggggtctcgctcttattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagatactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggagcgcggaggttgcagttagccgagatcgtgccattgcactccagcctgggcaacaagagtaaaactctgtctcaaaaaaaaa

SEQ ID NO: 119227 - DNA, 772 bp, Homo sapiens
cactggagcaagctggacttcactctgactgcaaaggttaccttgacttccagcctgcccctctactgcttttttctttcttctacactagcgccttcttttgccaaagatattggtgtattttgtgcctaggtccttccattaggagaaaagcaaccagtaagccatctacactttggtgtgaatccattcccatgactcccaagttctgtttgcttctaagaaaataatactgtgctggatgttacttaatatgcaaggaattctaagttaaaggaacatgataaattagtttttaactggagaatcccaaagtcccccatagtgggaacaaaattggatgtcaaaaagcccttctccagtcatcccagagacgtgccaagtaagaatgcctccacttcagctgattggagtccactcctcacgtaagagtgcccgacccgacgcagagcaggcaccccaggagtgctttgtgtgcgagtgctggccagggtcccacacagaccaaagcctcctggcctgaaggctgggaaggtgcatgtgggcatcacagaggccacctgagtgtggcaggtggacagggcatgggacctatggtcctgacacggggcccacccggtgggtgcaacatggctgctccaaaggagtctctctccacgtggctccagcactgtcccctgggattcacacctgcagcatgggagccaatccctggaaccctccacagcaacactcagcatcaccgggcttccccatcctgccacagccaagg

SEQ ID NO: 119228 - DNA, 451 bp, Homo sapiens
ctggtggcctgtcctgaatttggctaaatcgagttgccagttgaagccaagcctcccccgggccaggctgcagggaaacaaaaagagagggagcctcagggcagactcctgagctgtgtcctggctctgaagtcaccggctgtatgaggctgtgggcacagcacctgggacacagcacggaggacagtgactgatgcagagctggagaaatagggagattcacccctagggctctgcatggcaggaaaggggcagtgccaaaaagtgtgtaattatagagagggtaagactactggacactttatatatatctaatataagacttaccattaactatttctaagtgtgcaatttagtgttgtgtaaccatcacactatccatttccagaactttttcctcttaccatattaaacctctgtagccaataaacagtaactctcactccttctc

SEQ ID NO: 119229 - DNA, 491 bp, Homo sapiens
gaggggcccttctcctcctgcaagcagccacaccatttcacagaagagaaaaaactgggtccaaaaaggggagacagcttgcccaaggcctctcagaaatgtctcagtttccaggtgtggaaggcagaataatggctgcacaaagacacccacatccaaacccccagagcctgtgaatatgtcagcttatggcaaagggaaatgagggtgcagatggagtgaaggtgtctcaccgctgactttaagacaggggagatcaccctggatgatctgggtgggccaatggaatacaaggacctttaaaagtggaaaagggaggcagaagattcagtgtctgtgaatcaaggaaataggcagcctctagaagatggaaaaggcccagagacagattcttctcccccgcagcctccagaaggaatgtggctctgcctcgatttcagcccggtagagctgtgtcagacttctgactacagaactgtcagctgatcaat

SEQ ID NO: 119230 - DNA, 256 bp, Homo sapiens
gaggggtcaaagactctcccatatgttagaagggtcctgcacagaacaggctcacccccgcccacgtcccccagtgtttgaaatgcatagtgtttgctctggtttattggttagggcaggactttctcatttgttttagatctaacagcagtttagaaattggcctgtaacttttttttggcctgatttccttctgtttgtgccgatattctcacctcagtaggaatcaggagcttcttttgctgttcttctgttt

SEQ ID NO: 119231 - DNA, 479 bp, Homo sapiens
ggaaagcagcagagatgcattgtggtgttcttacatcttacattgtggtattcttacatctgttgacaattcaaccagtgttttaatcactgtagaagcttcttcctttctaatttgtttctgcagggaaatcatatgtcttctgtttctaaagtatggctgattactagattatggttgtcctttaatatattcttcccagttgttctattcctagagtttgtctctttaaaaatagtgtttccctgggctgggtgcagtggctcacgcctgtaatcccagcactttgggaggccaaggtggcagatcatgaggtcaagagatcgagaccatcctggccaatatggtgaaaccctgtctctactaaaaatacaaaataattagctgggtgtagtggtgcacctgtagtcccggctactcaggaggctgaggcaggacaattgcttaaacttgggaggcggaggttgcagtgagccgag

SEQ ID NO: 119232 - DNA, 390 bp, Homo sapiens
tgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgcta

SEQ ID NO: 119233 - DNA, 390 bp, Homo sapiens
tcattaagagatggctgagggaaagtgaaggagtttgttctgttttaacttaacaagcatttgaggtagggtacatgaagcagaggtacctgtggaagatgttaatgacatgagcctgaatataggacaccacatcatcagcatttccatcaaaaacaagaagagctgctatggaaaaggtaccaccctaggcgatagggatagtgtggtataatacactatccatgattttcagggagaacagaattcatacacaagaatatcaatgaatctgtaatacttaacttgccaagtaagtgtcaaatttgggcatctattctccataggagattgattagaaagtccttcagacaaaattggacttcagatgagcctttaaggaaagtggaa

SEQ ID NO: 119234 - DNA, 754 bp, Homo sapiens
gcaggtggatcaactaggatgaggagtgcgagaccaggcgtgtcgctagacaatgggacatcaccctagtctcttcatagagaatcactagagatacattgagctggggcattgtggtcatgcacctgttagtccacggcctgagctgtgcagacacggcatgcagtgcatggaagcaatatgcctatgatgtgctgggcatggccgagacggttagctaggtgacgtcctgcaagatggtgctattgcactccagcctggaccacagagtgagactctgtgtccaaaaaacaaagagaaatggaagttaaatattagcaaaccatctatcaaggtaaaaggttaatatccaaaatatggtaactcgtataactcaatagcaaaataacaaatttaacctaattttaaaacaagcaaaagactaatagacatttctccaaagaagacatacaaatggcctccaggcatatggcaagatgctgagtttcattaatcatggaaatgcagatcaaaaccacagtgagatatcaactcacatcttagcatgtctattatcaaaaataaatttaaggtcaggcatggtggctcacgcctgtaattccaacactttgggaggctgagatgggcagattggttgagtccaggagttcaagaccagcctggccaacatgctgaaaccctgtctctactaaaaaatacaaaaaaagttagccaggcatggtggcgcacacctgtagtcccagctgctcaggag

SEQ ID NO: 119235 - DNA, 170 bp, Homo sapiens
cccagatccatgaaatcagagtatgtggaaatgatgcctaggcatcattattatttaatgtgcacctgaggttatgaaccactgatgtaggctcacctctccacctgggaaacacatacacacacgtatgcatgtacccacatgcctgtggatgtgtacacgtgcacaca

SEQ ID NO: 119236 - DNA, 358 bp, Homo sapiens
gtcgcaccattgttatttgcagagtggtctctgcctgctcagcatcccacgttggcctggcaccaagcagggactctggccacttgatgcactaggcctgtgtgcctgtgctacgtggagcctactaacaacttcattcaacgccccaccaacctctgcgtaagaaaacgcgagtcctacacccaaagtcctcagcctgagtcagggcaaaaacctctggggacacagcagagcccaggtgtcctgatgacctgggggtctgaacacattcagggtcccacagtgccacgaaggactcccagatcccctagtacagctatagccctaaccctagcctgccacagggaggggaggcagg

SEQ ID NO: 119237 - DNA, 356 bp, Homo sapiens
aggagccagaggtggcccgcatgtgctttgcagaggaacttgcacccacgcttttatcggtgatggctggaatgcttttcttaactggagctttgttgaagagcctggtgcttttgtggcagtgctaacctggggagcccatggtaaaacccaagcaacaaaaccaccacccaatcacctgtgctgttgcagagaatggtcctttgccctttcttcttgccttgttcctttccctgttttctctgccctttttcggggctggtcttcctaccacctttcctgctagggctcccaaagtgtggcccttctggggtttacatggtgtgcccagggaatagcttggcttttttattcag

SEQ ID NO: 119238 - DNA, 497 bp, Homo sapiens
actgctcttaggagattatatatccctacacagatgaacattcgagtaatgacagaaatgtaaataccagcctattgttttataacaattttgaatgactacaaaaatgagtttattttacgggtatttgctgatgttttaataattatttcagtggtttgttaatatgtatcagttatatttcatacatttcctaggtttcattgtccatcttcttatataaggtacttataaatatatataaattatgaaattagactacagcatttaataggttgatataaaatgatacaagggcctgaaaatgtgcttttaacgtactttttaggaaaaggcatcttattctaaattttgaaggcctctatttggctctccccccagcctctgataccattgcctccgttttatatagatatgggaccagaattttagcctgctgctgcttatatctaaaaataatatttgtaaaattatccaaagcagtagatatattttta

SEQ ID NO: 119239 - DNA, 397 bp, Homo sapiens
tggccatgctggtcttgaactcctgacctcatgatccaccctcctcggcctcccagtgctgggattacaggtgtgagccactgtgcccagcttctctcacccttttcatcctcaagcagctatgaaaacctgtcctttcaggacgtacctaaaatcccatagcttctctccacttccgccaccaacacttgagccaagggcccatcacctttcacctcctgcagcagcctcctgacctgtctccctgctgccactctcaatcccctgtgtggtctgttcctatagggcagctgggtgtgtctttccaacataggaatatgtctccctgcaccatgtctttagcatcaagttcacccaacccatgcccctgccaaccccagtattggggcattcctca

SEQ ID NO: 119240 - DNA, 272 bp, Homo sapiens
attgataaagaaacaaattatatggattggaaattctgttaaagacaagttgaaagcagacaatggtaaaacataaaaaatataggaaataagatgtttagtggatgaaagtgaattggtaacttcagaagtaaatcagttctggatggcaaggaaccaaatgtgggctataagactgagtgttaaaatggagaaaaggcaatcactagagatgagatcaataaaattcaaggccaaggctatagatgaattaatcacataagtaacctagg

SEQ ID NO: 119241 - DNA, 638 bp, Homo sapiens
acatagctagagccgaaaggtctggaatcatggtggccttgggggaaccgatgcggtcttcgctcttcgtggccgtcagtgtctaactgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgta

SEQ ID NO: 119242 - DNA, 316 bp, Homo sapiens
tcatctcaattgccacagaaaaagcatttgacaagattgaacatcctttcatgataaaagcactctaccaactagaagtggtaggaaatgaccaatgtaataaaggccatttataaaaagtccatggctaatatcactcaacaatgaaagactgatagctaagatcagaaatagcaaagatgggccaggtgcggtggctcacccctgtaatcccagcactttgggaggcggaggcaggcagatcacttgaggtcaggagtttgagaccatgctggccaatgtggtgaaaccccacctctactaaaaaaatacaaaa

SEQ ID NO: 119243 - DNA, 169 bp, Homo sapiens
acccgtcgcatagtcgggggcgcgcccggtctccgccccgaatccaagtcggaacttgaccgagttgtttgggccgcgatgaccgcacggcgtgaaccgtcctgagcagggcccacgcccggcccaagcggcccagccaccgggctggggcggtgtctccctttgcccc

SEQ ID NO: 119244 - DNA, 811 bp, Homo sapiens
gccgctttggtgggaaggacctcccttcccccttatagaaacactttctccaggccgggccgggcttggtaaacctcagccgtgcctgggtagaggacgccgggctgggccgagcgggggtggaatgagggcgtctagagacagagaaaactaagtaggatggggtcgtccccccagtaatctggaaaacagttacagcaacaggctcctctcatcagacggcagtgctggtcgtttcctcactggtttgcggggaaggctgggcagaaacaaggatgcaaccttgttctcaaccacttgctatctcgatagggtcttgctgtgtcacccagattggagtgcagtggtgtgatcacagctcactgcagccttgacctctaggctcaagtgagcccctaccaagcagctgggactacaagtgcgcaccaccatacccagctaattttttcattttttgtagagacagggtctcactgtattgctcaggctggtcttgaactcctgagatcaagcgatcctcccactgtggcctcccaaagtgctgggattatagatgtgagctaccatgcctggcctcaaaacatttttgtaatctggctgttttccagttggatggactctgagtgcaatctcaatgtctttcctgatcagtaagaggaagaaaggagctgttgtataatctttggtccacttgctatataggaatagatctttactgctacatatacataattctgtacggaacagtcatgttccttggattctgacagcatcgccaatatgtgctttgaaacctcctacctggcacaga

SEQ ID NO: 119245 - DNA, 426 bp, Homo sapiens
atcctaagcttctctcctccactttctttctctccaccatccaatctgtacaactagttgagtcttcctctggggtggttcttcagtatacgtctatatcctgaccctaaggccactttcaagtccccattggatctcatttgggtttctgcaatacagtcgcctaactagtctccctgtctttcatttcccaccagtctctaaaatgaggagtataaggggagattctgctgtgtacatagcggaaggagcaaggctgggatccatctaaaatgccatataacttttttcaagatcaagcaacagacaatgccagtatgtgtgcttgtttctgtcccctcttaccaacttcctccccaccttattctcatcacatttccttcaaagaaaccacactgttgaacaacagttgggcattctaaagca

SEQ ID NO: 119246 - DNA, 275 bp, Homo sapiens
ccttaagcaagttctctaactctctgaaccttggtgttcctcacctgtaaaatggggacgataataaacccacctttccagatggccccaagccctgagtttggcccacattttatgatcaatgtgtgaccgccattattacggatcattagtcttggtccatgtggttcagaacatagaactgctgcctgcctgacctcagtaattcatgcagagaaacagcatttggacctcccagtacagttcattttgtagaatttttacactgtgtggat

SEQ ID NO: 119247 - DNA, 851 bp, Homo sapiens
acaagggaaagtgactcatcactggacccagcacacaggtgatgtaattcttctgccttgtttttgtacccaggagccattgtaatccatctctgggcccatcatttaaatgatgtgactatccttttcttcctgagccctattcacagggaaaatagtgacacatctgtgggcttctcaccgaaatgatgtgactttccttcctgggctcacctctcaagggaattttgacatattactggaccaagcacctaggtgatgtggctctgacaaacgagaaattgtgatgtaccactgttccacacctaagagatctgactctcttttcatgagccctgcatttattgtgtattgtgacatatggcttggtccaacgcctaggtgatgtgactctctacttcttcctcggccatgccaaagaagaggattgtgacatatcactggatccagcacttaggtgatgtaaatcttttcttttgctgagccatgcatatttttggtattgtgacatgtagctggaccgaacacctacaggactggatcagaggctacttaataagccctgcccataggcggccttgtgacatatgtctgcatctatcaccaaagtgatgtgactctttttctgcctgcatcctgcacatagagaagattgtgacatatcgctgggcccagtaaccaggtgatgtgtcttttctggcaggtcttttcccacagggagcattgtaaaatatcactgggctcggccaccaggttatgtgacccttctgcctgtgccctgcttcctggaaatgtgacattcctcatacagcacccaggtgatgtgactcttctgctcattttctacttat

SEQ ID NO: 119248 - DNA, 445 bp, Homo sapiens
caaatatatctgctgggatttatcattattattattaattataatcagcctttgcttggtagttatcttatttataacttttgatatagagtttttaagatatattcttgacctctataccacatatcaaaagagtagtaagttacttgtttcttttcaagtaaattattgatttgctactgactatgctcagaatgatgaatgaagtaagatttcaagctgtgaagaatctggagcccagtacctttctgacccgcaactttgacctaaaaaatggcatgtgtctaacttggaaagtaatttttagttgctatttatttagaaattatactacatttgtgatgcctttctccattttctccatgaatggttcaaaatttaattcctagaaatcactagtttataatcattccctttgatgttcagcagttcataaaactaacag

SEQ ID NO: 119249 - DNA, 322 bp, Homo sapiens
tgagtgtaatacgaattccaaagacctttttgaatattaaacaagataatacgcatgaatgaactttggaaaaactgtcatatgctgtgtaataattttcacaacttttcctgtcaaacagtaggcttttttcgccaaaacttctttcagtacagaatttaaaagagaaaagtagaagcgagaagggagcatgtaaagttatgctgataaggccaggcgaggtggctcatgcctgtaatcccagcacttcaggaggctgaggtgggaggatggcttgaacccaggagttcaagaccagtctgtgcaacatagtgagagcctg

SEQ ID NO: 119250 - DNA, 232 bp, Homo sapiens
tcacaatatccaatatcttgtagagagacttctataagccatgacattggggaaggcgtaatcactctgacatcaggattacatttgtaattgacaaatgtgggctgggtgcggtggctcacgcctgtaatcccagcactttgggaggccaaggctggcggatcacttgaggtcaggagttcgagaccagcctggccaacatggtaaaaccccgtctctagtaaaaaactac

SEQ ID NO: 119251 - DNA, 161 bp, Homo sapiens
ggaatcctggaagctcgtgagcctcaaaactggaattcttcgctaccactccacagtgatgcccccacctattggcatcctgaccttccagatgggcagctgagaatccatctaaggcagagatgctgctgagacgatccggagcactcaccacccaccct

SEQ ID NO: 119252 - DNA, 369 bp, Homo sapiens
taaatagatgggtgggcttgaactcctgggcttaagtgatccacttgccttggcctcccaaagtgctgagatcacaggcgtgagccaccatgcctggccctgatttttttttttaaaggggttgtttccatttcattacaattctgagtgcctttagtgtccaaggcattttctaggtgctgaaaataccaaaaaagtatgatataatcttgccctcaatgggtttataatctgtgtgtgtgtgtgtgtgtgtgtgtgtgtgtgttcacagctaaactgagggatatagtcggcccttcgtatccctgggttccacatctgtggattcaaccaaccacaaatcaaaaatatttgaaaaaaatggatggt

SEQ ID NO: 119253 - DNA, 355 bp, Homo sapiens
caccctgctaacagggcagtggctgccactgccttgaaacagggaggccatcccatagccaccaagtctagtcgctgggacaaacatgccacgggccaataccatgaccctagtgtttgtaccaagactcttatagatattccttttctttcatagatatacacgtaaaaaggctttgtcatgtctggcagtcctaatgccagggcgtggatcaaagccttcttgatttccttgaaggccatgtcctgctcttttccccacaggaggggttgttttccgccactttggtagcctcatacagtggttttgctaagagcaagtaacatggaatccaaatgcgacagaaaccagctgc

SEQ ID NO: 119254 - DNA, 403 bp, Homo sapiens
tagaaggagcggcaggtctctaagaagtggagattctgcagctggcaagcagcttcatggcatttggtaggcaatttataaacaatgaacattatcctaatttcacttttcttatagagcagctgtgtgctatagtaagaagtaatgggcctcagctctgccactgttcatgcacccttagataagtcacttacaggtgtgagccactgcacccggccattgaaaatttttaaatgattatatattatttttataattaaaaattttgtttttcccaaataaagatcccattgtcccttgagtgggaaccagactggaagcaggacctctggattaagtgactttaatcttgtagctctcctaagcctcaaacttttagtacagtgggaccccatttataaat

SEQ ID NO: 119255 - DNA, 470 bp, Homo sapiens
gtggtaatttaatttagtacaactcttgggtagtagttattactgtgtaatgttttactgttagccccaacaatttcacttctaaaactagattaaaaaaaaattccacagatatgcgaagatagctatatgagaatgtttattgccaaaaatttggtaacatcaaaacactgtaaacaaactaaacatctgtccatacgggattgttaaatcagttacggcactgattcaacggacttgtatataaccattaaaaattacaggtgtgagccactgcacccggccattgaaaatttttaaatgattatatattatttttataattaaaaattttgtttttcccaaataaagatcccattgtcccttgagtgggaaccagactggaagcaggacctctggattaagtgactttaatcttgtagctctcctaagcctcaaacttttagtacagtgggaccccatttataaat

SEQ ID NO: 119256 - DNA, 1505 bp, Homo sapiens
aaagggagttcggagggggccaggcctcctgcatgaaaagtgagggtcctcacgagcagtaggagctttggggtcagcctgcacaggatgggctgggcctcagtccttctagcgaaagccctcaagactttgcttatctggggccacccagtgagtcaggggacagaggttctcactctttctgttacaccaatcccaggctggggcttaataacttggtgtgccgcgctgtgcttttctgttgctttggaagtgcctggcatctcgtatggtgggctgtggagccacactgcctgcatttgaatcccggcttcacgctgtctttacttgacttctcttacctcatttttcccatctgtaaatggggtataatcatagtaactatcttacgagttttttgtttgtttgttttaaatttcagattcaggagatacatgtgtagttatattacataggtatattgggtgatgatgggatttgagcctcggtgaactcatcacctaaactgtgagtgtagtacccggtaaatagttttgcaagccttgcttctctccccgcctcccacttttggagtcgccagtgtccatcgtttccatctttatgaccatgtgtgcccattgtttagcttccacttatgaatgagaatacgtggtgttcacctttctgtgtcagttatttcacttagggtgttggcttccagttccatctatgtggctgcaaaggacatgatttcattatgaggttaagtttaagattaagccttagaattcacattaaggttttgtgctcggcaagaataaggtcccaggaaatgttaattgtggttgccgttgtcggccaccatcaccaccaccaccaccattgtcaaattaggctcttcattcttttaataactgcttctgaggttttattttgttttgttttgtttttcttcgagacaggcccttgctctgtcaccgaggctggagtgcagtgatgcaatctctgcaacctctgtctcctgggctcccacctcagccgcctgagtagcttggactgcagatgtgcatcaccatgcctggctttttgtttgtttgcttatttaagatgggtcttggtctgtcacccaggctggagtgcagtgacgtgatcctagctcagtgcagcctccaacacccgggctcaaatgagcctcctgcctcagcctcccaaaagtgcttagattacaggtgtgagtcactgcacctggcctgaggatttaaaaacaagcgagcaaacaaaccaggctatcctagatatttgtgttatgaaatgagtttctgtaggtaatcagtttcacttatttttttatttctatgaatttatagagagcatggtatatacttggcacccagagatagttgtaagaaatacattgtttattttctgtgtgttagaatttgaggattctcaatacattattaaggcaacctccacctcccgggttcaagcagttcttctgccccagcctcctgagtagctgggat

SEQ ID NO: 119257 - DNA, 416 bp, Homo sapiens
atgaccgagcctgggataaggaacactttgtctcagtatttatgaagagcacacttggcaacagaggaagagaatcttttgaattccagatcagaagggaatacacgcctgtaatcaagattctggaatcgtacaaaataatgtatgcttagactctgcgtgtgagtggaaaccgttatattggccagtgtagatattagtcataacgtaggaagcagtttttaatgtgcagttcttagttttcaatcttgggagcttcttgataattaagtgatgtttttgacagtgaggaaattaaattatgcgcggaattcactccctgaagtatatttttgagtagctttccttggatagtttaactgtagtcttgtcttcccaggatgaattaggtgacttattgaggtctcttcagtagc

SEQ ID NO: 119258 - DNA, 516 bp, Homo sapiens
gcatctcccattctttgcctctgtcttcacatggccttctctgtgtgtttctgtgtcctttcctctttggattcagggcccaggctaaatccaggataattttacctcaagatccttaattcattacatccgcaaagaccctatttccaaataaggccatattctgaggttccagataatcatgaatgtttgggagacagtattcaattcactacacaggcctaagtgttaatttctactgttcttctttccattggatacagaaaactgttaatacactctgcttttccttttttttttttttttggacacactgtctcactcttttgcctgggctggagtgcagtgatgtgatctcagctcactgcagcctccgcctcctggattcaagtgattctcttgccttagcctcccaagtagctgtgattacaggcatgcactaccatgccagctaatttttgtatttttattagagacggggcttcactgtgttggccaggctggtcttgaactcct

SEQ ID NO: 119259 - DNA, 145 bp, Homo sapiens
gggtgctgcctgggtgagggtggctctttcatgtttacaattagcatcctaaaggttggaacaagcaggggctatgactcccagagagagtggcagctgactgatgctggtaaaagagatttccaaatgtatgcatttcatgcag

SEQ ID NO: 119260 - DNA, 891 bp, Homo sapiens
atcataaagtattgtttgatctgaaagaagacagtgaacatttttggtaatttttagtaagctccctgataagattcatctattcattttattgtggaatttagcttactaaaattcctttagccagattttcccagtgcatctaatagctgaattaactattttatgttccttgataactatttagtacattattctttaaatatacatcattttaagcaatcatcgtgtgaaaactggtaaaattcagcatgattatttacttgacaaaagatgtattgtttcttaaaaataagccactaatactacattttataatactacattttaaatatgattaaagttataaaacatgcatccaaacacttgttcagaatacatggattatttatgttttgaggaacgagactgttaaagatttggtgatgtgacagatgatacagtttgtaaacataactaagaagttactcaactattatatataattaattaaatcattgtagaaatgattattcagcaattatgtcatttggtaaattcaaaggttaataggtccctgcactcaaaattcttccagtttagtaaaatgtagtcattatttgttttaaaggaaaaagtatcttaaactatttattaatgagttataaagccaatataatacactggggctcagtgagttataaagccaatacgatacactggggctctctttccagtatacctcttgcaagctacaggcaagtcagttacattctctgaacatcagtttcttcatctgaaaatgtggaacaaaatatctgccctgcctacctcgagcagtttttttgaaccttaaaaaagatgttgcttgtcaaagtgccttaaactgcacatagagatgaagtatgacaa

SEQ ID NO: 119261 - DNA, 410 bp, Homo sapiens
tgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaac

SEQ ID NO: 119262 - DNA, 147 bp, Homo sapiens
ccaccattaccaccctaaccccactctgccctgaactgcaggtaactgcatgcatgtcagcctctagcccctgaagtggaaaaagccctgttcacctcaccctccagaaggctaatagtctcaactacagctgactgtcaatacagg

SEQ ID NO: 119263 - DNA, 508 bp, Homo sapiens
cacaaatgaatgaacgaatgaatgaatgggttctaggcctgaagtcaggcctcctgagttttagtccagcttctgtgctgtgtgttcttgagtataccccctcccctctctggaccttttttttacaggaggacaaggaactggataggtagattctagagcctcttatttctgccatacattctgggaagaattaaaaccagccttttaaaagacagggcctagaaaaatcacaatttgctgacagggcctactgtgtgccaagtcccttgttagggaggtactgttaggtgccttcttgtcaaatcctcggaatgactcaggcagttggtattaccaaccccctttacagttgaggaaacggaggctcagaaagataaagccctcctcaatgtcataagcttggggtaagaggctgcagagcctgtatttgaactcaggtcttcctcctgcaaagctctgactccatcagaaataccttctctcccatcggaagttccagtgctgt

SEQ ID NO: 119264 - DNA, 427 bp, Homo sapiens
tacaaagggtaaggaaacaaattctcccctggagattaatgaagaatcacagaactatggacccatattagatatgtgacttacagaattataaaagaataaatttttcttgttttaagccaatcactgtgtatagcaataggaaactgatgaaatgattttatgtagaaaattccaaaaaaatctacaaaaatctctagaacaagaaaaatgtaaaggtagcaaagtataaggtcaacctacaaaaatatcgtatatttcatcagccaggcatggtggctcgtgcctgtaatcccagcactttgggaggccaaggcaggcagatcactcaagctcaggagtttgagaccaggctgggtaacatggtgaaaccccatctctacaaaacacaaaaatttaacaggccatggtggcacatgcctgcagt

SEQ ID NO: 119265 - DNA, 262 bp, Homo sapiens
aatttctgccacccccactcatgctaactggtggttacaaaaaaaactgacagcctgtttcaacgttgccagagtctgagggaccccaaaatgatcaatgtcaccattttgcttcatgactaggagcttattgtgcgaaaagcagctactccctatagtcaattaatagttccatgaaagaagccagagacgtgagcaatcaaaactaaatcaggcagcgtattttttttgagtcctccgtatttcttttttctagaatgct

SEQ ID NO: 119266 - DNA, 239 bp, Homo sapiens
ccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcaca

SEQ ID NO: 119267 - DNA, 201 bp, Homo sapiens
ctgggtgacttagaggatccctgatccgtgcattgagtacaagcctttctgtggacacatacttccatttctcttggacatcacataggggtgcatagctgtctggaaactgtctcaaggcagaaagctgctgcgatcgtgggtgtcccctcatctgtttctctcagggatccttgtctttctttgcctgatgtctagtgt

SEQ ID NO: 119268 - DNA, 676 bp, Homo sapiens
gagggtggtgccgccgttggctcctgcctccccggctccgcgctgccgccaccgcggcccatgggcagagtcggcgggcgggccggcattaaaccgaagaaaagatgtccctgtacgatcagaggaaaccagtgactcaaaaacagaaggctggtccaaaaacttcaaacttctacagtctcagcttcaggtgaagaaggcagctctcactcaggcaaagagccaaaggacgaaacaaggtacagttcttgccccagtcattgacctacaacgaggtggctcctcagatgaccgggcaaattgtggacacaccaccgcatgtgccagctgggctgaaggatcctgttcccagtgggttttctgcaggggaagttctgattcccttagctgacgaatatgatcctatgtttcctaacgattgtaagaaagtagtgaaacgccagagaggaaggacaaagacagcgggagctggaaagacagaagaaatagaagaaagagaagaaaggcataaatacagacatgatgcacgtgagttttcaaggagttcagatccggattctgatgaagatgaagattaggagcgagagaagaggaaaacaagtatgggcggagctgccattgcctcacccacttctctggcagtaaaagacagttaccccgagattttccttatgaa

SEQ ID NO: 119269 - DNA, 266 bp, Homo sapiens
acaatcatggcggaaggtgaaaggcacttctcacatggcagcagacaagagaagagagcttgtgcaggaaaattcccttttataaaaccatcaggtcttgtgagacctactcactattaccagaacagcacaggagagatctacctccataattcaatcacctcccactgaattcctgcccatgacacatgggaattgtgggagttacaatccaagatgagagtcacagccaaaccacatcattcctcccctggcccctccccagt

SEQ ID NO: 119270 - DNA, 282 bp, Homo sapiens
tatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctat

SEQ ID NO: 119271 - DNA, 319 bp, Homo sapiens
ttggagttcctgttctgtacaagatggtggaaaggatgaacaacctaacttcatttttaaaaaattaatcacatttatttagtattttccattaagtgctgatattcagctgggatgtagcagtctgtctctgtggccgtttccacatctccttttagattgctgccaacagtggttataatatttctgaaatcatccttgattctactaaatgtcaaacctgaactgggaattttcacataccttttttctttgaaccatttcagcaatcctctaaggtggatattattatttctattttatctaaaaagaatagagc

SEQ ID NO: 119272 - DNA, 155 bp, Homo sapiens
ccgttgctctccttgggctccagggccgtagggtttccaccacatgtctggaaagaaaagacacaggccttggagtcatgcagacctgtgtttgaatctcgcctctagcacttcctggctgtgtgatctaaagccggtgtcttcacctctctgag

SEQ ID NO: 119273 - DNA, 778 bp, Homo sapiens
agagctagcagccctggactaagcccaccgggcctgctgactggccaagggcacacacagagtacccaggatgcccgcaaaggggaaaatcccaggggtgccagagtggcaggggtgccaagaggggctgctgaagcacagggaggggtgctgagcctagggctggaggctgctagagtttaggtgggtggaaaggggcctggctggccagagacccagcccagagaccccgccagaacctaaggagttcatgctcccaggtgacgccaccatcccagaaaccaaacgccaggtcaaggccagagcccgccccacctcccacatgaacattccgagctctgagtggcattgatgagtgtcttggtcgcaggaatgccagggaaaggcagcacggaggtgagacaggtgccctggctgcctcctggagagcagcctgctcacaggtgcccttcccaggccccgggttggcctccgccacggctcctccaccccctcttcctgctgcagccagtccccagggctgcccaaggccaggttccgcctggtgcccaaacctacttcctgtccagctgcccactccccgcctgcctcagccccggtccagcaggctccccaggcagcagccatgccccgccccacctcccacagcatcaggtccctagacagctccttccctcgcgtctgcacacctagccactcgcccctgccgcacccccaaccccagcagcccctagctccctcaacctgcccaggccctggctgcctctgaatgcccccc

SEQ ID NO: 119274 - DNA, 422 bp, Homo sapiens
tgatgtccctatctcaccaccatgtaccctgaggtctattagatggaagtgccagttagaaatgcttggggtgcaagtaaccacactgtcaaataactggactgaacaaacgggagattatttccctccaacaagactgttggtgcgagttcagcagctcagcaatgctgggccaagctggagtctctaccacgctgtggactgaccctaaggtcccaagatgtcagtcgcagttccagtcaacgcatatatggcaacaaatggagctgagaaggaagggaggggccggagcaagagcctctttgctgcttcaggtaactttgacattttctggtgacgcaggccactgataagtgattttggttatttacccccatcaatactcaaagctttttctcctctcttggggctcccctcaaata

SEQ ID NO: 119275 - DNA, 648 bp, Homo sapiens
cacaggaagttgttctcaccgctgcagcagtgacacaggaagttgttctcaccactgcaggtgcagaaaacaagcctgatactcatgacagcctatgaggggccaggcactgactgagctaacaacctgcggagctgagagctgggagctccaaaaacgccagcagggaagaagcagtgggaccaaagcaaccccttcctgcatgtgcctccaaaagagacctttccttttctaatagatggtgtctcgctctgttgcccggctggagtgcagtggcaccatctcagctcactgcaagctccgcctcctgggttcacgccattctcctgcctcagcctcctgagtagctgggactacaggcgcccgccaccatgcccggctaatttttgtatttttagtagagatggggtttcagaatgtttgccaggatggtcttggtctcttgaccttgtgatccgcgtgcctcccaaagtgctgggattacaggcatgagccactgcacctggcctatctcccctttctagtacttaaatgcttttttcactttctcaaccaagggagtcactttggttttcctgcctttggaagacgtaaaaatgagaattccatacctatggcataaagtgtatggcataaatttgaagagtg

SEQ ID NO: 119276 - DNA, 705 bp, Homo sapiens
agtagaaacaaggtttgcagtagccctctggacaggcagaccaacgcactcgttccaagttcggatgcagaaacctgcttacactaccagactggccaagtatcctctgctgcatccccatccacccccaccgtggcagccaaatgggggtcttggccacaaggtggccgtaagcatctacttgggcctgtagaacgacgtctcattgaacttgaagtggtttatgttgagtgaggaaaaatgtcagaaggcaacagggttgtagcaaaaggtagtttagtgattgtctagttcagcttcttggtgttgacatagttgagtaacagccattttaaaaacaaaggaatatctcgccctttgttgtgtcgagagaaacaggggaaagactgtctgttgagaagccgttggtgggactcggccatttgccccgtccatagccagtgagtgtttcccatacactggccttctatacttttatctcaaaacagaaagttcaagatcgatgatgtctatagaaatcatatacctcaagcctttcctctgataggtgggaaactgaggcagagagcagctgggtttacccagcaaggttttggcacggtcaggcctaggaactttatttccaggcttctggcttagttctgtttccatttcattctggtacctttgcataaatatcttccatttgtccacaggaaacctccc

SEQ ID NO: 119277 - DNA, 1064 bp, Homo sapiens
agctcgaagcggtcctggaagactcgggccctacccctgactttaccgatgagagactgaggcccagacggtgtggggtcagggcccaggcttctgggggatgctgccaaggcgggagccagcgtccccagtgcccggtggattcgtgatggcttgcagagggtttcagtttccactgtccagccctccctgcagaccaatgcctaggtgtgacagtttggtaggaaaggggccggatatttgtctccaggctgggtttgcctagcgagtcgctgcatttactaagattgttggttaatttgggtggctgggggagggaggctgatggagataccccccaaccccaacaaacccttggcgtcaggagaggaggggcttttcctgaagcaaaactaatctctggagctaaaaataggagtgggcctggcgcggtggctcacacctgtaatcccagcactttaggaggccgaggtgggcggattgcctgagctcaggacttcgagaccagcctgggcaacacggtgaaaccccgtctctactaaaatacaaaaaactagccgggcgtggtggcgcgcgcctgtagtcccagctactcgagaggctaaggcaggagaattacttgaacccgggaggcgaaagtgcagtgagccaagatcgctccactgcactccagcatgggcaacagagcacgactccgtcttaataatagtaataataagaagaagaagaagaagaagaagaggagtggctgcctatgccggagttgttgactggaacaagaggaggaaccttctgggctgctggtaatgttctatgcctggatttgggtagtagttacatgggagcacgcataagtaaacattcttcaaactgtcttcttaagatgagtgcatgtcactgtgtgtatgtatatataataccttcatttcttaaaggcaggtgagaacaatctggcgttagaggtgagagtactggttgcctttggggtatcaactggaaggaggcacaaggagaggcctctagggggctgggaacattctgtatcttcagcacagccgttttgt

SEQ ID NO: 119278 - DNA, 625 bp, Homo sapiens
cttttcttgctgttgggtgccatttgcttctcagacctccacattcctgactgtaagcccttccattttggatgccatgttttgcatgagactctggagttgtaattctaggcaatgaaacccagagggaaagggtaaggaacagaacttgggggtagacacatcaggacctggggcaaagatgtttgcggcaaaatggctacagtgctgacacagctggctgctgagctatggatttaggaaaaagaaaacccaaatcaaaacctcccccaaacaacaaatgagaatcagtcccactatgggaagaaaaatggccgttacatttttacaccacaattcatttgcttataaaaagatatcttaggccaggccttgtggctcatgcctgtaatcccagcactttgggaggctgaggcaggtggatcacctgaggtcaggagttcaagaccagcctgacgaacttggtgaaatcctatctctacaaaaaatacaaaaattagccaggcatggtggtgggcgcctgtaatcccagctactcaggaggctgaggcaggagaatcacttgaaactgggaggcagaagttgcagtgagctgagatcacgccactgcactccagcctgggtg

SEQ ID NO: 119279 - DNA, 696 bp, Homo sapiens
tacatatagtaatcactggtaaaaaggtagtcacttaaaaatatttaataagtaatatccattcaacaaatatttattgagtgcatatcttttaggtaccgttttaagttctcacaatatggtagtgaacaaactgatgaaacaaacaatagaaacacaaaactaccttcacgtactgtttcaaaatagttgtattttggagcatttgggaggtttgagaaaatacaggagaatttcgagttaaagcctcatcatagacttttgctgacacgttgagctgctcagcccccagacttttttcctcttgagaggagtgcccagtgtgtgggtctttgcaggagacctactatgaagtttggatgtttctatatattcctcctttctcctctctggcagctgaagcactgtttctctcagtatgatgctctcaccaggaataaaaagccatacatttgaagattatttactcagcaggcagtgcagttaagagtccagtggtgcccgcagtagcggtagttcaatgttagcagggctggtggcagcaccgtgtgcatgacaagacaagacactgattgttttattagctggttgccgctccctttcctgtctttcagatggaatcagtttcattttctccaaatgttaacatacaaacaagcaaataagtatataaaaattgaggctacactttagcta

SEQ ID NO: 119280 - DNA, 877 bp, Homo sapiens
caccatgggtttgcaaccagtattgcacctgcagcccaggatttttagtccagcaggtagttgtggggcccacccagcttgtggtcccccaactcagcaggtctgtctccagtgtcttccctgggagcaggctgaattggctaggcttgtcccaagccatctgcattgaaattgctgagttcttccagatgttctatgctgctaggcttcctgggatggaaaccatgactggtcatctggccacacccttcccagtttattcatgtgaatgaaggggaactcagctcccatgctggctcatgatcccatgacttctctgtgtgctgacagtgtgggcttctaccccacttaagctcagaccacatatatcagcttgatattatcaggcagtgtgctgaagacctgggcagttggcactgggcccatggatttgtcctctggccctttggggtcaagcaccatctgtgatataagtggatgccatgctgtgggcacccttctgcaggaccagccaggtaggtcatcttggacggtgccagcaggcaaagtggtgcatggatcagattcacctcagtcccatgatagctacaaccttgctctctctcagcctggcagacagcagcagatggatcccctcagtgcaagatgcagagcctcggaggatgggcacctatggtcagctacagctgcacagcacagtgaaaactgcagatttccacaagagtttaagctgtgcctctgcctattctccaggtggctccccctgccagttcacagatgtatagggatcatatgagagtctataatcaggagctcagactagatttagctgggaaatgcctttcaaggagaaggaaccaaagtgagaatctcagag

SEQ ID NO: 119281 - DNA, 785 bp, Homo sapiens
ggaataaacgatttctgaggtctctaagatattataaaactttattgaaagatctaagaaaatttaatgaaacacattgtccttattaatctataaatatagttttaattaaaattccaatagggggccaggtacggtgggtatgccagtatttccagcacattgggaggccaaggtgggaggattgcttgagcctgggagttctgaccaacatggtgaaaccctattgctaaaaaaagacaaaaaaattagccaggcgtagaggtgtgtgactgtagtcccagctactcaagaggctcagttgggagaatcgcttgagcccagaagtcgaggctgcagtgaactgtgatctcaccactgtactccagcctgggcaacagaattagaacctgtctcaaaaaacaaataaaataaaattccaatagggtatagtataacacttgataagtcgatattaagatttatatggaagaataagtgactaagaaaaaccaatagaattttaaagaaaaataaagcagaaattgccctacttcctataaaactgtaacagttataccacatggcttcaggtgcaggaacaggcagattaatgaagcagagtctagaaacgagccacatatgtgtttatggaaactgtaaatatctgatgtagtgtttcagatcagtagggaaagagtagaatatttaataaattgtgtttacacagtttaactttaaaaaaattagatccatcttacattagacacaaaatttatttctaggtgaattatatcccaaatatg

SEQ ID NO: 119282 - DNA, 609 bp, Homo sapiens
ggggtttccccatgttggccaagctggtctcaaactcctgacctcaagtgatccacctgccttggcctcccaaagtggtgggattataggcgtgagccaccgtgcctcgcctattatctccttattctctttttaaagatgaaaaatggaagcttacagaagttaacgtcttattacactagacagcagtgggtaaaactaaggtctcacctaaaatcgatagttgtgaaggtttagtgatactgataatagcagaatgtactgggagctgattgtatgccaggcacctttctcagcactttgtgtacattaattcatttaatcctcacaataactttatgaggtgtaggttttcaaagtaaaggttttcttattatcaccatttttaagtaaggaaattgaggcacagagaggtgaagtaacttgaccaaagtcatataactaataagtgatatctccgtattttttcctcttttgaatttgtcattaaaatctaataaataagttgatattcataagattctttattgtccaaggagttttaatgcatgtagagacgatcacttaactacttttattttaaaggtgagatataaattcagaaaccaa

SEQ ID NO: 119283 - DNA, 439 bp, Homo sapiens
tgatgtatgactacaggcagactatttgaatgctctatgctgattcatgctgctatttttcacttgtcttactagctgagattatttttaaggcagtgttggatcctggagagggtgctgggagacaggtactctcctttgctgctggttgaaatgcaaattaatatacccttttaggtaagcaatttggcagtaactgtcagtagacttcggaacacttattccgtttagtccagtattctgattctaggaatctagccaaagaaaataatcagagatgggcagagaaaatttaagaataaaaatgttcattgcagtgttatttataaaagagaggaaaaaggtaaacaattgggtggaataagtaaaatgtggccaagcctagcagcggaatattattcaaagattacgtattgttttgaaaatgtgttttgtgaca

SEQ ID NO: 119284 - DNA, 592 bp, Homo sapiens
gcacgagattttgcagatgtaattaaggttgcagaccttaggagatgatcgtgattcatgcagtgggctccatgtaatcacatgagcacttaagagatttaactctggttggaggcagaagagacacagaagagaggtgtgggtgaggggaagccagagaaactagaagcaggagaatgtctctctgcaccattgctggtttagaaaataaactgggcactatgaagagcaacgcaggcagcctgacattgctgagaggccccaactaccagccagtgatgaattgggacctcactcctacaactacaagaagttgaattctgctctaacctgtatgtgcttggacacacattctgccctagggccttcataaggagcccaagagcaccttgattttgtccttgtaagactataagcagagtcatcagtccagccctcccacacttctaaagtgagagataataaagagaatgttttagtaatttgttacagtgatgattaaaagctgatacacattccaacctccatcagatccatttacagacattcccattcagttctaaacccttggacaatggccaaaaaaaaaaaa

SEQ ID NO: 119285 - DNA, 807 bp, Homo sapiens
agcggagtatgtataaagtgcttagaagagggcctggaacataggacatggatgaagctggaaaccatcattctcagcagactaacacaggaacagaaaaccaaacaccagtgttccagatttgcattaagctgtcacccggtggctgtgtaactagctgcttttgtgactgttacagccgcaaaagccttaacagacctgcagttacagactcagggaaaagcttgtactgttgtttgtggatcgcagggaagccagagttgcagctgactttctgtccacgagatggcggtagaggagcacagaaaaaagaaaccatcttgggctgttaatcatgttgactgttgagaagctaagagggaagccgatctgtcattagggtgaaacaaaaaagtcactgtaacaggagtcaagaacggggcttagaacctagtcatgtgaactatttccaagttttctcttgaccttgtgtttctttcatcaaatgagcgttcagtgaattcgggcactcagtaacctccattagctgactgcacccaccatagaaccttctctctaaaagtctccacattcgtccacgctcgtttcctccttggtccaatgccaacgctcgtccatgctattgccacccccattctgcctcttcccaaaagcctgcatcagtccatggagtcctcttcacctgaaataagcacttagtataaaccgatgcaactggtttcgtgctggcaagacaggctttagcaagacatttccaaaagagcaagtcttctctcactttggaagccttgaactctttctgaaccg

SEQ ID NO: 119286 - DNA, 298 bp, Homo sapiens
ctgatgctctgagcagacagttgtcaggaccgaaagagcagaaggtgccagcccttcctgttgtgaaaaggaaagacatgacctccaaccccacgacactgagagagctgtctctttctcagatggtttgcatatttcttccaagcaggctaccatggccattttcccctcagcgaggtcaagttcattacatcatgtatcttactatggtacctttaccatcttttgaagagctctcaggaaagatgtttgggaaaaacgatgttggaagaatcaaagggttatgtagaatattcat

SEQ ID NO: 119287 - DNA, 720 bp, Homo sapiens
accgtataaagtagaagtacattttatttattccaatgctatctctttcacactttaaaatttaaactagtcctaggatcttgttaacagtttccagactcctgtttttttcatagagctttttacatttttgtgcctctggattcaaagggttctaatggtcttggtttatcttcatatagcattcactcacccactctgacaggtcagaatgactcaatctcatcatgcgtggtacccagaaggcccaacagagaagagagcaatctagttgtccctgaggatacttggctcaaagcctcctaccatcctctctgagccaggctatgcatccagtccctgcacagaggagctggctgtgaggaactatagggaaaccctggtcttgactacacaagcttcagttttacataatgcaacttcacaactaattttttcccaatggtcagatcggcaggtagactgaagccattaaggtagccaaaagcaccagtcaactgggatatacagtttttctatcatgtggacatagccttgccatcattcagcaatatgtaagcctgtgacttttctgaaaaacagaatgaggggatctctggttcagttccttgagtttcaatctgggtaagtgggtcacttgttgcatactcttgtaatatccttccacttaatattctagagggatggatttgttagggaaaacagaagcacctattcctg

SEQ ID NO: 119288 - DNA, 958 bp, Homo sapiens
tgagacggggtctttcactgtcgcccgagctggagtgcacagtggcacgatctcggctcactgcaacctccgcctcctgggttcaagagattctcctgcctgagcctcctgagtagctgggattacaggcgcctgccaaaatgaccagctaattttttgtatttttagtagagatggggtttcaccatgttggccgggctggtctcaaactcctgacctcgtgatccgcccacctcagcctcccaaagtgctgggattacaggcatgagctaccgtgcctggcctctccttagattttttaagtcctctcaaatttgtacactcagaactaagtatattcaaatgtagtctgatttgcatagagaatgacattttcttcattcagactttgtttttaatgaaacctgataccagtgattttggcagctgtaacaggctgtatgtctctttgaaatagacttttttaaaagcctagttgtttctcactgtcctgtgccattttgttgttattgttgatttttttgttctaagcttatgactttatatttatccttattaaatatgatccccttaaatttagcctcctgttccagccacttagaattacttaaaaagttgattatgtcatacagggtatttacttttcccatcccagatacctgtcatttgcacatttgatcgtcctcctttccatattctcatccaagtcatttataaaaaaatgttacaaaggacaggttgctctgggcccctgttgcatactactgagccttcttccagatttatctgcactctttaggtacagttgtatagttgtctgtgaagccacttaacttttaagttaaaaaattcatattttttcaccttgcacagtgatatcaagagagactttattttatgccttgctgaaatccagatactatatttatgcctctagcatttgctggcctaaccatat

SEQ ID NO: 119289 - DNA, 466 bp, Homo sapiens
aaagaggcaggagcctgagtgaatcaaggatcggggaggggtcaggacccaggtagcacctgggccagggctgctctggcatcagacggaggccacatcctactctgccacttgggtccacctctcccagccactggtgccccagtcattggagcagaccagcaaggaagacaatgaacaccttgtaggtttgcagggcagattagctttaccacagataaggaggcctccttactagagataacaaggcaggtagagagagggtgccagggagctgtcattcaatcccattagtgactgttgacagcagaaggaagtcagcctccacctgggctaccaaccatgggaacagaaaacaaggggccaatcagagggtgagagatggtgagaggctgttctgtattattcctcagatgtggctccaccatcaactcgacaagtgtgttttgaaaatcaagctgtctcc

SEQ ID NO: 119290 - DNA, 366 bp, Homo sapiens
agctccttaccagcaagccgtctaggctgcgaacgcgagccgccgggccgcagctctctagaggtccctgtccccaccgcctggccccatctcatgtcacattcccccaaggtctcattccactcggctaatctccaagaacaccggccagggcattggctttcgggtccttttaaagaccaaaaagtaaagcactcccccgtgggtgctggacagcttgggagggatttggggctgtgggtggtgaaatcacagccctgggcacacacctgccagcccgatgtcactgacaggctgctcggaggcttggggctccagtgagagcatatagatattttttaaaaaacatattcgcgataaaataaa

SEQ ID NO: 119291 - DNA, 411 bp, Homo sapiens
cacacacacacacacaaccctttcaaatcacaggctggctttccaggattgtttgcagatcaggtggaagccacagtgcctggctaatcaaactgaccaaggaagtgcagggagccaggacaggcaccatctggggtaatgaagtaagaatatgtgttgtgatccagctctgccccagagccctgggcactcctgccccctgtgctaccagctgccctctcctaactacacatctttggacttggctattcagaaacctaaggctattcttgccttaggagagtccaggtttattcagggtctctatcccaatgcgctggggctggaggcagtgagtagctggagcctgcctccaggtcacctgcaccaagcagctgacagggtcttggaagagacagcagcgactacagt

SEQ ID NO: 119292 - DNA, 166 bp, Homo sapiens
gggcagctgttcccgccgttggataaattagaaaactaaggcatggagaggcaaagtgagttgccatggtcacggagtaggagtctggatcaatgggcttgaaccccattcccacccttgcccccacagcagtgtttcactgggctgttccccgagtgaacaaagg

SEQ ID NO: 119293 - DNA, 414 bp, Homo sapiens
ggaggagggtggctgggctccggctgccctctcgtggaatcttggcatgctgctcaaccttcagcctcagtttcctcttccacgaaaggggaaaacagtggctcaggggctggcagttggactaaggagctgacgcctacatggtggcatcgataaacaccgtgttatcgatgccacacaaataattaggctatgtagtgacagtgcacaaatagaaacacacatactgtgcttgagaacatgataaatgccggttttacctttccttccctcacctgaccaagcttagcgagacgtgtggcatcttcctcatctttgctcttcagtgccaggtatggaatcggtccatcatggacaggtgccttattgaactgcgcagagccatgaatgtcaggctgagagttgtgtgcgatg

SEQ ID NO: 119294 - DNA, 325 bp, Homo sapiens
agggacatctcactttcatataactgtgtgttggtggagaagactgagaatagagcaagctataagagggagcttgagcactcatgttaaatttaagatgcctatgagacatccaaatggagatgttgagaaagtggtgggtgtaggagtatggagcatgggatagaggtcaggcagagctgtagatgtaaatttgggggtcataaaatatgcgtgttatttaaaagctacagaactggactataatacctagctaattgatagagaagagaaggccaagaattgagccctggggactccaaagtctagagtccgggaaaaaagg

SEQ ID NO: 119295 - DNA, 256 bp, Homo sapiens
tctgaaattcacataaatgagcaatgtcaatagtttagaaagagtttacttagagaacaaagggcccttatgaggcactagtgagaagaaatggggaaaaaatgagtcctcacaatgtaagccttttcttaaagcgacttgttatcaagcagttcaggatagtccctcaaatctgcattaaaatgcatttcattccattgactcatttgcattaatttctcccattatatctgaaaatggctgaatgtctacccaa

SEQ ID NO: 119296 - DNA, 440 bp, Homo sapiens
agaatgggcaccccttaatgttacaggtgaggaaatggatcagaaagggtaaaagatctgactgaggttgcagagtgaggaagtggggggacctgaaaccacaggactctgtgatgccaaagcccacccagtctccatggagatgcgagggcatctcctctgaagagtgtccgacttctcatgctgacttcagctgggaagagctctaatgacttggtggcaacattatcctacctgcttccttcaggtgtcagtctcagaacaggctcaatgagtccaggagggcagcatgctggctaggcagacctgagtttgaatctttccctactgcttactaatgatgtgtccctggggaagtcatcgagcccctctgtgactcaatttcctcatcagttcagtgagggattcagtctagggcatcagtttttagaccgagagac

SEQ ID NO: 119297 - DNA, 669 bp, Homo sapiens
tgccgttggtcctaagtgccactgtgtgtgctgagtttttcaaaggtcagagcagattgaacctttgtggtttcattttccctgattttgatttttcttatggggaacctgtcttgctgcattcaaggtgactcgaagaagccttcccaaaggcgtgtgaaaaggcagccctactctactaccaaggtgacgtcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagccccactcttgaagcctctgaggagtctctagttcaacaaggacagaggagatggagagaggcagtcaacgtgagggtggtgcacggtggacacctctgaggcagtgaatctactccccatgaggacaccgtacacaaatcactaacgaggatgccctcaacacgatatcactaacgaggacgcgacaaggggcatggccaaagaggacgccgccaaggcatgcccaaagaggacgccgcccacggatcgccagagaggacgcgccagggaatcgcccaggggaggtcaccgccaagaggtgaacaagagcagcgcca

SEQ ID NO: 119298 - DNA, 803 bp, Homo sapiens
acatatctccttctaagggttttagcccagttcatttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaaatccctctggggggggccccttaacgcgggggaaactttatggccaaaccaggggccccggggtccacaagggggggtctcaccacagccgggagttccggaaaaagggggttcctacagattggcggccacacaggggacaggagcagcgatcctccacgttgggggccacacaacacggagaaactcaagcgagaaggggcggaaatacccttcaacaacaaggtgcaacaaaaagtcaaatagcaagcgcgaaaccatcgagggagaacatccggggggggtcacaccccaagtcggagggggaccacagatcattcacccggcggagtccacctaagaggtccctatatccaacgacggcgggcactccagcaccactttgtaggaaaaccacaagtgggtgcgacccccaaacgagcgg

SEQ ID NO: 119299 - DNA, 473 bp, Homo sapiens
caccgtctagatcgtggcttttcttttacttggcttttttttttttttgagttggagtttcactcttgttgcccaggctggagtgcaatggttcgatcttggctcaccacaaactctgcctcccaggttcaagcaattctcctgcctcagcctcccaagtagctgggattataggcacacaccaccacacctggctgattttgtattttagtagagacagtgtttctccatgttggtcaggctggtctcgaactcctgacctcaggtgatcctcccacctcggcctcccaaagtgctgggataacaggcatgagccaccgtgcctggcccagtgtcacccattcttacaccaaataagggtgtcctggaactgtcatggtgttggtggtgtgtgattgagtgcgtcagtgagcagataatgaggtccgaggtgagacctagctcaaatccagctctgcactgggtccggtcag

SEQ ID NO: 119300 - DNA, 213 bp, Homo sapiens
tgtgatttgtgtaaggctttgacatgtcttataatagtaatgctgttctttatagaatttattcaatgtaagggaatacactagtaaagagtaaaacaccaggcacagtggctcacacctgtaatccccacactttaggaggccaaggcagaaagactgctagagccaagcacgttgagatcagcctgggcaacagagcaaaaccctgtccct

SEQ ID NO: 119301 - DNA, 563 bp, Homo sapiens
agagtgctgggattacaggtgtgagttagccaggatggtctcaatctcctgaccttgtgatccgcccacctcggcctcccagagtgctgggattacaggtgtgagccaccgtgcccagcctataacttgctttttattacttaattatatgtccattattctatgctgtctttcaatgtatccttctaagagctgcatggtattctattgatgagtttactataatttaatttaacagttttatattactggacattcaggtgtttccagttttgtgattttgtatttttatgaatacatttatagctaaagttttgctcccaaagatgggaagaaattagaatacatttgtaaaagtggaattgctaagtcatagggtgtgggaattatgaggctttgggtgtgttctaatgcattgccgcttaactgatgtagacagtcaattgttgctcttcatttcctctgtaaaacataccgttaggttgaaagtttatcaagagtcaattgtaatgccagttatattatttttgaaattatataaattaattaaatcttatgttaaa

SEQ ID NO: 119302 - DNA, 257 bp, Homo sapiens
gcggccgcctactactactactgctcgaattcaagcttctaacgatgtacggggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119303 - DNA, 4717 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119304 - DNA, 4692 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccgtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119305 - DNA, 1225 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagggtctccgtgcagcggactcaggctccagctgtggctacaacatagggtttttatacaagaaaaataaagactga

SEQ ID NO: 119306 - DNA, 548 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcgtaagtcttggggttctcgcgggcccgcacttccctccgggccacagggttcccttt

SEQ ID NO: 119307 - DNA, 450 bp, Homo sapiens
gttgggctggtgtacatgtttaacctcatcgtgggcacgggcgcactcaccatgcccaaggcattcgccactgccgggtggcttgtcagcctcgtcctgctggtgttcctgggcttcatgaggtgagaggcagcggggacttccccacaggggccaggagtggagcaggagggagtcagcccaggaagcccgaacatgagggcactgagggggtgggaagacacctgtctaccccgtatcgagctcagtgagtccttgccagggtattcagagaggggaaagtggtcacagaggcctcctggtggcttgtctttgtggagcggttgcacagccctgatcagataaaaacctggacatccactaggctttggaatgtttcacgtgatgctggcctatttcttccctggcaggtttacctccctgctattaaatgtatgctttattaacatt

SEQ ID NO: 119308 - DNA, 1757 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119309 - DNA, 4481 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119310 - DNA, 4658 bp, Homo sapiens
gaagctggtgctggacagctggcgccggcagcagcggaccggcgggagacggcggcttgcgagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcatgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctgcctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaataattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgaaaaaaaaaaaccacatc

SEQ ID NO: 119311 - DNA, 507 bp, Homo sapiens
ggagctggaggcagccctggctcttctccatgggcaccaggcccagtgcccctgcagctcctccctgggccccacctgaccccgaagctgagtctctggcaaagggacatgaattggtgtaaaccgtcgtaattcttccctggggctgggaatgattttcaccctgaaggacatccaggttccactggcagcgggggagtgtggatagaggctgggaggtcatcacaggatgccggctatggctggtccacagcacctcagagagccccagccccatcctccggctgagcggcactcacgcgctgccttctcagaggctccgatgtccctggagcaggcaggagtgctgagggtcccattcagcatcctgagagagggacagcgcacagtcaggccctaaggaggacagggcagagccccgggattccagccccatcccctggggcaagtgattgaaccccatctgtcaaatggggccatccccacttcatagcacccagaattttg

SEQ ID NO: 119312 - DNA, 328 bp, Homo sapiens
agcaccggaggcccccaagagaattctcacactcctgagatgagcagaaggattcgggggtcaccaacaccgggctggctccccagatgctgtgggtgcacacctggcctaaggccctggaatgcgatcttatcgggttctaggtgagacccagatggccccagatcggcttttatccgtccactcctgctaatggacacgggtgctgtctctctgctacgagccaggctgctgccttctgttcctggccgcctcacacggtagcgtccaggtcacccgagggccatttctaggcaaaaaccccagctgtgttttcactccccactgc

SEQ ID NO: 119313 - DNA, 683 bp, Homo sapiens
gctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtggggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacct

SEQ ID NO: 119314 - DNA, 498 bp, Homo sapiens
ccctttgcttccccacctctgaacactggcttgggggcccctgtgcctgggacacccctttcttcctcccaggccctggcccatctcctccaggaagcttgagtgctcactgcagccaccggcctccctgtaagacagtgagttgtctgcgagctctgctctgagccctggcacatggagcgactcagttacacttaatcagctcttagaggcactggctgggcatggtggctcaacgcctgtaatcccagcactttgggaggccgaggcgggaggattgcttgagcctaggagttggagacaagcctgggcaacatagttgagaccccaccactagaaaaaaaaaaaatagcggagtgcagtggcatggacttgtaatcccagctactcaggaggctgaagcaggaggatcaattgggcttggaagtttgaggctgcagtgactgtgattgtgccactgtcctccagcctgggcaacagagtgagaccctgtttcgg

SEQ ID NO: 119315 - DNA, 548 bp, Homo sapiens
ggaaactcaggctcacagtgattaaatcattttccgaatgtcacacgagaacgtaggaggcaggcagaatccggagccagggatccgcccctgtgcctgggacacccctttcttcctcccaggccctggcccatctcctccaggaagcttgagtgctcactgcagccaccggcctccctgtaagacagtgagttgtctgcgagctctgctctgagccctggcacatggagcgactcagttacacttaatcagctcttagaggcactggctgggcatggtggctcaacgcctgtaatcccagcactttgggaggccgaggcgggaggattgcttgagcctaggagttggagacaagcctgggcaacatagttgagaccccaccactagaaaaaaaaaaaatagcggagtgcagtggcatggacttgtaatcccagctactcaggaggctgaagcaggaggatcaattgggcttggaagtttgaggctgcagtgactgtgattgtgccactgtcctccagcctgggcaacagagtgagaccctgtttcgg

SEQ ID NO: 119316 - DNA, 424 bp, Homo sapiens
ggggctgggatgagcagctcgagctgtattctgtggggagaacccatggagggctttaagaactaaagagaccttgtgatttttgcttaaaacgacaaggctgcattgcaggtaaggtctagagtgggagcagtgaagaggctggtgtagatgccccggtgagagatgaagctacagtctgggaattaagggtcagttcttggcaggggtcagaggaagcagagtttagtgggaacagctggaagcatccctgcagactttcagaggtggaccagggaacattcttggccaagtcaaaccaagaatggtgttgggacaagaggcaggagggatatttttgcccctgtggcttcctttgaagttctaagctctacctctcccagatgagcctttccccagggaaaggaagacaaactgtgtctcc

SEQ ID NO: 119317 - DNA, 517 bp, Homo sapiens
agtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattg

SEQ ID NO: 119318 - DNA, 938 bp, Homo sapiens
atgcacatttcacagatggcacagagtggggaagtcagtgacccaaggtggcaagccagctcttgctgatggtgaggagcctcattatcttaagacaacacacagtggagatgtgctttacgtaattggcctgccctgtgaaaacccctggctgttttttcagataaggagactgaagcatctagagttggagtaatttccacaagatcacagagctgaaaccacaggaagaggccaatatggacttctctactactttatttcccctgagcctggtcagcttcttccaaggagattactgggaggaagcttctaggatttctggacattggattccctgctggtttccccacctgattattgaaattgatttctggagttcaggaaaaagcaagtcatcatatatcaacctattatgtgtgttaggctgtttgcattatcacatttaatccatttgacgctgtgaaggagcaggtagtgttatctgactcaagtctgtccttcaattaatctcaccacctccaggattcctttatgctctttgtcaagaactctggtagagcaaagaaaatggggatagtttgtcacgttcaaaaatcgtattgaccaagactatcctctctctctctctcttttttttgagacagagtctcactctgtcaccaggctggagtgcagtggtgtaatctcagctcactgcaacctccgcctcctgggttcaagtgattctcctgcctcagccttccgagtagctgggactacaggtgcatgccaccatgcccagctaatttttgtatttttagtagaatcagggtttcaccatgttggccaggatggtctcgatctcctgacctcgtgatctgcccgccttggcctcccaaagtgctgggactacaggcatgagccactgtgcctggctgataatcctcttttaagaa

SEQ ID NO: 119319 - DNA, 738 bp, Homo sapiens
tggaccccttccttacaccttatacaaaaattaactcaagatggattaaagatttaaacataagacctaaaaccataaaaaccctagaagaaaacctaggcaataccattcaggacataggcatgggcaaggacttcatgactaaaacaccaaaagcaatggcaacaaaagccaaaattgacaaatgggatctgattaaactaaagagcttctgcacagcaaaagaaactaccatcagagtgaacaggcaacctacagaatggaagaaaatttttgcaatctatccatcttacaaagagctaatatccagaatttaaaggaacttaaacaaatttaccaaaaaaaaaaatcaaacaaccccatcaaaaagtgggcgaaggatatgaacacacacttctcaaaaaaaataagatatttatgcttccatttctttagaggtgagtgaccaaggtttggaaaagaggagatgagtgtctgctggagcttagccatctgtggcaccagcgctggtccacataagcagctggccagcggtgcagtgtgaggtagaggggtgtctgtgagtggtgctggaaagagggaagacaaggggtccgggttccagggtccaggtaaggtgaccttggataagcgattcagaccagcctgtctcctacggggcctctgccatcctgctgcccctaaaggcagctgccgtctcccctctggatagggttcacccaggtacccaggtcactc

SEQ ID NO: 119320 - DNA, 463 bp, Homo sapiens
ttggtaaaccctatcttttcactacaagtaaaacacagctgggtgtgttttccatattctgaggccctgggcagttctgtggcctcagctctctccaacttcccttgatcagccactttccagccactggacctccaggtcctccaccaccagcacttgctctcgtgcccggtcattgcactcgcttttccttccatgtggacacttggtccatggatttttacatggctgcctccttctcatgaggcaccttcctattcagctgccagctcctcaaagatacctttcagagccacctgagctaaagcaaattaccccaccacagtcactctcgagtccattatcttgtttatcttcttcagagcattcatcagcactcaaattctcttacttatttgttctcctgtcattgtctatctcctctcactagattgtaagctctctgaggacagaactttgttgg

SEQ ID NO: 119321 - DNA, 318 bp, Homo sapiens
ctatgagcctggacctgtgtgcaaagtgctttgcatggattattccatccagttcttacaacttccctctgagtaggcttcgcatcctcaatctcaaatgagaaaatgagactcagagaaatgaaaacacttacccaaagtcacacagctcataaaaaacagagctaggacatacccagcctccatgcaactgcctggaacatggtgggtgcacaaaacatgttgcctgccttcccttcaggaagcagagagggtgagaaagaactcccaggaaacaggtaaatgctgaactgggggctgttgattctctgcccagca

SEQ ID NO: 119322 - DNA, 963 bp, Homo sapiens
ccctgtctcaaataaacatgaataaataaataaataaataaataaataaataaataaataaataagaagagccttccagagcagtatggaatggccaatgcccctcctccctgctgctcctcctcctgtagctgtttccttctcccctctctccttgcttggaacagccacagcgactctccaaatcatgacactcaaaatgccacttctaaaaagaacatcagggttggtgcctctgcttcttctgaattgacctcccttctctgccctcttctgactcgtcctcccttctcttttggatgtaattctttccagcctccacactcctttgacagaagatgaaaaatttgtatctctgaatcctatatctgcttgtctatgatctaaatactttttgagtcaacaaggtgaacatattcctcatatttcgttatggaatgtttaaaacgtctaaaatacacactgccactgagaaagtaaattcatgcacctacaaagagaaaggaaaggacagccatccaccatttgactactgagtttccacctgcacccttcgacacttattagaactttcatgaaacagtgtgacaactcttattcctatcaaacaaaacagaactttcttccttgtatgtaaagaagtttgcaccctctacaccgaataaggagatgcacagttccaacagttattgtatacatcactgaccatattagtcactcctcaaaatccatcataggtccaccaaatattctgttaccttaagactacattgtaagattaaactccaacaacatgtatatacaacaaatgaatggagagaaaaataaaagtggtgagcgtataatattaatgtgtacatattacaaatatgcaaagctactaccacacttgattttgtaatttatcatgaggccacgacaccttttaaaaaatatatttaaaaaatataaaaatttatttta

SEQ ID NO: 119323 - DNA, 410 bp, Homo sapiens
gacctcgggaccgttttagcaccgtggtacggcaggaggtaaagaagtagaaaacgggccgggggcggtggctcacacctgtaatcccggctttgggaggccaaggcgggcggatcacctgaggtcaggggttcgagaccagcctgatcaacatggagaaaccctgtctctactataaatacaaaaattagccgagcatggtgtcacatgtctgtaatcccagctactcgggaggctgaggcaggagaattgcttgaacccgggaggcggaggttgcagagatcgcaccattgtactccagcctgggcaacaagagcgaaattctgtcttaaaaaaaaaatcccatcaagagctttattgtctacttggcctgagctgctgtagaaaaaactgatatcacgggtgtaccc

SEQ ID NO: 119324 - DNA, 344 bp, Homo sapiens
cccataggctgcttgcagaggccataggctgcttggagaatggccgggagtggttgcccagcatgcttggggcccacgggcctgagaggatgccctgcctggaagccaccctgcaggctcggcctccctgcctcccttggagctgactgactggctaattagggtggctggcctgagtgttgtggggtcagcagagcatgaactagaaaaacctgtgaccagcaggcagcagccacacacaggggccatcagcccccagggggcaagggtggcagctctcctgagtgacaggtttggacagggaggggccgtgggcagtaggggagccacagagctggagggca

SEQ ID NO: 119325 - DNA, 333 bp, Homo sapiens
ctggcagcgtgattgtcctccagggcaccagagggtccaggccttggcatgccccaggtggcacatgctggggcctgctgttggctcactcagtgcagtcttggcctgtgggtggatggggacatggcaaggcagaaggcaggcagtgggtaactaagaacccccttggacatcattcaagttctctccaagtatagcagagtcttagagacctgcgttcaaattctagctctactattcttcagctgtgtgaccttgacaagttacttaacctgtctgaacctcagttttcattaaaaagtgtttatgcctataattccagcactttgggag

SEQ ID NO: 119326 - DNA, 190 bp, Homo sapiens
ctgctaaacctgcacttctggagtcttgtcacattgcacagctccctgccactggataactgtatatggtacaatacttaaccacacaacaacaaagaaactgctccccaggtgacaccagctgttccaggagctttttttagtatcacagggatgatgctttactttcaggcaaacaagtattcaacat

SEQ ID NO: 119327 - DNA, 694 bp, Homo sapiens
ttccagcctgggtgacagagtgagactccatctcaaaataaaattgtacacataaacattgtacgcgcgcacacacacacacacacacacacacacagatgatttgtgtgacatcacattttgtcaactttttagattcacctactaactgtcctgtaagaaagaaatattttcaaatacctccacttccaaacattaaaactatggctggtgtggtaggtagagccatatgagtttctgttactgcaagagggtgaatcacagtatatttcttaaaggccgaaccatagaggatggatagtggttcacagtatggtacacaaaagatagattgtggatgccagcatggtatgtggaggactaatcgtggctcacagagtagatttctttttattccacataatcaactctgttcttctttccagagcaacaggatgtggtagaaagaatcctagattctaatcagaaacagcctttctctatgtcagtgtgttcttggtaactaacctaacctcactgtgttcttgggaactaacctaaccttggcctagtttatttgaagttggcaatttcagtaatgtttttagatctaacatagccctcaatgaatattagttaaatggacctgaaaacactttggaaatcacaaaatattaaatcccatattttcatactatgaatatattgtttgctc

SEQ ID NO: 119328 - DNA, 432 bp, Homo sapiens
acccggaggtggactgtaaagttttacttccctgagaagcatcctgctatttactcttaccttggggaaagaagactttgaaagctatctcctctatcattcatcagagaactaagattaaacaggttgcctcagttcctatcattatgctgccatgacacctgagattcaatttgctctctccatccctgtataacagaaaaggctttttcaggtgcatattttatagcttgggcttaggtgcctgtagaattgacttaagtatctttcgccacagagagcaggggctttgggaaaggctgctggcagagtatgagcaaacccagtggaggagggtggagactggggggtgccaggacacgtgtacaaagaactccagggcctggaactggcaacatagccatcagggttctctcagtcctgatgcacacg

SEQ ID NO: 119329 - DNA, 430 bp, Homo sapiens
agtgctgggattacaggcatgagccaccacacccagcctactattcctacttttgtaaatgaggaaactgagactcagagatggaaggggatccggcatctctgtgtaggtgagcagcacctgtccagactaaccagcccctttggccaagaacaaagtgttttctgggccaaaagccattctgcccaagggagatggatctcataaaccaatttagtgctaaagttgtgactaaaaaattcttgataagatttttagataactttataaaacatatatgtaatatttttcaagctgttttaaggtattttgtaaattggtctgatctatttctgttcctttttagcatgcttttcttaaatgacatgattatctagaaccccttatcagcaagaactaacattgtttagcacattcctagtaactttcc

SEQ ID NO: 119330 - DNA, 899 bp, Homo sapiens
atgcggcagcagcgtggcgtgtacttgagccgcacgccccagtagcccagctcctccaggaagcggcgcggacacagcccgtcgagcaccagcagcaccccggacaggtagaaattgtagaccagctggaagacggccgggtcgcggtcgaagaagtattcgtctgtctgctcctcgtagtcgtcgcacaggcttagctggcggctgcggctggtggaggtggccaggcgacctaggcgcgtcttggggaagccggccagctcgcagtagtccagctggtagctgtggccacccacgttcacattcagcgtggacagcagggccggagggtcgctggggccctcgggcttggcggtggtgacctcccctgcctgctggtcctcttctgccaggtcgtccttccactggtcctcctcctcgccgtcttcgtcttcctcgatgtagtagttatagttgccctctgtccagccgtggatgctggcctgggagccggaacgggcacccagggagcaaatgctcctgcggtgttggctgccctcattctccgtcgtgttccagggcctgtagctccaggaccgtctcctctcactctgtttgagcatggctgcggaaagtggacgcctagctttttcctcctggctgtggtaggggtccctcacctgctcactgcctctaggaggatggatcacgtggcctgcactgtcttagagaggccagcccggaccagcacagctaggggctcagacattgccaccggagctgccccttctcaggtcctgggcaggccagcccagcctgcagggtctgaacgcagtcagctgttgactgctctaatcttgctgatttggaagaagcaagtgttaggagggatttagaacctcttagcccatttcctcccc

SEQ ID NO: 119331 - DNA, 452 bp, Homo sapiens
cccaaataatctatttgcatttggatgcttgtctcagagtggtttctgcaggaaaaaacccaagatagagagacaacactatataggcatcgatgtatttctggggtgactctctttcctccagacctctcctgcaaacaacgcaggggagccacgcaaaggaagaggtttccacacctgggattgatactgctgggactccagggcaggtgctctaaaggactcttagaatttcatttttaatgtttaatatttggtccatctagaatttatggtggaaggtgtgaggtagacgttgcacttttttttccttccaaattgctccaatatcacttactggaaattgtgctttgtctgttaccactctcttctaatctgcctgtggcctgttccttagagtgtatcacaaacatacaagtgatcaatttccaataaattgattaaagaattca

SEQ ID NO: 119332 - DNA, 361 bp, Homo sapiens
gcacgagcacatggtgggtaacaacacacactgggcacctgtagggttggggaagagcatcaggaagaacagctgatggatgccgggcttgatacctgggtgatgggataatctgcgcagtaaaccacgatggcacatgtttatttatgtaacaatcctgcacatgtacccctaaacttaaaataaaagtcaaattaaaaataagaaaattgaagagtatgaccatgaggtgggatgagggagagttctgggcacccaggttcagaacagcttttccacagtttcagagctaaaccttcatggtgtctctgaatgtcttcatttgaatcaaatgctccaaatcagcaaacacccaagatca

SEQ ID NO: 119333 - DNA, 197 bp, Homo sapiens
ccagcacatcaaatgaccagctcattctcactcttcaggcttcagctaaaatgtcagatgccttcccctaccactcctatttaagtcagttctccccagttattctggcatgacttacttccttcatagcatctattatggtctgtaattatcttgcctttttttttttttttttttttttttttttgagacagcgt

SEQ ID NO: 119334 - DNA, 755 bp, Homo sapiens
ggagaggctgaggcaggagaattgcctgaacccgggaggcggaggttgcagtgagccgagattgcaccattgcactccagcctgggtgacaagagtgaaacttcatctcaaaaaaaattataaagaaataatatcagtgactagttagtatgtttctgtagggcttagtacagacatgtattaattcttctaacaacttcttgaggttagtacctttactccttcttatcgttaagaaacctgatgcttagggatgggcacagtggctcacgcctgtaatcccagcactttgggaggccaaggcggcaggactgcttgagcacaggagttcaagaccagcctgggcaatatggtgaaaccccgtctctaccaaaaatataaaaaattaggcatgatggcacatgtctgtggctccatttgttagggaggagggtgaggtaggaggattgtttgagtcagggaggcagaggttgcagtgagccgagatcgcaccactgcactctggtctgggtaacagagtaaaaccctgtctcacacaaacaaaaaaaagatataaaagaaacctgatgcttagaaaggtaaaaagggccaggtgtggtggctcatgcctgtaatcccagcactttgggaggccaacattgctcaagtcccagagttcgaggctgtgatgagctatgatcacaccactgcactccaacctgtgtaacagagcaagaccctgtctcaaaaaaaagacttggactggttcaggtcaa

SEQ ID NO: 119335 - DNA, 301 bp, Homo sapiens
actaaaaatacaaaaaattagccaggcatggtggcacttgcctgtaatcgtaggtgctggggaggctgaggcacaagaatctcttgaaccctggaggcggaggttgcagtgagccgagatcactccactgtactccagcttgggtgacagagcaagaatccgtatcaaaaaaaaaaaaaaaaaggaaaggagaatatggatggtatatatggggcagtattttgaatgactgaagagaaagatatatttagggcctgattttatggtgggctttacaagctatattaagaaatttggcata

SEQ ID NO: 119336 - DNA, 380 bp, Homo sapiens
gaattctttgtgcattgtacacgactgaggaagagacggcagtaatatattttgaaaagaggaaagtgtaagataataatggagattctcccaggaaaagtgggatacttaggaactttaataatggtaaacaatcgaaacatattttcctgaaaacctatttacaatgagatacataaattatacaacacaggaaaatactccagagttttcctgaaactctcttcaagtcacactcagctgggagcccctcaggaagcagttgggaggatgaagagaacagcaagaagaccgtggggaatgtggatagtctggataagctggagtgtagattcaagctgaattcctacaagatggtgtatgtgatcgtggggttgtaa

SEQ ID NO: 119337 - DNA, 315 bp, Homo sapiens
gaattctttgtgcattgtacacgactgaggaagagacggcagtaatatattttgaaaagaggaaagtgtaagataataatggagattctcccaggaaaagtgggatacttaggaactttaataatggtaaacaatcgaaacatattttcctgaaaacctatttacaatgagatacataaattatacaacacaggaaaatactccagagttttcctgaaactctcttcaagtcacactcagctgggagcccctcaggaagcagttgggaggatgaagagaacggaaagcaggggctggtgcggagcatggggagat

SEQ ID NO: 119338 - DNA, 187 bp, Homo sapiens
ctatacaacttatctgattttttaaaaatcagatgcctcttttcttagattatggttttgaaaagccaacccagaccaaattactttttccatactccagcacaacttggctaaattttaaagcacaggttgttttttatgtaacaagaatagggaaactttactcccatttcacatgaaatgacaa

SEQ ID NO: 119339 - DNA, 683 bp, Homo sapiens
ctctcatatataaatcaaccaccaattcctgctaaattctacctccacgtagttttcactttgtcgccgattccttgtcaaccctcatcatttgtgatctacctgctattgcaatagcccccaattggcccctcctaaatccatgttgtacatgatagccccagtgatcaatatgtaaatgtggtcacactactccctgccttgaacacttttcaatggtaccccacggcctagataaattcatcaaaaccgctcagctgtactgaaaactggcagacactattaggtggttcacttagtacccactcctgctcccttctagcttgactatcttacagctacatttcccagactccctagcagctcagcaatccacgagacctagcttcttcctagcagatgctcccacacaagacttggggtagaaatgagcaacatgagataacgactgtgctagaaatctggtctttgggcaagcacggtagtagaagcatccagttcttctgcagcactgtgcagaggtttcactatgacagtcacatgctgcatagatctatagctgctctgctctttgctgagcagcatctgagcttggctcactggctcttccccaggttttgttaaggtacccagtatcttataataaacccctttctgcttaaaagagtggatgaaaagtacac

SEQ ID NO: 119340 - DNA, 504 bp, Homo sapiens
  misc_feature (1)..(1): n is a, c, g, or t
ntgactctagcaggatctccacactgggttcgagttcatgtcattgatgggaagtgattatcattgatttatcttaagagagcagggagtgttctgcatgaaaaattaaaattacatgagagaaacagttgtaaaatgcaagatacgaaagcctattaatactgactagataggccaggcatggtggctcatgcctgtaatctcagcattttgggaggccgaggcgggcggatcaccaggtgaggagttttgagaccaccctggccaacatggtgacacctcgtctctactaaaagtacaaaattagctgggcgtggcggcacgcacctgtcatcccaactactttgggaggccgaggtgggtggatcacgaggacaggaaggagttcaaggccagcctgggcaatatggtgaaatcctgtctcttctaagggtgtaaaaattagccgggcatggtggcgcacctgtggccgcagctactcaggaggctgaggcgggagaattg

SEQ ID NO: 119341 - DNA, 303 bp, Homo sapiens
tttgaatcatgtccaggggctgggtagggtggttcatgcctataatcccaacagtttgggaagctgggcagagaggatcatgagcccaggagtccaagaccagcctaggcaatatagcaaggccttgtctctactaaaaaataaaaataaaaaatttagccaggcattgtgatgcacacgtatagtaccagctaccgaggaggccgaggagggaggactgcttgatcccaggaattctagattatagtgggctatgatcattccactgctctccagcctgggtaatgaacaagaccctgtttc

SEQ ID NO: 119342 - DNA, 245 bp, Homo sapiens
gagagagagagagagagagagagaaaagaaagaaagaaagaagaaagaaagaaagaaagaaagaaagaaagaaagaaagaaagaaagaaagaagctacaacaaaaaccccagaaccatcttttttcaaatagtcccttgaaaagaaaactataaaaaatttatgttaagattctgggtctttgaattactcatcatgagcacttttcctgggcagtatctcccatgttcacccttactcgtcaca

SEQ ID NO: 119343 - DNA, 269 bp, Homo sapiens
ctgcttgtcctgcctctgaagaccaaccacacgcgcgcgcgcgcgcgcgcacatatacacaaacacacacacttaggaatttgttttacaaaaatgtgatcatattataagtattttctccatcttacttttttcaatagtatctcatcaaaatccttctaaggcaactagtatagctctaatggacttctttaatgggctacatatgacatgatatggatgtatcatgattcaatcagccattcagtcccccagtggcagtcctttac

SEQ ID NO: 119344 - DNA, 261 bp, Homo sapiens
ctttggcctctgagctttggcaggtccttgcccaggcttgcttggctgcccccaggggtggcacttccacaccctcccagtcaccatagccctgacctgtcgatttgccagacagttttctttaagtccatttaaaaatgactcacctctttgatcttggcctcccaaagtgctgggattacaggcatgagccaccgcgcccaccagccttggcccatttttactgggctgtttgtctttgcccctaagttcagagccagg

SEQ ID NO: 119345 - DNA, 310 bp, Homo sapiens
ccccaggagcagtggcaggtactctgtccaaagcaagccacctgccaatacagaaccccaggttatggctcctcttgggcgcaagttgttaacagctacagcctctaaaggccagtttctctttgcttcagtgcccaatgcagacctcgagccttccagaggccttggactcttggacttagacccttggtagggaggaccctagcaatgggcagtgggacacaatctcagaggtggctctgccctgacaggtcctcatgtctgcatcatgggacacacttctgaaagcactctgccttctaagagctcc

SEQ ID NO: 119346 - DNA, 177 bp, Homo sapiens
ctctggagacatacatactactgcctagtaggacttctaagagaaagccagctcgatgccattgggaacagcacaggaattagaaggaggaagccccagcttcagtgatggtcttcttgctgtctcatttttatcagagtgattcactgccctctctggccttcatcatactcattt

SEQ ID NO: 119347 - DNA, 778 bp, Homo sapiens
cgcagtggctcacgtctgtaatcccggcactttgggacgccgaggcaggcaggtcacgaggtcaagagatccagaccatcctggccaacatggtgaaaccctgtctctactaaaaatacaaaaattagccgggcatgttggcgcatgcctgcagtcccagctactcaggaggctgaggcaggagaatcacttgaacctgggagacggaggtcacagtgacccgagatcacgccactgcactccagcctgatgacagagcgagactccatctcaaaaaaaataaataaaataaaattgtaagtgtacatactccttaacccagaaatccaacttttaagactatcctataaaaaaaagggcaacaataagaaagaacatatgtttattacaggatggtttataatgacaaaccagaaaactagaaccacctaaatgcccatcaatacgggaatggttgaataaatagcagcacatccacgccatggaaaattaagcaggaattggagccagtgtattaatttagaacaatattcatggtatactgatatgtaagaaagcaaggtgctaggtgatgatcacattatgactttttaatttttaaaggaaaaactctacgtattataagcacttatgtttgtcactgtaaaggcacagaagacctttctcatacagcaaactaataacaataacttcttcagatgggggaaggataaatttttcctctatattatttgacttattactgtttgctcattgtaattttaaaattcccatagat

SEQ ID NO: 119348 - DNA, 220 bp, Homo sapiens
tgaactttctcccttcccaggctcctcttctaccaggccacccatccagtcctgtcaaatgtctccatcagctctcacctatcctctcctctccatgtcttctgtggctaccctcgtgaagactattattgcctggattctagtgctagttttccaattattctttctgcttcctttctcagtctctcttacacactgctgccaagttaatctctgaagc

SEQ ID NO: 119349 - DNA, 158 bp, Homo sapiens
tttttctggttaatagactcaagcctggggcagaatctttcatcagctactaaaggtttttttatgctttactgcacccagttttagaaacgaaggtgttctattatgtattacgaatggaatcaagggtttgctcttcatgtgacatcagctactca

SEQ ID NO: 119350 - DNA, 295 bp, Homo sapiens
cagtctggctgcccggcccccacactcagcccagactgagcccccactggacttgcccggtcaggtagaaaggcctggtgcacacacatgtccacacctgctgctcagcacccctcacaccctgccccacaaggcctccactgtctaaaacggccctggaaccgtgaccaaaaaaacagttagatggaagccccctcggctgggaggggatatctgaaggtcccatatccgtctctgcctcatcctaaaggctgggcagtcagtgaggccccagagcctccgatgcctgacagag

SEQ ID NO: 119351 - DNA, 195 bp, Homo sapiens
agcagaagtgtcattaccttgcagctcatgtcgacaaaaagctacactgcacatttctcttaggctgctaagaggaaggaaacacaaaacacacacacacacacacacacacacacacacacacacacacacacacacacacagaggcctcgttttctgcatgtaaaatgtgtgtgttctttaaaagccagtggt

SEQ ID NO: 119352 - DNA, 192 bp, Homo sapiens
atgaggggactgtagttccaggcataggcaagagaatatgagtttcgagcaaaaaggagcttggcatgttctgggaatggccagaagccagttgactagaacactgtgatgaaggcagagtcatgaaggatgggagtagaaggataggaatgagccactttggctgggcgcagtggctcatgcctgtaatcc

SEQ ID NO: 119353 - DNA, 698 bp, Homo sapiens
ggtgtaccattctacattcccaccagctgtgcatgtctgctccacatccttgctaataattgggagggttggtcatttttaaattcagacattctaataggtgagtagtgatatctcattgcattttaaatttgtatttccctaatgactaatgatgtgcctttttatgtgcttatttgccatctgtatatcttctttgatgaattgtttttgaaaacctgttgcacatcttttaaattgggttgtcttcttattattgaatttttgagttttttttttaaactatatattgtggatacaactcctttatcagatatgtgatttgcaaatacgttctccaagacagtggcttgttattttggtgtctttcaaagagcagatgttcttaatttcagcgtagtccactgtatcagtttttgattttatagattgtgcattttgtgttgtctctaagaaatatttgcttaactcaaggtcacaaagattctctcctatattttattctagatgttctataatttcaggttttacatttatctctatgatatcttttgagttaattttatagagtaaaaggtatgaatcagtttatttttgcatatggatatccaattgttctagtatcttttgttcaaaagactatcttttctccaatcgtctttgtgcctctgttgaaaatcaattgaccatatacacat

SEQ ID NO: 119354 - DNA, 455 bp, Homo sapiens
tcatactcatcttgatattccccacagtgtctagcacagttacttgcacctaacaaacactcaataaataatagttaattgctaaactggacggtgccgacttgtcggttttgcatataatccgtgactagctaggaggcagaaggggagacagataccggtggagaacacctcagtgtgctagttgatccatataagtaacttatacaaagtgttatacttgttgagccccgatcaaagttctaaagctgattaacttggaatagtaaatcctattcattacacattctaggttccaacaaccagattttacagccttaacaaagatgtccagagtggatccattctgggggtaggtggtgatgggatggctggggtcacagagaatagaaagatgactaataataagaccgttgttttaccagtccagaaaaaaatgggaacttagaccaata

SEQ ID NO: 119355 - DNA, 112 bp, Homo sapiens
gcacagggtctgagcagagatgtgtgcatagctgggaactcgagactgaggcctggctttgtggaagacaggcaggaagcaggaagcagagccacagttttattagagttcg

SEQ ID NO: 119356 - DNA, 732 bp, Homo sapiens
cttgtgtttttagtagagacagagtttcaccatgttggccaggctggtctcaacctcctgacctcaggtaatccaccccccttggcctcccaaagtgctgagattgcaggcatgagccacctcgcccagcctaggttcttttattacagcttttttgcagggaagtttgtgtatactagcaaccttaaagatatttacccacattagtacagtaagttcataatgtaagtaatcaaagatatgcaaaaagatttctcttaaaaagtagtttagcctctaacaggtaaagcacttggacgttgtgaattcctgttagattcatcagagaattgaggtcacacttgagctggaaactgaaggcaagcagatccatagagtcagcttactaccaacagaaacctctaagaacccaccactggagccagcttcaggtaggaatatttaaagggtaattaattgctggaatctgagtgtgaactagcttgagagataacaactcctgaagagccagccacggagaagcccatacgcttttgtgagttttaccttgaggaactctgccaggttctcacagtgaagatctaagaaaaatgttctcccctcttcctcattgggagggaaaagtagccatttttagatactcccagagcatttcattctccttaacaaaggcctgcacagaaaggaaacttttttactggagcccagccaccctagggggatggtcgattc

SEQ ID NO: 119357 - DNA, 243 bp, Homo sapiens
tcacacccacatgccacacaccaacaaatccatggtcttatccacttatgtctaggaaggcctagagctacttctgggatgaggttggtcctgggaagggaaagccaggaagtgaggctgggagtctgagggcaagtctctctctccctctcgtgccaaaccccacgttcagccctttcaaatagttctacccttggaggaggttaagaaagaggaaaacggggacgggcgcagtggctaacg

SEQ ID NO: 119358 - DNA, 638 bp, Homo sapiens
aggagacctaagtctatatatttaaaggacatattctgttaacactactggacttgaaatataataaaggactcctcaagcaggcaaaaggttaaagacccttctaggggaagaaaaataaggtcatccttattagctctacattaatataaaatgctagagtgttttgaagcaataaccacaacctgtaaagaatatgatccctaaattttctacccagataaactgtaaatcaagtaaaaagcagttgaaactgtaagggaatactacttttgcttttcagattggcaaagatcaacaagtttgataatacactatgttggcaagaatatggggacacaggccaggtgcagtggctcatgcctgaaatcccagcacttttggagctgaggcaggcagatcacctgaggtcaggagtttgagaccagcctgaccaacatggtgaaaccctgtgtctactaaaaatacgaaatttggccggtcgtggtggcaggtgcctgtaatccagctactggggaggctgaggcaggacaatcacttgattctcttgattctctgcctgggaggtggaggttgtagtgagccaagatcgtgccactgcactctagcctgggtgacaagaacaagacttcgtctca

SEQ ID NO: 119359 - DNA, 392 bp, Homo sapiens
tttttgtatttttagtagagacagggtttcaccatgttggccaggctggtctcgaacttctgatctcaagtaatccacccgcctcggcctcccaaagtgctgggattataggtatgagccaccaagcctgacctgtttggcattttctaagttccgggaagatgttattcacaactgtcaaagtactatcataggaaggaaaaaaattggaaagagagattggattcagatcctagaagaccttacttttttggctaagaagtttggtctctattcagcagacagggaaaatcaataaagaatttgtaagatgccatttagctttgaattcttcagaggaaaaacttgagtggtacactcaagttagtttccatgtaaactttgtgatataa

SEQ ID NO: 119360 - DNA, 183 bp, Homo sapiens
gcttttaggtgaatagtattgtcatgattgccatcgctactcaagtcacctgccgatagccaggatgtcccacctcagttaagctgcccggagaggccaagggaatggaagctcctactcctatggagacactctaattgtggaagcaaaaggggatataaaggcaatgtcttaggtctcaat

SEQ ID NO: 119361 - DNA, 516 bp, Homo sapiens
tacagtagtcccccttatcatcatcccgtgtgtatacagtagtcccccttatcctcatctggtgcgtatacagtagtccccccttatcctcatccggtgtgtatacagtagtccccccttatcctcatctggtgtgtatacagtagtccccccttatcctcatctggtgtgtatacaatagtccccccttatcctcatccaatgtgtatacagtagtccccccttatcctcatcccgtgtgtgtatacagtagtccccccttatcctcatctggtgtgtatacagtagtccccccttatcctcatctggtgtgtatacaatagtccctcatcctcatcccgtgtgtatacagtagtctccccttatcctcatccggtgtgtatacagtagtccccccttatctggtgtgtatacagtagtccccccttatccggtgtgtctacagtagtccccccttatcctcatccggtgtgtatacagtagtccccgcccgacggtcggggggttccataaggg

SEQ ID NO: 119362 - DNA, 323 bp, Homo sapiens
ctggccggcactgtgtgtccagacccagcgtcccagacgtgttggggccaccagaggaatgtctgaaaccagagccattccaaaaacccgaagcctggggttttccctgccccaggtcgggctgagctcatggctgtgagcaggagctgtgggtcctgagggaggaggcggtgctcagcccctggggaggcagcagggaccaccactgcgaagcctgcctgggcaggcatcccccatgagaggcaggcagaaagcccagactccagagggccacattcctgacttggcttcgatttggagctggtggtggtggtctctctctg

SEQ ID NO: 119363 - DNA, 692 bp, Homo sapiens
taaataaataaataaataataaaagtgttttacgcaagtttaaattagttgctaacacttaaaaatggagagatttcaaacagtaacctagatttccagcttctcttgaaaataagtatctggcaagattgggttaatcatcgaataaagcagaaacaggctggagccaagcaatagctgactccttcggacagggctctccacttggccacagcacaaatccctccaactccctaaagattcctggctcactgttctgttttctcggtaataatttagggtgtcctccctgccgatctcagcacctttactcccagatacatatacagtcttggagtcttctgtctgaactgtgtacgtatctttccggggtgctagaaacattctgtctcttgatctattagtcacattaagtatatatatatatatatatatatatatatgtaaaattcattaagctatacattttaagatttgtacactttactgcatgttaaacctcaactttagaaaattagaaggaatgaatgggcaatctcctgccagacattctctgtatgtgtctgcaatggctggaactgcagcaatcttgtgaccatgaggtaaactacccaacttagtcccatttgttaaaaatggcagaacagtgagatttatgatgtcaccaagggtattaaattaaccaaacacga

SEQ ID NO: 119364 - DNA, 465 bp, Homo sapiens
aaggaggcaacatcgacggaggggtggactctgggctgaaagaagagcatgggggaacacagcattgtttgggaaataaacaaatcggtgggtggagctctgaggtccctgtgggatgatggggatggaggcaggagaggcaggcagagaccgtgaaacctaccacccaggcccaacttcaccttaaaggtcatggagagccacggaggatttgaagcaagggagtgataaagagccactcagctagggtccaaagaccaaaacactgggatttagggaaaaggcacagataagatcaggtaccacaagagagggccagtccagcaggttggggaatgcacaggcctagggcttcagggaactatcccgggtgcagatacagatcagagctgccctgctcagggtccatgctggagttctgctgtcatgagctgtactgtcccctcaaagctccagcgttgaagc

SEQ ID NO: 119365 - DNA, 635 bp, Homo sapiens
attcatatgaatactatttgaatgctaacttggctaggtattgaggatatagtagtgaacaacataccaatataatggataatatattctaatagaaaacaaatgaatagctagctaacttaaacaatgatatttatgatattgggagagaaaaactataggatgctgacctgacctggtcatgagaatggacaagatgtcactgtggttaagatggtttaatttgatatcttaataatgtgtaggagtatggtggacaaaagaggagaaatttggggtgggaaaccatcatgtcaaggccttgaagcaagaaggagtagagggtagtccagaaactaaaggtccagtgtgactaatatatagagacagcagtatgtaaattatttttaaggaaaattccaatggggagaaacttgataaattccttgcagaattgataaattgctctgtagatataataaacctatatgttaatagtgaaaaaatatccgtcctgttgcagtctcaaaatcaaacaggttattatttttaatgtcactactttgattgcaaaaatatctttacttcacatatatttgattactagtgaagttaagcattactacgggattaaccaatagcatatactttttggg

SEQ ID NO: 119366 - DNA, 1553 bp, Homo sapiens
gaggacagatgggagaggagcacggctgggggctgaggcccagccggcaaggagagcgtggagtcactgtgaaggaggggctgcggctgcagagacgctcaggatccagggatgggtctttgagcagtgaagaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaatta

SEQ ID NO: 119367 - DNA, 1581 bp, Homo sapiens
cttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaatta

SEQ ID NO: 119368 - DNA, 383 bp, Homo sapiens
aaagtttcttttcattttgagcaaagccatcctaaccatcagaagcctacggaatacctccctggcataattagctggtcctgaagtctggctgaatgcaaacgctcttccttgtgaccagggcggccgggggctctgtgatgaggcatgatcttgtcagcttaacgaggcccattaatagtccactggcgtttctattttcaaaattgtcttctgtgtctaatggtattgaggagccacgtgaaaatcacttggtgccctctaaatgggattctaaatcttctctcctaggagattacacatgctgtgacttggttgtaaaaataaaggaatgtaagaagagtgaggaccccaccacacctgagccctccccagcagcaccc

SEQ ID NO: 119369 - DNA, 944 bp, Homo sapiens
tgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaacccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaatta

SEQ ID NO: 119370 - DNA, 1589 bp, Homo sapiens
tccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaatta

SEQ ID NO: 119371 - DNA, 605 bp, Homo sapiens
gagaagactagataagttatggtgtatttatacaaagaaatggtttatagctgagtaagaatggttttgagaagattaccaaaatatgtacatgcaaaaaggaaggtgtagagaagcatatatattgtgccactttttatatagaataaaaggagaggggataattatttgtatatgcagaaagacatcttggaaagttatatataagtaaatgattcctaaaaatagttgtgatagaactgggcagatgaaagagagcgggaaggagactttcactattaattttaatgttttaacattttatgttttctactatttttgagccatgaaaatgtattaagtattcaaaaaagaaaaatgtgagttcctatgtttaagaacatcgtggtgaaatactagtttatacatcataagatcttcaaattatttttatacaatatcttatgtaagtactgatattgccacacacatactttttgataaaattcacaaagtaattcaaagagaaaaatcactccgtttcatttattttccttctaacatttgtgttgggagtctcatgtaggaagaaataatcccacccaaggtgaagtatgtaatattaa

SEQ ID NO: 119372 - DNA, 716 bp, Homo sapiens
gggagataaaaggttgattgttgcctccagtagaataaaggcttaatggaatgttatattaatcagaatttgtgtccttcagtgcatattactcatttcttgtcataaatttgttgaattaaggttaataagttcccagaaattaagctttggtagatttggtatgctgagattgataaatcttcagtactttttcaagtgcagtgtttaataatgggcaccttgatagcagttaggaaataatgtagaaattcatgagagtgggcttgtcaaagtctacgtaagaaagatacttttccctcatatttccaaattgttctttggttgttatgaagattgttcccttagccttcaaaataacttcaagccaattagaatgatggtttaatattttcaaatgtcattgctattgagttccttcatacactgtgtgctttacgcatagatgtttcaaaggtaaatttctaaatgtatttgcaaaactaatgtagttggcccctgatagtgtggtgtaggaatggttttcataaacatttcagtagactgttttaaagcctggctaaaaattagtcagaaaaagaagtgggaaaagggtgttcatggagagaaaaaatatacaaagaacagagttaggaaagaaaatgatgtattgtaggaagtatgagtagttatgtggctgggcacagggggtgactgttacgaaataatgggaatgt

SEQ ID NO: 119373 - DNA, 360 bp, Homo sapiens
ttgcagctaaatgcagctgactgagtgatccaagacactaaggagcactaagacgctaagaactgtccagcgggacctgccaaaattcctgggtcacaaaattataagcaaataaaatggaatacagcatgaccaatgccagaatcataaagaaaaagatcaacaaattaatttcataagatgtttagcaggccgggtgcggtggcttacacctgtaatcccaatactttggaaggctgaggcaggcagttcacttgaggtcaggagtttgagaccagcctggccaacatggtgaaaccccgtctctactaaatatacaaaaactggccgggcatggtgacacgcacctgtagtcccagc

SEQ ID NO: 119374 - DNA, 780 bp, Homo sapiens
ttcaaatggcttcaatctgggatattcctactttcctgtgttactattctgtatgctaccaatcaatgtattctgaagatataaccactctgtttctcctcccctcatggccagctctgtaactcactcattttagaatgttcttactgcctcacctatttctagtataagtgccatttttaatagcattcacattcctcctctacgaaacagctccttttgcttcagacttaagtttctcttgctagtggcaataatagttgcggttgaaatttccattgtaaactatacttttagttcatggtgccatttaagaaccgttagctcattctgttgaaataaccagtggctgagctggggggaaaagttttataaaaagactatctgctcagcccagagcaaattctaggtttggcaacttgtcaattatttgaaagccaaactgatcccgatgggaattttaaaaacactaaaacattctcttcttctgggtgggtcctctccagcaccttcagtcttctcttcccagctgcgtttttttctatcactaaccagagtggtaactgagggcaaggtctcttgcttttaagaaaagtcattttcttgcccattctgtcttctatctcagccccatttcttctcccctttgttggcaagctcttcaaacacatgatatcaacgtttgctcttcctgcttctagctacccattcccttcagaactctggcaaaacaaactggcttcttttgaaactgccttcttaaagggcaacgggataaaa

SEQ ID NO: 119375 - DNA, 473 bp, Homo sapiens
aaactatacacaccacataagccaatgaaattaatgtttgtagagaaagtaatattaacaagaggggaaaacactttacattaaaactttcagaaaatgaaaattctacctaatcttttccaaattatactgcttgttctgcaacattagattatctaaatagttttactgggtatactacaagagtagacataaagataataatttagagaaaagaggcaagcaaaataaaaagcttagcaggcagggatggtgaaaaaatataaaacacaagaaaaagaacaaagctgggaataaaggaaagaacaggtaaaatagattgttacacggaataaaaattgtaatataaatacagttcatttgtcactaaggtaaattctcaaattttcagttaacaaagtatttcaaatgtatacattatttaaaaaatttaaaatatggtttacttcatggcaacttttaaaatgagatac

SEQ ID NO: 119376 - DNA, 330 bp, Homo sapiens
tttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatg

SEQ ID NO: 119377 - DNA, 767 bp, Homo sapiens
aattgaggggtattaatatttttagtctgtctatagattacctaagtaatcgatttcttgttctaccaaatatcaacagtatctcttaatcctgcactgtataagataaggatattaaaattattcctactctgcagttccccctccagcctatcgcttctgtcatccatgcgttgacttttaaaatgacaaggccgataacatttgtattctatttgtaaccataccaagccctttttgaagctttttctagagattaactctaaaatttgaagaataacaaatagtgttttccattattgggatgatgtagatattgttcactgaaggccagggaggcaccaggactccatcaactttcttgtacatgtttctttctttttctggagcttctagccatctttttccccttgtttcctctattatagctgtatctatttccctgcctctccatcggtcaggcattccctttagggtttctcttcatcatcttgctccagtctggctgccctcttgctgggtcatgtggctgttgttttggggcttcttttctctgccttctgaggttggattcacctttgcttagaacctatagcttcttttgtgtttacttcttccttttacttccacccattctcaagtaaataccaagaagtgacaggtgggaggtaaggttttgagtccttttgtgtctaaatgactggattcttcccttttacctgattgttggtgtgacgggttgttggattgttgtttggactgttggc

SEQ ID NO: 119378 - DNA, 342 bp, Homo sapiens
ggagactgaggcaggagaatcacttgaacctgggaggtggaggctgcagtgagcctaggcagattattttgtacctctttaagactcagtttcctcatctgtaaaatgtgggaaatagtctcctgggaaggttggtttaaggattaaatgagataaagaaaataaaactgattttggtacatagtattaaatgaaattatcacatgatgataatgtgttgctgagttgaaaaatttggttgcggaatagttctcatttgtaaaaaagtgtgatacgtatacacacatgtatacaggagttctgaaagggtatataccaaaatgtcaatagcagttacccttg

SEQ ID NO: 119379 - DNA, 465 bp, Homo sapiens
tttttttttaaagacccacgcgaagagctgagggaaaactgtcagggcaaaaggaacatactggtgaattaaaggaacagaatgaagacatgtatggctggaagaaaaggagaaagagtgaagcgtgatgggtgggaagggaaacaagagtcaaattgtgtaaggtttgtaggccacataatgactttacattttatactggtatgagaatgggaagctgggtttggagcaagggtggaacttggtatgatttatatttttatcagatcactctggctgtgctgtagagaactgattgtaggagaccaatagtgaaaggagggagactagtttagaggcttattacagttagcaggtagaggttgcagtggcttggtctagactattaaatatggaagtagaagaaaaggtcacatttaggacattttagaagtacagctgacaggacgtcttgatgaactaggt

SEQ ID NO: 119380 - DNA, 352 bp, Homo sapiens
ttttttttgtagagatgaggtccgaccatgttgaccaaactggtcttgaattcctggcctcaagtgatcctctttcctcagcctcccaaagtgctgggactacaggcatgatgagccacagtgcctgacctccactgacttttattcaaatactagagactcgttttctgtatctctagtaactcttaaaggcagctagtgatgcttaatgctgactcttcctcagcctttcccctggccaaatagctaatggcttgtgatctattctagcagagaatttaatgatgagattacattcagagaaggcatggggttagggaatccaacagaggctctgcacccaggggtttgt

SEQ ID NO: 119381 - DNA, 536 bp, Homo sapiens
ttccattccaagctccacggggctccggcaggccccatgtcatgtgcagatgagggattagggttcctgcctagcctcgctgctctcaggccctcatgggctcctctccccaccccccatgcagccggcagaccctgctcccacccagctgttctcagtgtttctcatccttcctggatgacgccctacctggggcacccattcctgtggcaccccagcccttcactgcagcacgcatcctgtcacctccacagtgagaccatcctggaaccatgatcagcccatcagtttcatccaccctcctcctagcccattttctgtgcttatttattgttccccaaactcctgcctatgatttaaaactaagtgtgagtctagtctgttacaatgatatggattccagatcttcggaatcaaaatgctccaaggtttaactcacaaacttgtcttctttattttgcattttatgtgaatgcctttggtaataccatcatcggttgcgccgatggagggagcaaagatctcatggtgttggt

SEQ ID NO: 119382 - DNA, 368 bp, Homo sapiens
atgattgtggcttttgctgagcatatttcttttcgacgagttgaagatgacaatctctcaataccttactccatagactggatgtaagcgtcaaaagaggatgaaaaggtactttctgaacggacaggtactctggggtgatgggttgggagattctctaagcctcaagaacagcgtttcatgaaacgggcttataaaatacagcccatctcaaacggattttaaaaggcacccagttactttaaaatacccaatacaaacaccaagacgggctattttaccaggtcccctgcagaatgtgaaggggcttccagcgctccaagccggctttctaatttaagccaagaaccgaaaaggagcgaaggcgg

SEQ ID NO: 119383 - DNA, 511 bp, Homo sapiens
caaggatcaaacaaaacaacatgttcagaaaaatagtgctcaaaaccatgcttgattcaaccaggtggacagtaatggagctatacttggtttgttgtttttgttgttgttgttatatgtgtacaaagatttaagggcccttattgcaaaatgaacagcaaaatattgggaattgtttaaatgtctaataatagcatttggtggaaattatgcaatgtgtataagatatagtatctatatagccattagttttaacttatgaagaatattgaatggcataggaaaaatttcatactaaattaggttaaaagggcggcctacataaacagcagcgtgatccgaggtaggtaaggaaaatctgtatctgtaaacgtgcagaggaaaaaagcccgaaaaactacctaccagtggttctctagctggtggaattgtcagtgattttaactttagctgctgagtctttttgtacatatccaaatttttaaaataatgaactcccacaactttaatc

SEQ ID NO: 119384 - DNA, 416 bp, Homo sapiens
ctgtctcccccacttctatctctgtctctccatttctctctgtctctgtctctcccccacttctctctgtctctcctccacttcctctatctctgtctctcccccatttctctgtctctgtctctcccccacttctctctgtctctcccccacttctatctctgtctctcctctacttctctctgtctctgcctctcccccacttctatctctgtctcttccccatttctatctctgactgtcccccacttctctctgcctctctcccaccatttctctctgtctctgtctctacccccatttctgtctctgtctctccccccatttctctccatctctgtctgtctctcctgtctctgactcctcctctctccccagctccctggacgaagccctccggggcctctgcggtccct

SEQ ID NO: 119385 - DNA, 782 bp, Homo sapiens
agagcttaccaacgagctctgtcctgtccttattccatccctaataacatagcccccagtggaacaactacaaaggcattacaaggccttacctcttgcaattgttataggtgtactcattcttgtaggatgctgcatcataccctgtattcatggattggtgcagagacttatagaaacagctctcaccaaaacctttaattctcccccaccttactcagataaactcctacttttagaaaaccaagcagaacagcagagtcaagacatgttaaagagtttgaagaggaagaattatgaaaatcaagagggggaagtagtaggaaacattgagttcctcttcaaagatccattgtcctctattttcaaagcctatcttccttgcctccttgcccctagttatggtaaaaaatttccagccattcccaatctgtaatccacatccattcccaatctgtaacccacatccgttcccaatctgtaacaatccacatctgtgcattacttggcacccttagttccgaaactgctcttcccaccgctgtagctcccacccctgctccatttttatgtggccaatcagaatcagcttaggttgtgcagtctgaccccagccaatggggactggacacagtagtagggactgactgtgttagggataaaaacccattcccttctttgttcagtgtgctcttgcagtgacaagaatgagcagcacccttctgcagaagcacatttgccttgctgagaaatcctttatttgaatgctcattttctttaca

SEQ ID NO: 119386 - DNA, 253 bp, Homo sapiens
tcactgaaggttccctgtgtggacagcaacctttgcagaatccaggagatcatacagtctggcacttagcacagttcctggctgtggtaagcaatcaatgaatgccatttcttgttattgttccctgaatagcaagatgatccagacttagagagctgagaagcttgagactgtgtgttacatgaagaaagaaagagccaaagaattagtggaaaattaagatgagagcatttggctattgtgtcacctatgg

SEQ ID NO: 119387 - DNA, 356 bp, Homo sapiens
tgaagccatcctcctgcctcacctcccaaagtcctgggattacagatgtgagcaattgcagccagctgacaaactattttgaaatgactgtggtttgcttatgcaataatcctgtggtgtcaattaaaacctcaaaacactagtgagtttcccttttttaaagaaatcttggcatttactctggtttttttcaactaaaagatgaaattttaatagagagtatccgaaatgaaagggattatgggtgatttttattttctttttatctgcgtttttaaaattttaaatgacagatgcatatttctactgaaataacaatttggcttttattttaatgaaatgacagcaaaatgaga

SEQ ID NO: 119388 - DNA, 200 bp, Homo sapiens
cttgggaggctgaggtgggaggatcactggagcccaggaagtagaggctgcagtgatctgtgattgtgccactgcacaccagcctgggtaacagagcgagacctggtctcaaataaaaattttttgaaagaaaattatttttttaaaaaaggtatgtgtctacctcagtaactggtgtattattagatgttgaagtgaag

SEQ ID NO: 119389 - DNA, 127 bp, Homo sapiens
caactttccccacattaggaagagcttcttgaaaatacagcaagggcaaggtgcaggaaagcaaaaggttacatcatatcaggcgcagagagagcctagatcttcctggaatctaaactgatcatcc

SEQ ID NO: 119390 - DNA, 935 bp, Homo sapiens
atagcacagtggtaacagtagtcatgatatcagcatttgtttgtttgcaccagttcttcaagccctgattctcacagagcgacttgcagaaggccagttgtgcacacacagtgggttgcattgcaggaaaggaaccctgaatataaggtacccgaatctcttatactggactgcaagcatgcctgctttttgttcttaagggagatgctgtctctgtcttccaagtctgtaagcatacctgccctttgctctggaggaagacactattctctaagtctattcactataaaaatatccttgtaatgatagtccagaacaaagatagtcattgcctctgcttaaatcatgtacagaattgcaagagacccacggagaattatctaccaacaatatgcatcatagaaatttagaaaacagaagaaaagtcactacagtcctaccacggtcttactgttaaggtttttgaaatatatagagttttagccataaatataaatgatttcatatagcatgtattttataaaaattggtttatactgtacattctatcttgtgatgtgatgtttttcacctgccactgtatcatgcccatttccctctctctgctgtctgtattcttcttgatgtggtgaagcatctttgcccaatcttctgttcccttgtgccctgctctctgcctaacatttaattgtactaagtatacaatcagagttttagaggttgaagagcagagatttcagatcatctggtccaaccttttcatttaacatgtgtgttaactttctcatttaacataattacatttcactgagaccttctggaaccaacaagaaaaccttaatatggaactgcaatgatgggaatttggggcattgaaagaagttgggttggcaacattgcttgggtgatttccttgctaacattgtactgtaagg

SEQ ID NO: 119391 - DNA, 3037 bp, Homo sapiens
  misc_feature (900)..(900): n is a, c, g, or t
  misc_feature (968)..(968): n is a, c, g, or t
  misc_feature (974)..(974): n is a, c, g, or t
  misc_feature (1064)..(1064): n is a, c, g, or t
  misc_feature (2365)..(2365): n is a, c, g, or t
  misc_feature (2384)..(2384): n is a, c, g, or t
  misc_feature (2406)..(2406): n is a, c, g, or t
  misc_feature (2412)..(2412): n is a, c, g, or t
  misc_feature (2513)..(2513): n is a, c, g, or t
  misc_feature (3027)..(3029): n is a, c, g, or t
  misc_feature (3031)..(3032): n is a, c, g, or t
  misc_feature (3034)..(3037): n is a, c, g, or t
atcacagcactgggcaggaacagcacggccagggcaggaggacaacaacctccagggaaggggcaaggaagcctggacagggcaagagcgtgtcaagaagctgccgacaatgtcaaccaggcagataaggccgaggagtccctcgtggcatttcacaacaaggtgacatttgccagatcagtttagccgagctggggcggctgccagggttaaagaggaacaaggcgggagggtggggaggatgtggaaggagagagtgcagacagctcttttaagaggtttggctgtggtgggccaagatgaccgccaagctcagctgagaggccagggtgtgggtggcgggagaggcctgggaggcatctgctggaggatggtgggagaagatgggagaagttgggagggggccgtaaggagagagtggggtgaagggcaggggcaaatgcagaaccgtggagctggagctggcctagagtggggcaggagcaggtgccaggcacctccttgaaacagccaccctcactccgtaggccggaaacatgatgcaatcacatgtcatttaatcatcataacacctttgagaacacattattacaggcatgtttcagatgagggtactgaggctcagagaggatcagtgacttgtacagagtcacccagatggaatggcctggactgccactccaaggatcaaaggccaaagtgttccctgctgacccaccagcactccccagctcctctcatgcgtcccccatcacctgggctcccatccagactttgccgctccaccagctgtgtgcctccgggcaagacacaacccttctttgagccttggtttccccatctgtcaaataatagcagctgggcacagtggcttacacctgtaatcccagcactttgganggccgagatgggtggatcacctgaggtcaggagttcaagaccagcctggccaacatggtgaaacctcntctctnctaaaaatacaaaaattagccaggcgtggtggcgggcgcctgtaatcccagctactcaggaggctgtggcaggagaattgcttgaacccnggaggtggaggttgtggtgcgctgagattgcgccactgcactccagcctgggtgacagagtgagactccgtctcaaaaaaataataatagcaaccacaagctgcaaagatcacagtgttccgaagctggggtgcaaggctgtgcggggggaggccatggggaccgggaagtaaatgtcttcgtgccaggcaggagaggccattagcacccttggagggggcagagcccatggcagggggctgagtgggtaactggagaggcagcaggcaagggaggggtttttcccagctcagaatggcttgagctcatttggatcagcagggagagaggcggtggagggcgaggaactgttttgccagagtacagaggcaggccctcatgattctgccactgcctcctcagtgcagggccccacatggccttggtacacacataaggtacacacaccatcctcagactctccaggtggccctgccacaggaagggagctgaggccctgggctaaagggctggccacaggtcgccctttgaacttgagactgcctaaatccaaagctgaccctgagactggaagaagaacccctcccaacggaggccttaaaggaaggaggggaggggaccagggttccgggggtcatggtggaacaagaacaagctcgctgactgacagcctgggggaactcaggacaccagcaccagccacttgggagattgtgcggggggagccacttctgagccagtgaggaccccaggaccagcctgggccctcccgctcaggtttttggagtactggaagatcaactgagatttcacccaagtttcttgccactgacaaaatgaccactacttgggtacgaggcagattaggtaggcctctcagctgcaattcaagctagtgtaagcaaaaacggggataattgaactgaaaaagtgaatggcttcagacctggctggatccaggtacccatggcggctaccgggaccctctctcatgctctccacctctcggctctgctgtcctcaatgctggcttcattctcagaaggctctccccactgttggcaaggatggcccccagcagctccaggcccatacctggccagctcagcagccccagcggacagagggagcctttcttttcttttttcttttattttttatttatttatttattttgagatggcgtctcgccctgtggcccaggctggagtgcagtggtgtgatctcagcccactgcaacctccgcctcccggattcaagcgtttctcctgcctcagcctcctgagtagctgggactacangcatgcaacaccaggcccngctaatttttgtatttttagtngagacngggtttcaccatgttggccaggatgatcttgagctcttgacctcgtgatctgctcgcctcggcctcccaaagtgctgggattgcaggcgtgagccaccgcncccggcaagggaggctttcttaatggcgccagcgaaagtccgagggccaacgcccattggactaacttgggtcatgtgtctgtctctgaagtagtcactgggtctgacccttcctggcttggacgacatactcctgtttagagctgaaagtggaaagtctgccagaaaacgggaggcggagcaggcctggcagggaggtccatggcacttcctcccctcatgcccagggccccgcccccgactccactcccagacctcagagctggagcatctgcaacttctgatcagactccagcccacctcacccctgcatgcagaaataggggtgctacaaggggaagcggggagggtgtgtggggtaccgaaatgacctgggacagacctgggttcccattcagactttgtgtctgaatgggacacaaagctgtgtgtctccgggcaagtcactgactctctctgggcctcagtattcccatctgtaaactaataataacaatcaacacattgacagcannnannannnn

SEQ ID NO: 119392 - DNA, 371 bp, Homo sapiens
acagaaacaagtccagagatacacccataaaaatatggtaaactgatacttgacatgtccaaaaacaatgaatgcaaaaaggataatcttttcaacaaatgggattggaacaattggacattcacatactctccccccaccaaaatctacttataccttatactttatagaaaaattaactcaaaagggatcatagttttaaatgtaaaatgtaaaactataaaacaagaagacaaaacatttgcgatcttgggttaggaaaagagttcttagatgtgataccaaaagcatgaaccatgaaagaaaaaaactggtaaactagactgaatcaaaatgaaaaagatttgctctggaaaaaaaaacacagttaa

SEQ ID NO: 119393 - DNA, 815 bp, Homo sapiens
agacagggttttactctgttgcccaggctggggtgcaggggcatgaacatggctcactgcacccttgaccttctgggctcaagcgatcctcttgcctcaggcttctgtttagctggggccacaggcgggcaccaaaatgcctggctaatttttttgtttttattttggtagagacgaggtctcactttgttgcccatgctgttctcaaacttctcggctcaagtgatcctcccacctcggcctcccaaagtgctgtgttacaggcataagccactgcacctggtctctacttcgttcttactcttcttcccgactctgtgatcagctctttttcctcactgacatctcttatcaccagcagaggcctaccactagacaccagtggttctacttccctggttgagccctggtagatacggttcctgagaacttcatggagcagtttctgcaccaaacctgccctctctacctctggacctctacgtggaaaagagaagtccgtattggaagccttgactctggcccagacatttctgctgtacctcatgtagggtgagcccaggacctgccacactgtgccagcctcgcccaagccaccccccagccaggacgcggtctttcctgactcagcaggctgaggcacctgaggctttcattttaattatgaaccacttcaaagcctttctggaagcagtctctgcaataaccaacctgggttctctcctaatgtggggattgtcctggagcccaggccttccaaggctcctccgcccgccaacatcacctacctcatcttcctcttcagcacatcccca

SEQ ID NO: 119394 - DNA, 592 bp, Homo sapiens
aaaatcactatatacagattataaaataattacattaatctctttgaacaaaccaaaaaagatggagtcaaaagcatgaaaaaggcacaaatgactgtaaaaattggccatttatatttgaaagagaagaaaaatgaatttctggcaaggaaaatcataccaatcaaatttttttttaaaagaatggtttcattaagctgaaaaaatgaacagtaggaacaattaaaaaggcatggtgagatttgagtcaatagttacaaagttttggttagtaaggatgaataaagcatgggatctattgtacctcattttggctacaattaataatgatgtattatatactagaaatttgctagcagggtagatcttatgagttctcactacaaaataatggtaactatatgagatgatggatatgttaattatcttgattgtagtaatcgtttcacaatgtatacatatatgaaagcatcacaatgcacaccttaaatatttaacatttttgtttgttaattatttctcaaagagctagggaaaaagacttttgcagtagaggagggtacatctaaaaattagattgtagcacagagag

SEQ ID NO: 119395 - DNA, 193 bp, Homo sapiens
agtattaagaggcaaggaccaaatgaagtggagctgtggaaaacattcttacctgaggaatgagaagaggagcttccaaaaagggagctgaagaagatgatcagagaggtggtgtgagaggcacccatacagaacaggtgttttcctcgcctctgcaaactccatcttgtccattaccctgaatggagtgtca

SEQ ID NO: 119396 - DNA, 393 bp, Homo sapiens
cagggtctatcaagacaggtgaagggaaatgaagttaaggcctgcaaactccctgtgtgttcttggagaaggaaagcaagcaaaatatgcaaggtgtgtaacaagcaccagcaactcagtggtggaggagggattccagtgtatttggagaggagaccttaggtggccagggagccccttccttctgtctgtctgttcatctgttcacccatcattcactcttccattcaggtagtccttggccacctgctgtatccaagatctctggctcctagtgcggtgacggtagactggataatgcagactagtggatgatttgacaagttaacttacatggttttggaaagaggcatcacttttatgactctgcaaacccaactcccttatttctaa

SEQ ID NO: 119397 - DNA, 304 bp, Homo sapiens
tagatgggattacaggcacctgccaccactcccggctaattttttgtatttttagtagagacggggtttcaccatgttggccaggctggtctctaactcctgaccttgtgatccacctgcctctgcctccaaaagtgctgggattacaggcataagccgccgcgcccagcctggatttcttactgtgtattagccttgccctcaaagagctttccatctgggtagaagacggccaaggacaccttgttttatttaaccccctcaccaacaactctgtcagataagaaatccaaggaggaacttg

SEQ ID NO: 119398 - DNA, 795 bp, Homo sapiens
tatatattttttaatgttgggagaactgttcagcctgggaagaaacatttggggtggtgggtttggcgggggtgcagggttagaatccacataatgctgatggattgctgagctggagtcctgggtcttgacacaggaatgggactggagagcaggtgtgtaggtgaacttatttaaggctccgtcctccaatacacacacctgagtgatcacccttgagttctcagggacgcagtttaaggcccactcttgtgaaggtgacctgggttggatttagttggtctgttgggatctttagagtggctgtctcttccagcctctaaaggaagagtgtttttcaaaccacaggactcagtatattaggtaattatacgattacctaattgattatgaaataattattttttattttttatattattattattattatttttgagacagagttgtgctcttgttgcctaggctggagtgcagtggcacgatctcagcccactgcaaccttcacctcccaacttcaagcgattcttctgcctcagcctcctgagtagctgggattacaggcacctgccaccatgcctggctaattttttttgtatttttagtagagacggggtttcaccatgttggccaggctggtcttgaactcctgacttcaggtgatctactcacctcggcctcccaaagtgctgagattacaggtgtgagccaccgcatgcagccataaaatcagtttactggactaaaccactgttaagaaagctcacagtgaaataacagacatggtgagatatt

SEQ ID NO: 119399 - DNA, 504 bp, Homo sapiens
tgctttctacaaactgttgaagtaccagagtgaccaacttgtcccagtttgcctgagactttcctagatttagcaccaaaagtcctgcatccagggaaaaacccctctgtccaagggagactgggacattgggtcaccctatgaagcacccataatgttttggccctctttctaggtgctgggatgcagattttagtgtcagttcctgctcttatggggtctatgaccagataggaagacagacaagtgaagaaaactgctttatgacaaatacagcaaacaaacatgagttaataacagctgacacataccgagtgcttatgtgttccaagttgctctggtccttttttgcaaatggattcatttcatcctctcaagagccttatgaggaagaaactatcagtgtacccattttacggatgggaaaactgaggcactaaagtcatgccctggggcatggggcgcctggaggaacccagggggtctagctccagagtctgtgcc

SEQ ID NO: 119400 - DNA, 548 bp, Homo sapiens
tctgttgcccaggcttgagtgcagtggcgcaatctcggctcactgcaacctctgcctcctgggttcaagtgattctcctgcctcagcctccccagtagctgggattacaggtgcgtgccaccacgcccagctaactttttaagtagagatgggtttctgccatgtttgccaggctggtctcgaactcctgacctcaagtgatctgcccacctaggcttcccaaagtgctgggattacaggcatgagccactgagccatgcctaaggtactcttaagtgtcaattttgttaattatcaaatggggatagtaagacctatacctcattgtaatttgtgcaaatcagtaataaatgtatagaagcctatagcagtgtctgctatataaaaggaactccataaatgacattattgtcatttaaaaggcagggataagtcttgcccatctctgtatcctcatgtccactaacttaagtactcagcaaatagtttttgaatatatgaatgaatgaaatgaatggaatgaaagaaaaaaatagtaaatgaacaga

SEQ ID NO: 119401 - DNA, 545 bp, Homo sapiens
tacatagcacagacactgacaggcaaagtgaagtttgtaatcacttcccaatcaattgttcaactgaatgtgagaagaaatcattttctctcctgttttgagtcagaatatcacataaagcacaactcttcctgcatacattgtatcatattccacagtaatttacttttttgcaagaagtatccaaaatttggtttttcctgctgagcagttatccagataattgcaaatcagtggaatcatttacatgaataaagatttttattctaattaacgtgctaaatcaagcacaccaaatgtctctaattcttatattactcaaatggcaatatttttgtcagtgactatcatatgaaatttcaggtgcctaatgcattttcaaatggcactcataagcatactaacgttttataaataaatgtctccatatttttaagatgaatggacaatttttgatttttaatgtagtccccaattttcaatttttcaattttcatttaccgaatggagaaacagcattcatcagagcaaaagagcaagtttca

SEQ ID NO: 119402 - DNA, 297 bp, Homo sapiens
gcagagctggaatgtagcaacagctggaatccagaatgacattctaagggggagggttgttaaggcacaaatgatttttctgggatttaagaccttacttaggtaagttatttaactgtgtctttcaatttacagttaggtgaaatatgattgatagtaatgcctccctgataggtttagctaccttttaaatttgaatgtctgttacatagtgaatactgtcaactattaaaagcagtaaagaaacaggatatagagcgagactggatagcacttgttgggataattatttcccag

SEQ ID NO: 119403 - DNA, 408 bp, Homo sapiens
tgtttctactaaaaatacaaaaaattagctgggcatggtggcgggcacctgtaatcctagctacttgggaggcaggagaattgcttgaacctgggaggtggaggttgcagtgagccaagattgcactatagcactccagcctgggcaacgagaaagactccgtctcaaaaaagaaaaacccattagaacaaatccggcaccagctgagcaccatgcattgtttgttgctgaaattgttgccaatctccaggacgttttgtgccgtaaaatcctcttccacccacacgctggtacccaaatgcagcaactgcaagtatcacctaataggctgcaacatttcgaagaatcggaagcgaatttcctgaagcccttgattaaccaagcgcctccccatcctctagtcactgc

SEQ ID NO: 119404 - DNA, 325 bp, Homo sapiens
gtttcctccggatggaaaacctatttgggaaatcttgttgctgggggcgggaaaataaggacagagagctctgtgattataaaggatattgaaggctgatgtggtggtcttccctaccaagtaggaatctacccaccaagcaaactgtaatactcaccacatctatcctctgccagtgccatgatatactcatcacttctttttattgtggcaaaatacacatcacataaaatgtgccattttaacatcttgaagcacacagtttattggcatgttgtgcaaccctcaccactgtgtatttccaaaattttttcatcaccccaag

SEQ ID NO: 119405 - DNA, 379 bp, Homo sapiens
aaaaaaataaaatccacaatgtgggacagttcatgggagctaggcctatacaataatgctcccaaatatgtaaatgaaagaaaaaagcgaaacaacattcactgtgaaagacactgtacgtgatccaacccagtatccattctctccttcttactatcaaaaccccgattgtattcagggcagtcaaagagccttgtttcccagcctttcttgcaacgagacacttctagctcaggatgatcagggcaatgtgtagggagggacactcagaaaagttcctttggtcattggaggaggggaatagtctcagctagctcttagccttctgcctattcacccctttcttcctcccactgcatgaaacagtgacgtgatggca

SEQ ID NO: 119406 - DNA, 376 bp, Homo sapiens
aaagaaagtacagtattccataaattaacttatataagaagttacttatcgacactctaaggtcaaataaagttaagccaatgacatgtcacgtaatctgggttctagttccaactcaactactttgtaatgtaatactgaataagctgcttaatttccctgtctcaggttcatcattttataaaatgaggaggtttgactagatgatccctcgggtatgctgcagctcaaaaaatggaaaggaagaaatacattttaaattcatcttattaatagaggaaattaaactatcagcagaaactgataattttttccacttatttacaaagctgatatattctgaaactgtccctaaaatgtttaaaagttggctttt

SEQ ID NO: 119407 - DNA, 1920 bp, Homo sapiens
  misc_feature (2)..(4): n is a, c, g, or t
  misc_feature (15)..(16): n is a, c, g, or t
  misc_feature (19)..(19): n is a, c, g, or t
  misc_feature (28)..(28): n is a, c, g, or t
  misc_feature (31)..(31): n is a, c, g, or t
  misc_feature (33)..(33): n is a, c, g, or t
  misc_feature (35)..(36): n is a, c, g, or t
  misc_feature (237)..(237): n is a, c, g, or t
  misc_feature (702)..(702): n is a, c, g, or t
gnnnctgctgcctcnnacnctctgcctnccntncnngaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtngcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctggggntatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctatcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtctaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatcatgtccccgtctctgcttagcgtctgggtgagaaaaacaggctgtgatccagaagaagggaagatagagaaggagggaaaggatgtaggcgaaggaggtgagagacag

SEQ ID NO: 119408 - DNA, 384 bp, Homo sapiens
caaagtgctggaaatacaggcgtgagccaccacgcccggctccaattctgcctttgatctatttgatgtaccaagaaatttgtttaaattgcctctttggggttggatatgacatattttggatggggttggtggggcattgaggtcaccttaactgaaaccagtaatgcagctgaaatgtatgatagaagattctaggtctggatgtagaaaagacacattggagctgtttcttattgtcagagctgtgcactgatgtaaatacttttgtgagctggaggttgccagggcaacagtcctattaatgaagaataaacctcatttattatcagtgccagaataattattttttaaataaatgtacccagtggtctaacactgaca

SEQ ID NO: 119409 - DNA, 346 bp, Homo sapiens
gagtaactctagagtctaacagctttccccggcccccgaaggtgccactccatttcaagccaacacagtattaacacataaaaaggcttttctgttcaacaagcccaggtgtgatgcgctgggaaaaaaataataaatgctcacttactgatatgggacctcagctgtcaaccttgttagtgggcataaaacaattagagaattcaagacagaataaactgctaacttgataactatttgctccctccctagatggcactgagagacagatatagggaaagcatctgagcaggaaccttcacggctggtcttacaggagaggcagctgcagagtagcatccagtgg

SEQ ID NO: 119410 - DNA, 331 bp, Homo sapiens
tttctgcatatttgcactaaaaatccttacacttgcaattatttatagcagtactggaagtggcagatatgtactgtaagttattttcattttgttaattaacttagggtctcattttcactgtatacaagggcttcctcaaattcctaagacaattctactgataactgagaactctccttctccaaggttattttagggtctctaatttgggctttgcttttataccatttaactttgttgtagctgaggagccctaagatgacaagaaatcagcatcatatttaaactctcccaggggaggaaaaaaggggactcctcaaaacaaggc

SEQ ID NO: 119411 - DNA, 862 bp, Homo sapiens
aggaggaggaagaggcagaatatatggctgtgtctggtccacacaggactttagattaaaagcctttttttaagtctgtcacaggagtagagtaaaaataaataggtttttttaaagccattttagtgatacattaagcaagctttcaacagtggtattcttggtatctaagtgaccttgatccataataagaatactgcttttgcagttaatctaaaccttgctgtttcaaacattttaaacatgcttacagcttaagtgacacactactatactatggctaacatccacttgtataacaactatgctgaactacagacgggcagcatttattctaagccgacacaacttagcaccagctactctagtcactacatcacgtccttctcgcactgtctgcggcggcactactctccaggtggcttgccgtgcatgcgtcgcctcaacattccgaagctcgttctgtcatatctcactttaactgtcgctctctcccacgctggctcgcgcgacttcttctcccctctccctctcttcagcgccacacatcttctgccgcctctccttcataggtcaacacttctccatcctaatcaaccccccagcatgtaaaacacaacgtaagaaagcaaggtgaaagttcattgcaaaccaactacccagtggactgaaacgacattacccattagattttccataagcccttcataatcggccctacagtcacacattgctggatcttttgcgcacctccgtggttgcgacatttctgctcaccgccagtagctcaaccttaccacatgcatggaatctgttttactcataaaacagcagttacacgcaaggtagtaataattacccc

SEQ ID NO: 119412 - DNA, 289 bp, Homo sapiens
ctgaaaacagggtgggtctggtagttctcagaagaagccacagatgtaggaagaagtggagttaggaggaacatatttacatgtcatctagaggcaaaatatttctatatccttacagataactggaatattcagggcttcgaagacccgcttttgtaaaaagaaggaccctgcaagccagagagggcaccaggctttttcaaggccacacaggcaggtaacagccaccttgatcacctggcctaggggcagtgacctagctttctcctgcatcttcagctttctcctg

SEQ ID NO: 119413 - DNA, 490 bp, Homo sapiens
gttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttt

SEQ ID NO: 119414 - DNA, 594 bp, Homo sapiens
cagttagctctttttgcttactgaggttgtacattggttttggagaatacggaataatcaggctcagagttactttcacattgtactgctaagatactgttgaattaaagtcacagtgttcatggaaaataatgtgtcagaaattactaagaagaatgtctgaaatgtgcacaggttgtgaagtgctggagagaaaaaaatgggtcagtgcattgattctcttggggtaagggtgaggaccacattctttaaggggtgataacaggagctctagttaaaacgtttctaaatatacacgacccacctcctgaggttctgctgtagctgtcacccctagggtttgttgttttcctttattctgcatgcatcactctgtgtactcactactagtagttacttttagggttattgtgaatattgttagatataagatgaattggtgcatatcctctgacgctgggagaccattgtaattgattggtcaggtattttatagcgaacttctatgtagaatataggattagataaagcctttgtatacggtaagctttcagaatttaaattaaaaatgaaaaagtcaatggagatttatgg

SEQ ID NO: 119415 - DNA, 440 bp, Homo sapiens
caaagctccaagacagacctgtagcagcatggcccaaaaagttcctctgctgccccagtcccatacctgcctgaggtacgggggttcaggctgagtcggctgacctggagtcatctggaagccttgtcagaaatgcagattctgcagtgctgttcccagaggatgagattcagcagaactgggtgttggatattatatgaagagatttgcaagtgttattttacgtaattcgcactttacaaaggaggaaactgcagcgcaggtaccaaggttgccccatctcggtccaggcctgctcccggcgagccactcgcccttgaccacgcctcctctctcctgattggctgtcaggcatgagtcgacagagaaagatgaccactgccctcaccccactaaagaagccccagcacttagcaagcacttatggcccagagcagact

SEQ ID NO: 119416 - DNA, 642 bp, Homo sapiens
ctagctcggtacccccttccctctctcacgtaattctagtttccaacgaaattaggcgtgtcactgaccacctccgtaaaccagcatgaccaatactcctactgaaatgcctaggaaataaatatttggacgccttcctagacaagcacaggatggtgtaaatctccatttctctcaggaaacaagtcctgctgctcacaaccaccaaccaactcagcagcttggtaaaaacagacccaatacactcgtttcttctaagcgcacagctagctgcctagcatctattcagctcctcccgaaggaagcataaacatcttcaccaaactgtagcaaagaagacagaggcaagtcgggttaacgcttcaaagagagaaaagacgctggagtcagaagagtagagaggcttttattcgtattacctttactaagggacaggtggctctctagttccttttttcccccgattcactgtttcttgactctagttctttatgtctactcatgctgcctcacagctcctgccgggccctcagcgttcacgcagaggcccaagcactgctccccccgcttgccttgtggtctctgaagtatctcaggcagcattcccgatgcctgctttgaagtgtcagcagttggcacagg

SEQ ID NO: 119417 - DNA, 443 bp, Homo sapiens
ggctcctgaacttactgtgtgaactgtaaacaaaaggctttgggacaaatttgtctcaaaccacgtggcactgatctgcagagtgtgggaaatggtcaggaatagagctgacaagtgttcccagtcttcccccagaggtaagatgtccgtccaatccacccagcccctgcctattcatgaggacctgagaagacaatttcttccccttctcttctagagcatcttttttacgtttctgtggttaccggatctctgggcccctgtgagtgattatctgtgtcctcacatttcccctcagaccagatgcttaagagcaagaaccatatctttccccacggagcctgagacatctccacccccaccccactcccagcaccagccccaagggagctgcgtgaacaacaccgaccctcattcccattcctttggcttattaatcactg

SEQ ID NO: 119418 - DNA, 237 bp, Homo sapiens
accacatattatgtgattcatttcaagtgaaatttacagaacaggccagtctataaagatagaaagtatgttagtggttgcttagggaatggtcagtgaggagataggatggtgataactaaagagtacaaggatgcttcttgaggttatgatgttttaaaacttaactgtggtgatggttgcacgtatctgtgactataataaaagccactgaattgcatatagtaagtaaatgtg

SEQ ID NO: 119419 - DNA, 361 bp, Homo sapiens
atttgctgtatttgtacctggtcctttgctcaaatgcctgttttaaaaaaagtcctagacctataatcacacattagattttaaaatatgccctttcagctgtctaacctacatctacacagaattagtacgtgtattttttttttaagacagggtttgctctgttgcccaggatggagtacagtggcacaatcacagctcacttcagtctcaaccgcccaggctcaagcaatccccctgcctcagcctcccaaatagctgagactataagctacgcaagcattttgacaagatacaggagggttggcacagagatttaaagaagccaagttctaacacaggacagcaaagacaccaaaac

SEQ ID NO: 119420 - DNA, 130 bp, Homo sapiens
tagtagttcaagatcagcctgggcaacacagcaagatcccatcttaaaataaaaaagatctcatggtaactaatatttgatatgtatgatatatgactttaagcaatattacgtgacatcacctttctca

SEQ ID NO: 119421 - DNA, 333 bp, Homo sapiens
cagctcttcaaagtggcaaatgtcaggtttctcatctgctcacaactgttccaccattccactcggcgctaaaataagtgagtatcacactcagagggaggggcacaattcatatttttgttgttgttcacgcctaacctagactggagatgtaacgctttgtccaaaatacgatttcgttattgctattcatgcgaaagggctcaacaagttaaaacaaaaaaagctgtacacaaacccatgcggacgacctgcaacctgagcctggctcagacggcctggggacctgctcacagggatccttactcagtgtcacatgatgcacccaggggt

SEQ ID NO: 119422 - DNA, 410 bp, Homo sapiens
caaggtatcctctaacaggtaagtgaataaatacactggtacatccatataatggaatactattcagtgattaaaaaaaagaatgagctatcaagcctcaaaacaaacacaaacaaacaaaaaaccccatggtgaaaacttaaatgcatattgctaagtcaaagaagccaatctgaaaaggctgcatactgtataattccaactatatgacattctgaaatggcaacagtacagacaataaaaagatcaatggctgctagaagttgttagggaggagggggaagggacagagggaagaataaaacatgagattttcaggtcagtgaagctactctgtatgatactgtactggtggatatatatcattatatatttgccaaaatcaatggaatgtacaacatgaagagcga

SEQ ID NO: 119423 - DNA, 389 bp, Homo sapiens
ttgagataatcaaataatgcaatgttttaagtactattgtaattattcaatatcagatgttaggatatctcagttgtctgaattgtgcctacaagctagcaatgacaaaaggtgaggaaaagaaaagaagtgttaaataaagagggaaaacatgaaaagcagatggtaagaagaaggcagcatctcagaaaacagcagctccatcctcccatgccctcaggaccaaaacctcagtgccatccctgactgactttctttctttcatgcctaagatctaaaactgcagcacattttgggtgctcgagaccatcatggccaacatggtgaaactccgtctctactaaaaatacaaaaatattggctggccttggtggcacgtgcctgtagta

SEQ ID NO: 119424 - DNA, 440 bp, Homo sapiens
ccaagatcaggttataaaaaaagagttagtgtataatgtacttaaaaacattgcctctgtcaatgaataaaaagaataacatattagcgaagtgcattaaggaaggcaacagacgaataggaaaaataatgtgcaagatttagtaaataaatataggaaaactaaaatggccaggcacagttgctcactcctgtaatctcaatgttttgggagggcaagctgggcggatcacttgaggtcaggagtttgagactaggctgtccaacatggtgaaaccctgtctctacaaaaaattagcggacttggtggtgcatgcctataatcccagtgaatctggaggctgaggcatgagaatcacttgaaccaggaggcgggggttgtagtgagccgagattgcgccactccactccaccatgggtgacaaagtgagactctccctg

SEQ ID NO: 119425 - DNA, 495 bp, Homo sapiens
agctccacgatgcacactggaagagaggaggttgtgttaaggtggcggtaaaaggagaaatacaccaatggtgctgggctgtggcaaagcagcaggaaaactctgtgcacacctagcccctcaaacaggaaccactcagcccagcaatacttaattctacacccaagattgtttcctttagttcttttgggttcaagatataatatattaagtacctcttgcccccttccttgttatttatgtgatggtcggttttatgtgttaacttggctaggctgtagtgatcaactatccaatgacacattactctaggtgttgctgtaaaagtattttgtaggtatgcttgatgtctacaatcagttggctttatgtaaaggagttgatcctggatgatctgggtgagcctgttctaatcagttcaaaagtcttaagaacagaactgatgtttccctgaggaagaaaaaatctcccctgtggattgtggcatcagctcct

SEQ ID NO: 119426 - DNA, 188 bp, Homo sapiens
agagggttgctgaagtggccagagtcacagcgcggctggtgacagagcagagtctggccccagcctcccctgcacagccgccatttattagctcagatgcttccaaattcaaaatgcagtgtcaccagaaaccgctgacacaggctgatggttcagcaactcacagccatcccctggggatgggctcc

SEQ ID NO: 119427 - DNA, 423 bp, Homo sapiens
ataactgttgaaattcagtgagaagcttatgaggcatcattatacccttctctctactttttttgcatacttgaaattttttgagaataaaaaataaacaatgtagtgttttctgggactcaacaccttcgctgatggtcatgtctatctagagcacagaaaatctgtttccttcacaaagcccttccacactggccatctagaggtcaaaggacaaggacttgggaagaggccaggagaggccagttggaaagaaaataaaaggaagcatctttgcagaatctcctatctgtgatacttaaaatgtcagccaatgtgtggtgttaagtacgttttgttttcagacctgagtttcatactcaactttgccactcaatgcctaagtgaccttagactaagtcactttctaacacaaagttacag

SEQ ID NO: 119428 - DNA, 612 bp, Homo sapiens
tggttccccgagtgtttatcgatgccacccaatgctgggcggacacagcattgagtggcattgaatctcgtcatgagaagtttctttcctttcagttctctttcactccacattgggtcaaggggagaatctccatttggggctcctgtgctgttaacatctgtcagacgctggctgatgtcatttgtttgtttgaccaagagcaaatctgacccaggcttagaatcttgctagaacttgccttgctctcttgttgaacttcatggcattgtttcattgtatgtgtttttccggaatctcccgtctatacctaggaatgctggttttccatccactgtagcataggaaaatgtctttttgaaatacatgtttaagttttaaaaaaataaagtcaacttaaataaacacactaagatgacactagtgtaggtgttactcaggttcattggttcacctggccggagggcttggggaatgcagagttaaacgaccccaagtgggactctgtctcttaggcacctagggtgccctctgcctcttgtctcctagggtgacaccagtggcatcgataaacacggggtcctctagatcgaccgccagcagcaactgcct

SEQ ID NO: 119429 - DNA, 524 bp, Homo sapiens
ccgtacccggtgtttatcgatgccacactatgttctgaaagacatgaggaggggatcctgtgctgttaacatctgtcagacgctggctgatgtcatttgtttgtttgaccaagagcaaatctgacccaggcttagaatcttgctagaacttgccttgctctcttgttgaacttcatggcattgtttcattgtatgtgtttttccggaatctcccgtctatacctaggaatgctggttttccatccactgtagcataggaaaatgtctttttgaaatacatgtttaagttttaaaaaaataaagtcaacttaaataaacacactaagatgacactagtgtaggtgttactcaggttcattggttcacctggccggagggcttggggaatgcagagttaaacgaccccaagtgggactctgtctcttaggcacctagggtgccctctgcctcttgtctcctagggtgacaccagtggcatcgataaacacggggtcctctagatcgaccgccagcagcaactgcct

SEQ ID NO: 119430 - DNA, 475 bp, Homo sapiens
tgcaataactggagttccatgagaacgaaaattactttgaaaaaatagaaaattggggaaagctctcaaaaagcagaaattaatttcactagaagacagaagacaatgtacatgttaaaacattacatacaaaagtacattaaagggccacacattttctggagtgtacaaccaagtttttgttgttattctaaaagtttttctcacaatgtttggcatacaatagatgctcaatatttgctgaacgaatgacccaaatgtgtgtgtgtgtgtgtgtgtgtgtagtaaaggggctggagtatagagaatattgtgaggtttgggattcttcagaaaaatcacctctcactgcaacagagtactgttgttaaagaatcccatttgctattatctagaatacttttaagaaattgtttacttattacattgtatctgaagttctgagaactaagtacaatcaattaccattctaaag

SEQ ID NO: 119431 - DNA, 604 bp, Homo sapiens
ccagtctcagggtatgtctttatcaacagcatgaaaatggattaatacgcaacctctctgctcagttgtcctgtctcccactgtgctcaaggcacactggccttttctgtttctggaacatgccaagctcctcctgtctttgggccttaacactaacctgtctggaatgctcttcctcctgctctgtgcctgtcctactccttcttgtcattttaaaatgtcagtttaaatgtcatctccttggcaaggccttctctgatgtcccaagctaaagaagccacacagactttctctatcacatcactcttgttctccacacagcacatgtccataagtgctatttttctgtctgtctttcttctccactccccctccctcgttctcttccaggaaagcacggccttcattctcttgctcacggatgtttcccagagtctaaaatagtccctggcatagggtagtaggtgttcaataaacatctgacaagcaaagtgcctcatccaacaaggcaggagtgggcatatttttcacaagattacacttaacatatttagcagacgtggcaacacaaacacatacacacattctcacacaatgatgattt

SEQ ID NO: 119432 - DNA, 808 bp, Homo sapiens
agagagtttttgtgaggtagtatttgaaaatggatgagaaatttctagaattgatgcacaacataaatcctcagtaagatgaagtagaccaagtgttgagtgggataaataaaaataaaacctctacctagaataccaaagaaaagacaaaaatcttacaagcaatcataaagaaaaggtggattagccaaaaggatttgcaaagagataatagacttttcagcagcaaaatgagagggtaaaagataatgcaatattatctgtgaagtgttaaaggaaaataaagcctatgtggaattctataccaaactattattcaggagtaagggtgaagataaatatttttagggacagtttcactgaaagaactattaagaatgtacttcaagaaggaggaaattgaattcaaaaaggaagaaggattcaagaagcagtggtgaacaaagaaaatgttgaatgtgtaattatattttagtaagcatttagtgtaaagtgaaaagttaatgactaacagaaggaagtggttaaaagcaaggtggaactaaatttaaggagattgacaaatatgttaaaataaattgcctccagcacctctgtatcagtctgtttgtgttgctataagggaatacctgaggctgggtaattcataaagaaaagaggtttaattggctcaccattctgcaggctgtgcaagcatgacaccagcatctgctccacttctgatgaggcctcatgaaagaagatgaagagggagccggcttatcacagggcaagagcaggagcaacagagatggggagacgtgccaag

SEQ ID NO: 119433 - DNA, 579 bp, Homo sapiens
gagcagatgaaaggatgcagttaccatgaaggctgcagatgaggtaggttagaaaagtaagatctggaattctctatgagatctattcagtttgagatacccagtagatattcgagtggagatgttgactagatagttagatatgtgagtcaggagttcaagagagaggcttgagttggagaaatacatttatgagttttcagattagaggtggcatttatggcccaggaaacagatgagatttttaagaaagtgagtgtggagagagaagaaaaacaggctcaggacagagcctgggcattccaacactgagaggttagacagtaaaggccaaatcagccagatactgagaagaaacagaagaaaaccaagagggtatgctgtcctggcaaccaagtgtagagggtgcaaccaggaggagggaatgatccgtgtcataaaatgctgctggtcaggctgtgcaagcatgacaccagcatctgctccacttctgatgaggcctcatgaaagaagatgaagagggagccggcttatcacagggcaagagcaggagcaacagagatggggagacgtgccaag

SEQ ID NO: 119434 - DNA, 415 bp, Homo sapiens
taagcaagtcctctccactaagggaagacccttggaagcttgtgcctggtttcctgcagacttcgctctgaatgccagtttgttttgctgatttggctttgtatcttttcactaataaattatatccatgaagggcctggtacggtggctcacacctgtaatcctagcactttgggggctgaggtgggcgaatcacctgagctcaggagttcaagaccagcctgggcaacatggtgaaaccccgtctctactaaaaatacaaaaattagccagacgtggtggcacacacctgtaatcccagctacttgagaggccgaggcaggagaattgcatgaacctgggaggtggagattgcagtgagctgagagtgcatcactgcactccagcctgggcaacagagcaagatgccgtctta

SEQ ID NO: 119435 - DNA, 445 bp, Homo sapiens
tcatgtggtcatttggaggtaagatgacactctctggctttttgaattgccagagttttgcactggttctttctcatctgtgtgagatgatgtttctttaatctttaaagttgctgtccttcatatagggctttttgctttttatattctttgatgcccttgagggtttgacagtggtataagctgggtataaattgattggcttcatgtctggatgattgcagggggccaaggctcagcttagcattcctaggctgtgtgctctaaccctggggacctgggaccaggcccacagccttttttctctggccccttgaggttaagctcctgctgtgctgaaggggctgaggtgttcccagtctgctggtaacactccaatgcagtctgccagcaaaagggcttcggcaaggcagcaggggtccctgcacatgtgtgcaccagtgac

SEQ ID NO: 119436 - DNA, 115 bp, Homo sapiens
actatgcaggtgtgcatttagatgaaattattttctgctgtattgcattgatgggactaaaggttctttttggccacatatttagcttgctcaaatgaaactttttttttttttc

SEQ ID NO: 119437 - DNA, 427 bp, Homo sapiens
gaacaagacatagataaaaagcctgggaaagacactacagaagggacatcatcaataagagataaatatattaaagaagctcatacaatgagtatgagacgcaaagtacaattaatctttcccttaggtacggtaaattgccctaaaattgggtttttcctcattttgcaatagaccttaatgctgatctctagtttttcttttatatgatgctatcaaattggttttatctattttctttcttgatttcttgactaatttgacttgttgatatggtatctgaggataaacctatgtgcctttttttaagtgtcctttaaattctcttacatggaaaggcttaaatagaagatgattttttcaattccgtgttttcgattttgttgtgctcagattccatgaatttacaagattgctgtggagtact

SEQ ID NO: 119438 - DNA, 629 bp, Homo sapiens
ggttgggaggcatgggagttgattgcaacattaaatagagtggtcagagaaggcctcgctggcatttgagcacagactttaaagcacagtcatgtcgatatggtagaacagagattacccagggagagggaagaataaatgcaaatccctgaggcagcagtgtgcttggtgtgtccaaggggtaacagggaggccagtatggctcaagaggagcaagcaagagagaagagcaaggaggaagaacagtagaagaggaggtcagagggtaaatgagaggcaggagtagggcagatttgggggcattgtgtaggccattagaaggattttgactcttacatgaataaaattagggaaccattttcggctggatttcagcacagaagtgactgcatctaatgtatcattttaaaagcatcactctggctgctgtgttgagaatgggaaagggtggagacagggaaaccaggtaggaagctgttggagtagttccagtgaggggtgttgacagcccagaccggggagtagcagtacaggtagtcctaagtggtcaaactcagaatatattttgaagtacaatcagtaggacttctcgacaggtggagactacctaagtaataggtataattatg

SEQ ID NO: 119439 - DNA, 306 bp, Homo sapiens
tggactgggtgcgggcaaggaggaagtggtgggattctagacacattttgaaggtagagcattaggatttgctgacaaattggatatggagtatcagagaaaaaggagtcaaggatgactccaagatctttagtctgagcagctgaaaggatggagttaccattaactgggtaagaagacagggaggagcgtttggggcaggaagtcagaggttccgatctggatatgttgagtttagggggcatttcagaccaccaagtagagttgagtaagcatttggaaagtagagttcctagaagtggggct

SEQ ID NO: 119440 - DNA, 446 bp, Homo sapiens
tccatctcctcctctggactgtaaatcattggaagcagggaccacgtctaatttaacttagcactcaccccatttagcagtcacatattaggactcaacaactaatcatgctgctactgagaagttcaaaatgctgaacacaagatggaggacagaggggaacacaaaggtactataagccaaagatgtgaaaaactacagaagaacatagtgtccgcctcccagatattgggtattattgtgccctgcctgtgtatataagaagtctctagtgacatggcttgagcttcagactggaagagggctaagcctgataggccacaggggaatgcaactagaacatcagggccctgggtacctcaaaatgccaacatagatcctgactaagtacttccatcaattcagaaggaatgaagcccgttggagtgacactgggaatagtaata

SEQ ID NO: 119441 - DNA, 397 bp, Homo sapiens
aaacaatgtagcttgcttggacaaagaatgagaagttaaaagaatgaggagactggccccactgggcagcggactcagttcagagaaccctgagaaatagagcaagatggctgggcacagtggctcacgcctgtaatcccagcactttgggatgccgaagcaggcagatcacttgagcccaggagttcgagaccaacctggccaacatgacaaaaccctatctctactaaaaatacaaaaaattagccaggcctggtggtggttcgcacctgtagtcccagctacttgggaggctgaggcaagaaaatcgcttgaacccagaaggtagaggttgcagtgagccaagattgcaccactacactgcactccagcctgggcgatggagcaagactccgtc

SEQ ID NO: 119442 - DNA, 224 bp, Homo sapiens
ctccacagcatccaggcttccagtgtaaaagcctcttacaacatcaggcgggagaaaacaagcctgccgcttgtggtgccttagcaccaatttgtcacccacttcactcagccctggccccctgcttctcctctgtatggtatctttttttcccatggctgctccagctgggctctggcctgacactggaatcacatgttttggctctagcctttggtattatt

SEQ ID NO: 119443 - DNA, 321 bp, Homo sapiens
ctagggtgcatggcaactgctgaaaaaacttcacggaggaagtgagaaatttttatcagggttttgaaatacaaatacgatttaaagcaggtaaagtgaggatgttgggagtagagactaaaagtaaaaggagagtgatgtgtgaagtagcacagtggccatgctcccatatgtcctacttcccaaggacacagccctactgtggatgagcataccatggccttatctgcctctgtgcttttcatcagatatgtccatctcctacaatgctcttccccaacattcacccatctggccagactgctaccacctaccacccaa

SEQ ID NO: 119444 - DNA, 282 bp, Homo sapiens
aagtcactgacacaaggttacatggctggaaaatggcaaggccaggcctggaaccctgagccgtggtactgaattgctcttacctgcagtggaagccaggctaggcctctgggcctgctaagtataatcccccatcattaaaaagattagtaagtgatgatggggcccaggcacagtggctcacacctgtgatcccagtgctttgggagggtgaggcacgagcatcacctgaggccaggagtttgagaccaacctgagcaacatagtgagactcctttctct

SEQ ID NO: 119445 - DNA, 154 bp, Homo sapiens
ggccccgggatagctccggagcggcgcgcgttggggcggcggggccccgtccacccccggccccgcgcggcctcctcccggcggcctcagtcccagcttcccgggcccagcgcccggtccctgggaaaggcggggttctcctctcgccccgccg

SEQ ID NO: 119446 - DNA, 397 bp, Homo sapiens
tgttcaacaataaaagaaatgaagtactgatacatgctacaagagtataccttgaaagcattattctaagtgaaggaaatcaggcacaaaggccacatgttgtaccgttccatttttataaaatatccagaataggcaaatcagtagagatagaaagtagactaatggttgccagtggctgtgggggtctgggagtgactgctaatgggtatgagttttcttattggtgtgatgaaaatgttctggaattagaaataatgatgatgtttgtttacataatttgtgaatgtactaaaagctatttaattgtatattttaaagagtgaattttatggtatgtaaattatctcagtaaaagggttataaaaggagaaataaaaagaatttaaacaatgaa

SEQ ID NO: 119447 - DNA, 188 bp, Homo sapiens
tgtgtgtttgtcttgcttctctggacaggcctagcttctccactcatgggtgcacccaggtcctcatcactgtcaccttagagcattagagcctctataggtgctccccaatctctgacctccccacccatggtggtcctggggatgcagacagaggaggggcactgcataatgctgagagggctggc

SEQ ID NO: 119448 - DNA, 574 bp, Homo sapiens
tttttttgtgagacggagtctcactctgtcacccaggctggagtgcagtggcgcaatctcagctcactccaacctctgcctccctggttcaagtgattctcctgcttcagcctcccaagtagctgggactacagacgtgcgccaccatgcccagctaatttttgtatttttttttagtagagatggggtttcaccatgttgaccaggccagtctcgcactcctgacctcaggtgatccacccaccttggcctctcgaagtgctgagattacaggcatgagccaccgtgcctagccttatatacatacttctcgatatgctttcttattctcatttctctgtagaatgtttcaggctttctgagcagttaaaggatctgtgaatatcctttgcagaagaaatagttgttttttctttcccacttcttattctttttccccatgtttttttggctgggacctccggtactgtgttgaatagactggttgtagctggaatccttgtcttcttttcctgactttaacaggaatgtttctaacatttaaacacagaatgaagattgctttggggttttg

SEQ ID NO: 119449 - DNA, 406 bp, Homo sapiens
gggctcagtgacccagttagaatgtgaatgcaagtcttactgcaacctttgttgacagatctttccattttctaagtgagtcaaaaatccaggtttttatccagaatgtacaaatgtttaagtattagaaaatgttaacactctgggaaggtcaaacaaaacagatacccacaggccagctgtggtccaaggactacctaactgattcttcctgttaattaacagatctcccaaatagagccaggaggaagtgccagctggtaaatgagaaatctcattattaaatgaaataatccaatgaaaacaccatccagggcctggcacaaaataaatgttcaataaaactacactcattactaacaaaacttcattcttacagccagataaatataaaatgcgccacaac

SEQ ID NO: 119450 - DNA, 461 bp, Homo sapiens
taggggtcttcctcacatttcaggcgatactttgctggaagttataagtattggggaggaaaagggaagagaacgagatgagaggaggagcagaaagaaggaaggaaaacaaaggacccatgtggaactagaatgttaacacacgttgctctggccacgttcctgggcatctgtccctggtctgcagtctttctagtacaggaaggaattccaatgtatagctctgggaatgactctgccagagccatttcctgggtgtgccagagcttgcattaacttttctaaccataggcacttctttcttcctttgttcactaagaagtctttgttcagcagcttctatgacctgctgagctctgctgggttggggggctaacagacagggacaaagataagtaacatcttgaggttcctccctcccaagagcttccagcctccagtctgatgttggagccagccat

SEQ ID NO: 119451 - DNA, 375 bp, Homo sapiens
gcacgagtctaggtgaacaggtttcattttctttcattactataaagatgtcactccatagtcttctgcctttcatagtctaataagaagtctgggccgggtgcagtggctcatgcctgtaatcccagcactttgggaggccgacatgggaggatcacgaggtcaggagtttgagaccagcctgaccaacatgatgaaaccccgtctctactaaaaatacaaaaattagctgggtgtcatggcacacgcctgtaatcccagctactcaggaggctgaggcaggagaatctcttcaacctgggaggtggaggttgtggtgagccaagatcgtgccactgcactccagcctaggcgacagagtaagactccatctca

SEQ ID NO: 119452 - DNA, 431 bp, Homo sapiens
gaatctgtctcaaaaaaattctattaaaatttacttaacgaatcccacaaatgagaaggtctgaaagtacatgctcaagttcagggctctttgctgtttagccacaggatatctgtttgttttcttcttagtttattttgcaacctaaatatatttgtagttgcagccagttacaactcaagttaatgaaacccctaactaaggattaccattccacatcggatgcagtgatacgttgcctgggatttgttctcaagcagtttgtgcgtaggcagagatgaagcaagctcagctcaagctgctcactgtcagccgactacggtggcttgcctgtaatcccagcaacttggtgaggctgaggtgggcggatcacctgaggtggagtttgagattagcctggccaacacggtgaaaccccatctctactaaaa

SEQ ID NO: 119453 - DNA, 397 bp, Homo sapiens
ccatattgtaccagggttggtctgtgcaaatgacatacagcaaatggcagtgtgaagctctgtcacttctgagatcaggctataaacgagtgtgacttctgcgatggagtcttctctctccccccgtcaccacttgctttggggaaagacagctgccatattctgagggcactcaagcagcttatgcagatatcgtggcaaggaagccagggaggaacccaggcttcctgcccccagccagggaggaactgaagcctcctgccttcagacacaggagggggtcttccagcccaggtgtgccttctgatggcggcatccctggtcatcagcttgagtgcaaactcatgagagaccttgagtctgaaccaccagctaagctgctcccagaaagtgtgtg

SEQ ID NO: 119454 - DNA, 265 bp, Homo sapiens
agaacctccaccctctgacgccatggtcagctcctgctgtggctctgtctgctctgaccagagctgtggtcaaggtctcggccaggagagctgctgccgccccagctgctgccagaccacctgctgcaggaccacctgctgccgccccagctgctgcatttccagttgctgcaggccttcctgctgtatctccagctgctgcaaacccagctgctgcaggaccacctgctgccgccccagctgctgcatttccagttgctgcagg

SEQ ID NO: 119455 - DNA, 684 bp, Homo sapiens
tcagctgttctgtgagggtaaaataatgaagctggttttgtacttaccaagtttgtaaggcattcagatgaaaatatctaatggatagctggaaacgtaggctgtcatagggaatagaggagttggaatgacttccaaattaactaacattcatttaataattgaatataaactgaaagcctagtttgttcagaatattataggagcagcattaccatgactaagctatagacactgattctttaagacttttgcaaaccagtagcaaaaataatgttcaataaaccgattacagcacaagaaaaaaagagtgtcaggtaccacagagtgagaaaaaaacaacaacaataaccaaaaaaaatagcaaaatgttgtagaaatttaaaaaaggaaatgaccccttctcaattaatctatcaagacagtgttccagaagaggttgcttatcagttggttcttgaaaagtggtatttggaaagcttaagaaacatagtacactagcctacagagaatctaagcagaagttgaacttttcactccaactaaaaatctatgttaaaaaaaatgagtgaggccccctctgcagtgaaagttactattttgacatttgtgagatcaaattttaagatcctctgggtatgtcaaagtcttttcgtaattgataggattcagaacaccgtcgaa

SEQ ID NO: 119456 - DNA, 746 bp, Homo sapiens
aagcagatatgacttctcaagttaacgtttttttaagtgatttccattcatcactaattccaaacaaaacaattacaaactatcataaaattattagaaagtgaaaatgggaggcattggttaaatatgtatttagtatgcttcatcatgtcctcaaacatatttaaaaagttaatctacacttctttaagtgtcctgggggacttgctttagattaagaaatatgttaactatttcaggacccttctttaagtatattgggagacttgctttagattaagaaatatgttaactatttcaggacactaaggactttacaaatctgaattagctcatattggctgctatctcctcaatattttctgataaataagaaacaaacagtaaatagcaacttccacaaaatctaccagtagtacacaagggcagccaaacttcaaaattcttgccactcgacgaactctagatggttactgtttactaaaatgtaaataataaaaagacttttctcaatcttgtcctccagaaagaaaagccataaagttcaaacactaaccaaaaaaaaagggtaaggagaaacatttaaatattggtgttccttttattagtgtcttcacatacaacacttctcaattttaaacaggactttgtttcagaagacaaaaccaagacaaaatggtagaaatcaaagggttatagactttgatttaaaaggcataaccttttcaaacatgagagctatcaat

SEQ ID NO: 119457 - DNA, 639 bp, Homo sapiens
tcttcctcctttcttttatttttttttgagacatggtgtccatctgttgcccagactggagtgcaatagcacgatcgtggctcactgcaacctccacttcctgagttcaagcaattctcctgcctcagcctcctgagtagctgggattacaggtgtccaccaccatgcctggctaatttttgtatttttagtagagacagggtttcaccatgttggtgaggctggtcttgaactcctgacctcaggtgatcagcccacctctgcctcccaaagtgctggaattataggcatgagccactgtgcctggcctgttccttctttctaatggtggattaccttcctgtaaacacactggaatttacagaaagacaagaaggtaatgaacaattacataatatatgctaggtggtgataagtgctgggaagaaaataaagcagtgtaaagggataaagattgatggttgggttggggattggtgtctcatgtagaacggtcatggaaggctcctgacaaagtgacattggattaaaggcctgaagaagtgaggaagtgagcccaccgagatctggtgggagaatgtttcaagcagagggagtggtgactgcagaggctcagaatggagcatgaccagcatgcct

SEQ ID NO: 119458 - DNA, 837 bp, Homo sapiens
aggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctatttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcaccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttggg

SEQ ID NO: 119459 - DNA, 619 bp, Homo sapiens
tgccgctaggggtagcggcggcggcggcggctgcggctcgggagcgcggctgctttgagggctcgggaaccttacagagtggggacgtggggaggctagagggtgagaaagctggcgggagagaggcggcgtggaggagggcggtgcgtggctgactcatcctctggaagatcagactgacagagacacacactagcccgcccaggccgcccgcgcggatgcctcctcaggagggaggcagcgcgcgcgcaccgaagcgcccgagcgtctccgggcgctgatacgggcccgggcgtctcagagaaagttttcccatcggaggggcgggagccgcgcgggactttggaaaggaagtggggacggaacaggaggcgagagccggcgggcccgacggagtgcatggtgcccggagcctcggctgactggcaggaggacctcggggcggggtcgagctgagccagctacctatctcgacctacagccgcgccagaaaccgcttcccggacggcagacgggggtcccaggtcctcagctcgacatgtcccggctgcatgcaggtgatgaggagcagggaccgcgcgcagactgagagcgggcccggccgacgacgacgagccaa

SEQ ID NO: 119460 - DNA, 230 bp, Homo sapiens
gtcacgcatgatcctatgtgattaaacagattttctaatattataatcaagattcttaaaatttaagtacagttaatcctccatttttaaacaacatgcaaatcagaaatttaaaaagacataaatatatgatatcaaaggtgtgcttgtatgtgtacatattatctgcatacttgttatgaaagacgtaaaggtattttttgaagtccctgcttctaccttgtatttta

SEQ ID NO: 119461 - DNA, 388 bp, Homo sapiens
ctgggagatagaaacttaaactatatggttgctgtcctcatgtaatttatggcctaatgagaaatgaacagggacacaaataatgattacaagtgacagaatgtggtgagtttgtaaaggtattaacaacgaataggggtcaggcatggtggctcacccctgtaatcccagcactttgggaggcagaggcaagtggatcacctaaggttacgagtacgagaccagtctggccaacatggtgaaaccctgtctctactaaaaatacaaaaattagccgggcgtggtggtgctcacctgtaatcccagctactcaggaggctgaggcgggagaatcgcttgaacccaggagggggaggttgcgatgagctgagatcgcaccactgcactc

SEQ ID NO: 119462 - DNA, 212 bp, Homo sapiens
caaattacaggcaccaatcgagactgctctaagagcaaacccatttttatgtactggcctggtgcaacaattggagtagcctcaggcaccagtcagaggggctagggtttggctctaaacatgaccttctctgcctcacccctgctcacatggacacaggggagggcagggggctcacatttttgtttgatgaactgtcaagcagagcctga

SEQ ID NO: 119463 - DNA, 608 bp, Homo sapiens
gggctcaccacccccccaccacattccctttgtgccacccacggtggccatgatgacatctgggaagtgggcagcacagcctgcaggctgtgtgggcagttggcactgagggtacttgggctctcatatttttaaacccagctctggccacctctgcagttggctcagacagagctgaggggttttcctttgggccccgctgactctgagtgggagggcccaggcaccactgtgtcagaaggcactgtgcccacggcagccagggggatgctcacagctggggtgggatctgtgtccttcagaccctgggagccccaggcagcttgagcaaagcttgtgggaaccgtgggtaggtctgaggctgtgggttggaaggagaaaaccagggaggaccaggaaagggctcgggagaggagaggagggaggaagccaacagaaggcagaaggagccgcaggacagaggtgggaggtccttagagagcatcgaatccgacccactccgtttgagatggggaagctgaggtcgtgagaaggaaaatatccagattctactgcgagttaatggcagagctgggacttgaacccagagctcctgatacccaagcaag

SEQ ID NO: 119464 - DNA, 449 bp, Homo sapiens
tgcctttgtggttttctgtgcagtcttatagtggggctcacatctggttggggaggtgcaggttagtattttagcccatgaatctgtggcaaatcattcatttgcatttattaataattcttagaatatgcatttaaaaatgtctgaatggttaaaggaaacagagtttcagctgcgcttttgggactggctgttatgtgtctggaacagatactgcaaccagccacacagtttaccctctggggataaacagcgggataaacagcttccttaggaatccttggacaggcaggttcttgaggacttcattcctttgaagtaacagagggatggtgtaaaagaaaaggacaatggcacgtggatccacaatggcacgtggatcacaatggcacgtggatcacaatggcacgtggatcacaatggcacgtggatcacaattggcacgtgga

SEQ ID NO: 119465 - DNA, 300 bp, Homo sapiens
accagtgcatcccacagctattctagcaccccataaacactccagtgtcccccacttcctgatcccgtaacaccttgggccctccagataacccgctgctccagcctggcagtttgtcaaccccctcacccagacccccaacacctcatgcctgtcttatgccatgagtctgaggcccctgacctgggtgccacccaggcctgtctgtgtgggcagctcccccaccagctcccttccatcccccatgggccttatcccgggtttcttacacccatgcacacactatccagcattcctgac

SEQ ID NO: 119466 - DNA, 202 bp, Homo sapiens
aaaagtgcccccattcacctagtgagacagggaagctctgggcatgaaattacaattttttaaaaagaataaacaactaattaacaaaaaattaaaacatgagatcggtgctttgccctgtttttgagtctaaatttattctacccatatggtgaactccaagtcacaaaagtaacaacaacaacaacaatttcccctgccc

SEQ ID NO: 119467 - DNA, 496 bp, Homo sapiens
caaaatggaactcatttctgtgagtgcataatgattatttctgataggatagcagacatgttggagcatttggaaaaaattaatcacaagtatatggaaagccagacaagtgggaaaacaaggaaatcattaactgaaggaaaaatacgtggtcatacaagaaaggagcaatggtcataggctcaacagtgaaaatgtttgtacagtcatagtgtaaacactgatgtattatccaagctgcataaagagatcttataaatcaattagaaaaagacaaccattggaaaaacgagcaaagtgtatgaatgggctaattcacagaagatgaaactcaagctcaactcatgagtaattggggaaattaaaactattcactggctgggcatggtggctcatgcctgtaattccagcactttgggagcctgaagcaggagggactgctcgaggccaggagttcaagaccaacctggtcaatgaagtaagacccagtctctac

SEQ ID NO: 119468 - DNA, 493 bp, Homo sapiens
caaaatggaactcatttctgtgagtgcataatgattatttctgataggatagcagacatgttggagcatttggaaaaaattaatcacaagtatatggaaagccagacaagtgggaaaacaaggaaatcattaactgaaggaaaaatacgtggtcatacaagaaaggagcaatggtcataggctcaacagtgaaaatgtttgtacagtcatagtgtaaacactgatgtattatccaagctgcataaagagatcttataaatcaattagaaaaagacaaccattggaaaaacgagcaaagtgtatgaatgggctaattcacagaagatgaaactcaagctcaactcatgagtaattggggaaattaaaactattcactggctgggcatggtggctcatgcctgtaattccagcactttgggagcctgaagcaggagggtcttacttcattgaccaggttggtctcgaactcctggcctcgagcagtcccgtcgac

SEQ ID NO: 119469 - DNA, 251 bp, Homo sapiens
aatcatgaccagcgcattaaccctttgatggtacccatcgattcctgattctgggtcctttttttttctttactgcctacattttcctgctttttcagataccatgagctctccatactgtctaaaagttccctctgccagcccactcatcaagtcagcatagaaaaggatttaatagatgccatttacgccttctcatttattgcctgattaaactgaagagtaaatgaaagacattcctgtagtgtcag

SEQ ID NO: 119470 - DNA, 350 bp, Homo sapiens
gcacgaggtttctactattaacttaaacaagaacatttgtcagatttgttcattcaaatattgtttgtagctggggatggtggctcacgcctgtaatcccagcacttcgggaggctgaggtaggtggatcatctgaggtcagaagttggagagcagcctggcccacgtggtgagaccctgtctctattacaaataaaaaattagctgggcgttgtggtgtgctcctgtagtcccagctactcatgaggcaaggctggagaatcacttgaacccgggaggtggaggttgcagtgagccgagatcacaccattgcactccagcctgggcaacaagactgaaactctatctca

SEQ ID NO: 119471 - DNA, 350 bp, Homo sapiens
tcaggctgtacacctaggatgtgtgcaacctcccctttctacattccacttcaacagaatgttttaagctggctgggcacagtggctcacgtctataatcgcagcactttgggaggcagagtcaggcggatcgcttaaggtcatgagttcgagatcagtctgcataacatggcaaaaccccatttctactaaaaatacaaaaattagctgggcatggtggcacatgcctgtaatcccagctactcaggagactgaggcaggagaatcgcttgaacctgggaggcagaggttacaatgagctgagattgtgccactgcactccagcctgggagacagagtgagactctgcc

SEQ ID NO: 119472 - DNA, 126 bp, Homo sapiens
agtgtgcagtttttggtggcgagaccttaccccctccatctccccgggggtctgggcctgctggaggtaggggtctgtttttttcctcccacataaagatttgccttggagctcggatttcagccc

SEQ ID NO: 119473 - DNA, 289 bp, Homo sapiens
attgggctgggctttcctcctttccttggatgacttcagaaactttatttacgttggtggccttttgagcccctttttttcagaccttcaattaatgcctcctggtattgtcttagcctctccatatctggtccttcattcagatcccattgagggtccattcctggcagctgaattcttatgtattcctggggattttggtaatcggctgggacatgctcctctagccatttagttgctgcctggagcacccttcgcttttcatctgtgttaaaggggtacatgagta

SEQ ID NO: 119474 - DNA, 799 bp, Homo sapiens
ggttgatgactagctcctttgacactggtaaaatgagacatgcagctttaattttttatgaaaattataatagatctagtggggaaaaatgaatctagaaactagctattttttttcagagtatcttagatttgtattggcctcactgatgctgagctctgcaacatttcacttaaaagagtcttcagcaaacacagtgtctcatgcaccttcctgtcctggaaatcctattttagccaaggacataatgtgccaacatctgaatcctggacagtgtctctttatgttttggggttatttttaaagtgtgtgtgacatatagatttatttgcactgaataggaaagatgtccacaatatattgtttaatgaaaataaaaagcaagctagagcacataatacacattggagggttgggtgtaaaatcttggatcagacggctttggtttaagtcttaactctggcttcctaggagctgtgtgacactggcccagtctcagaacctttctgtgtcttcattttctcatctggtgactaaataatagtctcttaattcacaggatcctggtgaggattaaatgaattaatatgtatacacacagcgagcagtgcctggcacacagtgagtgtttaaaaatatgcatatgtcattttgcaaaagaacacattttggaagaacataaccattcatctaacaaatatttacttagtaaactgctaccagtgattacctctagggcatgggaatgagagaggcaagggcaagaggactgagtttctgctttataagcttaggtatt

SEQ ID NO: 119475 - DNA, 553 bp, Homo sapiens
aagagaaacctctccctaggaaagcacgcataactacaattctggactcaatttcactgacacttctgacctcacacccaaggataagaaacgaatgggtctactgcctatttgaaaatatagacacacacatacatatctacaaaatcatgtgatcctacactgaaggattgtttcaacaatgcaaagtacttatgaggcttattaatagccttatattttcagttaacaacatattactagtggcaatgagagaagtcccaccacaaataaaacagcatgtttattctcaagtacaatgcattgaactgacacagactatcactccagttacacaatggctgttcagagttctcagttaatggaatattcacagtttaagaccaaacacaatgcacaaagaacagaaaaatagacaaagttgccgtattagggatagcaacattagcttcctggcaacagagactctggggagggctacacataaaattattttctattaagggtcagtaagtaaaaaaaaaaaaaaagtctgacaaaatatttcattcat

SEQ ID NO: 119476 - DNA, 180 bp, Homo sapiens
gtagggggaaatttttggctttctctgtttggtcctaagttggaagtagtatgggaaaaagtagggaatctgatagtttttaatcaaattgctaccccatctctacaaaaataaaaaaagaaagaaagaaagaaataaagaaaaatagccagctcctggctactcagaagtctgagatgg

SEQ ID NO: 119477 - DNA, 735 bp, Homo sapiens
cgataagcaccctgccttcttttctgtctttaacacaaaatatagtgggattttgacagattttttgttaatttgatcaattcagactgtcagttcaaatatttaaaatctcacaggcatttgtaattagatacaagtcattgattgaagaaagaggatagatgaaaacatcccatgacagcttcttaggtctagtgctatttacacattaccccacggggagccaagctgaacaagccactctatcctcaggctgaatcaaggtgccaccaataaaagttttcactgaatttagactggtggtttgagattaaataaagacagaatccaaatatgtttgggaaatataaaatgttttttgattatttagctttgggagcagataaggaaacaaaaatacaacaaacagatttactaagcactattttctgtttcagttaaggtatttgggccttaatagacaaattatacctaatagtaataatattattattataaacctcttattatgtgccaggtatgattctaaatggtctctctcatgtaatatattacatatcatcatatattctattatatactatgtaagacaggatagttacgtatagatgtagacactcaattcttaacaatagttttatgacatgggtacaatgatcatcatcccatttgatagatggtaaaactgaaacaaaagttagctacctcagccaaagtcagacagcttctaaatgg

SEQ ID NO: 119478 - DNA, 556 bp, Homo sapiens
acttatcccaggtatgcaaggttgatttaatatttgaaaatcactcaatgtaatctaccatgtcaacagcttaaataagaaatatcttatgattatatcagttgaaaatagtctatgtagaaattacaagaaatctaccaaaaaatttcctgcaaataaatgaattcagcaagtacatgagatctatgaccaacacatgaaaatcaatctcatgtatatattctaacaacaaacatacagagactgaaattaaaaacacaatacccatttacattgctcaaagaaaatggaatacttaggtatacactaaacaaaacgtgccatatatttttgctgaaattacgaaatgctgatgaaagaactcaaagaaggcttaaataattggaagggcttatcatgttcatggattggaatactcaacacagtaaagatatatattattgtcaacttaatctggaggtttaatacaattcctatgagaatcccaacaagatttttgtagttctagaaaagcttctcctaaaatttatataaaatggcaaaagacctaaaatat

SEQ ID NO: 119479 - DNA, 231 bp, Homo sapiens
gtctcctagggttattctgaagactgctggagaagatgtacacaccatgctggcattccttgacatgcttcacataggcgctgttctctgaggcagggttccaggaagctcatagtcctggcattcattgtagaatgaatgaatacaaatgcctctgccaaacacagtggataaaaacagaaatgatcattaatgtatgtgaatggagtagattgaaagtaaagaaaaccc

SEQ ID NO: 119480 - DNA, 266 bp, Homo sapiens
cccttgaatatttgtatcagctattttgacacatgacagcattctcaggtaatctgactagcaactgttttttgaactgaattgttgtgaaacattcaggtttttagttcttttttgtttttaatttttaacacagaaacataaataatgttcatatcctcttggcattgtgatggttatttgcgcttatattttatatatcagtttaaatgaagcaaacgttaagtaataaagccagtcttttgttcatactgcattgtaacatt

SEQ ID NO: 119481 - DNA, 357 bp, Homo sapiens
tcgtctttactaaaattacataaattagctcggtgtggtggcatgcacctgtagtcccagctacttgagaggctgaggcttgagaatcacctgaacctgggaggcggaggttgcagtgagctgagatgatgacattgcactccagcctgggtgacagagtgagactccgtctgaagacaaacaaacaaaaaacaaaaaccgaatcctttagccaggcgtgtctcttgttggataagtcagtttggaatcttttggatgttttccttcttttacttgctcagccataataaatctttcattttaattttgatcagcagcattgtgaggtcctgcccagtgtggtaatgggcagttagc

SEQ ID NO: 119482 - DNA, 281 bp, Homo sapiens
gtggacagcaggacgggatgcgggtgcctagagggggtgccatctatccccaccttttcttcatttcccatcatgccacaaaattcatttattgattcaaacccacatatgccacactcctactatcttccaaacactattttactaggtctcagaaatacattggtgatataaaacaaaaaatccctgctctcatagagcttacttctgtctggtaagacagacaataaacaagataatctaaagtcatttaatcgtgatggatggcttttcttttttct

SEQ ID NO: 119483 - DNA, 345 bp, Homo sapiens
ttcacttcagcctgggtgacagagcaagactttgtctcaaaagaaacaaaaacaaaaacaaaatacattcagaatctgacttcctccatcgccttccactgacacttctgtggcccaagcctcctgtctctagctgggatcagtgcagtagctatctgctcccttgtcttccccttctctctcagcacccttcagcgcagcagcagccagagtggctctggtaaagagagtcagatcatgtcactctgagcagaggcttaagaccctccagtgactccccaagtcagcccacatgagagctgacaaggtcctaccctctttctctctaacttcacccactgtgat

SEQ ID NO: 119484 - DNA, 280 bp, Homo sapiens
gaagggtttgatataagtatctttgatattctgtaatttaaaaacataataccctgtaaaggagtggctgaaaatgactgaagaagttgtaatcaggaatacaggtaaattcacttagaggaaccattataacaagttcatttctataaaaggtggatggctcatgaaaaaatggtttcattaatttgtattgtaaatgtatcatacttttgtgagtacgtggatttcttttaaagaaaggggtggatagtggtgatggtatttggggttgaagataaga

SEQ ID NO: 119485 - DNA, 319 bp, Homo sapiens
caggccctgccaccacccagctcctagtgtatagggcactgtgctcactgttgtgggggtgaacacagagatggccataccgctgccccttccctggaggtactcagtgtggctggagaacccatgcatctgcagtccccacagttagcctggctggacttgcagagcctgaatcgctgctcacagggttgctgtgagaattacaggggatcatacctgtgaagcatttagcacagtgcctggcacctaggcatgccctagaagttctggctggtgtcatgttgtcattggcatatgtctgaccttacctcctgtgagg

SEQ ID NO: 119486 - DNA, 307 bp, Homo sapiens
gttaggaatacagaaaggatcatacccgccacgtaacagaggaaagatggtcacgttttgtcacatgtattttgaacaatatttccaagatttacttaaagctgtttgttgaagggagtgtgggttgcaagtcaaagttcatcttggaattgcactctttccttccccttctctgtaatgcatcctgtgaatgcatcatggggattatactgctatagtcttgcatcattacgacacacctggctgcacttttagccaactcttagctggccaaatggtgcaaatagtggatgaactgatagtgatg

SEQ ID NO: 119487 - DNA, 808 bp, Homo sapiens
gaatgaattgttagaagtttttatagttgtgggaagcttttatggtagaaagatacaatgactatgcaaatataacaagttaaaagtcatcttttaaattatggttttactttggcttcatcccattttttgtttttgttccttaacatggtcaaggaaatgaaatattttaaacagtgtggtagtacaggatggatatatgttagtttactttgtcaaacacaattttagctgtcacattaggcttaagatacacatttgtctatttataatttttctagagaaattacctctacctctatggaggtagacttgtattgaggttaatttacaattaagcacagcctttagtcttaattatatgtatatttagggtacttctatagaggctgatggtgattatggtgtaaaatcttccaactaccactgctctcttcccactggcccctttgtggttaataaagttcaagagcagctggcttagtgtggcatcttatccaggtatgttttgtattacaaagtgaatatgtgaggatagataaaatctagtaagggcaaagaaattaaaccgtagaagtgaacgcaagtagtaaagttgatattttgaatgaatagatcaggattcttctttttataaaggcagccctggacaaaaaaagatgggattgtagagctataggtatgtagagagtccctgatttggctacattgctggatcttgggtcttagaaatgtgatatccctacccatcatgcattagtaaatgaatgaatgaaattttgacagtgacccttaaaatcaatgacta

SEQ ID NO: 119488 - DNA, 574 bp, Homo sapiens
gggttattaaacagaaatctcccaggcaatgaacctcttctgcagagtgcaattctgcagagaaggaagcagctgtattcatcagctaatacccacagcagctgggggatggatctatctgccttgtaaagggggcctgaactggtcaccagctgtgtaaaacactatggtatagaaacactgtcatatatatgttaggaccccagaacagctctgaagaaacaaataactgaaacatactgaagaaagcactgcagaacctgaacacttaaattatgtacgtagagcattgcttctaaaaatatgctatgagtacgactaaggatgctaggaacacatctccctttctaacattgggtttacgaacatcctctcccctcaactacccagtttgcttagcagtagcagctggtggtgaattctgccattagggcaagatgcccagcaaggaaagaactgggttggttaggagaatttaaggcagatgaagtctctggaatggggatatggtgtgtagggtgaaaggagctaaaagggaaaggtttctttgtgtatgaaacccactcaccaatct

SEQ ID NO: 119489 - DNA, 356 bp, Homo sapiens
tttctaggacatgtacgttaccaattttatacctcgtttgattttcaagacaattttaaacaccaaaaagataaatccttaaacacttattagtgacctaacaacagaagaccagaaaatgcagaagctaagtgactttgaaaagcaaaaggtcagctttcctgtgctcactataaaaagcttagttcaaaataaagcaacctactattagtgttcactctgagctgaatcctctcattttccctacatagcagcaagcatccaggggaaaatatagccagtgtctcctgagatctatccgtgctactggaaaacacacgctcggacagtcttagaggatctttaaccatcggtgc

SEQ ID NO: 119490 - DNA, 278 bp, Homo sapiens
gcccccagatctccccccgctgaggatgccatgagtttggctttacccactgtgtgatgaccattttcggagccaccgatgggcttctccagccctcctggctttgcggggtgtgggtgtttgggtaatgtgatgaaaaaacctacaccccaggcagtgggtgtctgcctctgtactccttcacctttccattctataaaggttcctgggcataaaagtatccagctaaatccacacactggttaagaaatgctaacagctgtgaggaattacatgag

SEQ ID NO: 119491 - DNA, 630 bp, Homo sapiens
caagactctgtttcaaaaaaaaaaaaaagaaaatgacacaaatatcaatagaagaatggaaaaacaaagtgtagtatattcataaaatgacatattgtgtcacttagaaattatctgttgtctacaataatgatgtagaatttactatacaatgaggatgcctatttttagccttatttttagtttcttcaaattctgtctcattttaaagtacattttaaacagtctctagttgaagatcattttgattctgaaaataaccttactttttgtttagtaactcacttgggttttcttatcacaatagaaacttttgaaggatttttgttttgttttgtttttgttgacggagtcccactctgtcgcccaggatggaccacagtagcgtgatctcggctcactgcaacctctgccccctgggttcaagggattctcctgcctcagcctcctgagttttagctgggattacaggcaggagaatcgcttgaacccaggaggcggaggttgcagtaaactgagatcgtatcactgcactccagcctggtgacagagcaagactccatctcaaaaaaataaagaaaaaaaaagaaactcttaaatatatttgtacctatatattttttctctctc

SEQ ID NO: 119492 - DNA, 469 bp, Homo sapiens
ggactttgttcttggagcctcacgctgagtctggcacacagaagacacaagacattgttaattcagtgtttgttgtatgaggaaggtagacagactggaaacagacttccctaaggtcttatagctagcaatggcagaaaagtctattgaatcctaaagccgagctgagggcctttctattctcctaggtctgcgttgggagaatgagcaagatgccttggccctcactccttcggtgggtcccagcacgtgccaggggcagcatgtgcggtcacctgtatgacccctttgctctagtcccaattccctactacagataaaacatcattcacccctccgcaggctttctgttctgaatcacgattaccagcatgtctcatagctcagatcctaaccagcacttactaggcagaattcagcacttaagtgacccattaaggacttttggcagaggaatgggaaagataaa

SEQ ID NO: 119493 - DNA, 474 bp, Homo sapiens
atgctaaattttatttaaaactatatggtcccatatgtttctggttgacattttactaggattttctgatttcaacatgttctcattaagtactatgttttattaactgctaaaaatgaatgtaattcaaatccatggacgttcaaaaagctcagtaaatactttttagtaataccgcttttcggcataattcaagtacatagatctacttagtttcacaatatcggtatagtttgatgtgtattagaatagttacaaggttattaatcccactagttcttgaaaaaagtttacattaatttgtcttactttcaacttgacccattttgtataataatttaaaggaaattaacacattttgactaaacataaaaaacttactttaaaaaacctgatggactctaaactttaattatatgggttacacatgagtaaatgttttcaaatggacatattttattacacagaaataaa

SEQ ID NO: 119494 - DNA, 824 bp, Homo sapiens
cctcttcctgtgtggaagctgggattccaatggcaggcaggaaatcttgtagtaggtgatcgtggccttccttgggatccctgtttcccccttttattcccttttcacccagtaaaaccctgctttgctcactctttaaagcatctgtgagcgtaaatttttgtggccatgggatggacaagaaccacatgtttacctgaagtcctgtgacattttggtgtgcagcatgggagctccaaaagtgagtcaagtgaacttattttgaatggtttatggcctttaataattacataagttatatactcctgtgatcaaaatttggagcatgtttgtttctctctgcctggttcctccagaatttagaacctatctacattctttcagatgccagaggatgctatagaaaaatgcgtgccctcttgtaatactttgttcaagttctgatcagaaggatgaatgatggagcccaagaagccagagtctcattgtgttgctcaggctggaatccagtggcatgatctcggctcagtgcaacctccgcctcctgggttcaagcagttctcctagatcagcatcagcgtcccgagtagctgggattacaggcacccgccacatgcctggctaatgttggtcaggctggctcgaactcctgacctcaagagatccactgctttggcctcccaaagtgctcggattacaggcatgagctgccacacccagcctccaaatactttttttttaaatcaaaataatgatttcaatgactgagatctggttatgtatttcaacataatcatgtttcataaagatttagtcttctgaaa

SEQ ID NO: 119495 - DNA, 606 bp, Homo sapiens
cctcttcctgtgtggaagctgggattccaatggcaggcaggaaatcttgtacatctgtgagcgtaaatttttgtggccatgggatggacaagaaccacatgtttacctgaagtcctgtgacattttggtgtgcagcatgggagctccaaaagtgacattctttcagatgccagaggatgctatagaaaaatgcgtgccctcttgtaatactttgttcaagttctgatcagaaggatgaatgatggagcccaagaagccagagtctcattgtgttgctcaggctggaatccagtggcatgatctcggctcagtgcaacctccgcctcctgggttcaagcagttctcctagatcagcatcagcgtcccgagtagctgggattacaggcacccgccacatgcctggctaatgttggtcaggctggctcgaactcctgacctcaagagatccactgctttggcctcccaaagtgctcggattacaggcatgagctgccacacccagcctccaaatactttttttttaaatcaaaataatgatttcaatgactgagatctggttatgtatttcaacataatcatgtttcataaagatttagtcttctgaaa

SEQ ID NO: 119496 - DNA, 317 bp, Homo sapiens
ctgctctgtgccagcatgtatctcacaataggctaaatggtatcctgaatatgtaaataattcagtcctgaccctttagagattcatttggtgaaagtgatccacatagaaaacccttactaaatcctgtgtatagctaggccaaaaagcagaggcagattatctgaggtaaacaattaaaaaaaaactactagctgggggctgggcacggtggctcatgcctgtaatcccagcactttgggaggccaaggtggatggatcacctgaggtcgggagttcgagaccagcctgaccaacatggagaaaccctgtctcta

SEQ ID NO: 119497 - DNA, 348 bp, Homo sapiens
aggatcagacacagcaggcgtacatcccaggtttccagactcctaatcaagtgctctcttcgctctgtccctatccagtggtggcagcccatgtctgagccctcagggctataacaaccatgcaaagctcggacggggcagggtcatgccaggtgtagagaaacctctctgcaagctcaccagagtataagctgccctctcggagctgttccctggcccccttctttccccttgccatctaggaaagggtgggtggagggccagtgatgtggcaggggaagtgaaacacacttagacgctgaatgtttgaccttccatgggtgccgatgaatagcgaggggatcctct

SEQ ID NO: 119498 - DNA, 311 bp, Homo sapiens
atttaggggtgaagaataatgatgtctgcaatttagtttcacacagtttaggggaaataaaggagggagaaagagaaaagagagagaatgccaacatgcgaggagttaatagatttttgactctagattgaggccatatgggagcttattgtgctattcttttgatttttctgcatgtttaaaattttttctttttaaaaagttggaggtaagggaaaacaagtatttacagaagcagtactttgattgaaagaaatggattaacaatcaagtttggccaggcacagtggctcacgcctgtaatcccagca

SEQ ID NO: 119499 - DNA, 590 bp, Homo sapiens
tattcatcatgtcagtgacagaactaaaataagagagctacatatatgaagattctaaattggaattggcaagccactctccaccagctaaatgtggcctactgcatgtttttataaatgaatttttattggaacccatcacacctgttggtttgtatgttgtctaggcctgcctcacaggtacaaagacacattgagtattgcagcacaaactatttggcccacaagcgtaaaatactatctggcccattaagaaagaaaatttgcaacctctagtctaaatgggatcaactctgtggtagctaatttgttttgttgaagaggtacacatactgtaaaaatttatctaattctgtcttaagtcaaattatgagggttttctctacactgaaaagactaacattttaagtctctctttactagtttaacatcaaagtggttaaaagttgtttgcctttttaaaaaatgttcagattgcttagtgttttgattctatggtgatgacagattaagaatttatcacttctttctgtatgtgtgtatgatatatgtttaatatatatttactaaatataagatattcaaaacac

SEQ ID NO: 119500 - DNA, 379 bp, Homo sapiens
aggtaatcttatatttattaccagtgaccattgtggcagcaatggttgttaggttttataatgttatatcactgctcaccaaacagaatttgttcttttgttatggagcaggttcagtaataagagttggtgagtattattcagaagagaagctgcctcttgggttgagtaattaataaagtgattcattgggaggtagtttttgtctgtaagaatctctaaggaatgatcacaatgataagttttaggacatcccgttttaaaaactggactcttacaaactttgttatctagatagcattaggtataactaaattggggagacaaaagtgaaaaacgattaaccatataagggtggtttcatgcaggtactgtggat

SEQ ID NO: 119501 - DNA, 722 bp, Homo sapiens
ctgcagtataacacgaaacttttctcacaaagtttgggaggcacatcaccaatgtgttgatcagcaaatatttattaaactaatgctcttggagaccaagccaacagttaagagcacgggcagtcctgaacataatcaaacctactcgattatagattggagaaagcccagaatccaagccccaagactgtcccttaatcactatgtgaggataggaaagcgctcagagcaccagttccctcatttgtaaaatggggcttacagtcccaccctggaaacatgtcttaaggatcacatgaagaagcacaggggaagtgcttggaacagcagctgccatttggaaggtggtaactttgaagttgatatctaccaggaaagtgatcacaagggcagaactctgacttttcccattttcctaagatctatttctaaattcagtagcattggctctctcagtctaacggcagtcagtccactgtctcggtggtggtgttttttgaatcattaatcagaatgaatagtctatggtacagataatacatgctgctgagtttcagaggacggaggtgttttcttcagatgcatgttgaggaaaagattcacacagtaaaaggtacattccatctgaaaaaaacgtagtggggaggggcgcaaagagctgctcagtccaaccagaatgtatgtgtctaccatagaattacagtaatttaaccctggaaaga

SEQ ID NO: 119502 - DNA, 420 bp, Homo sapiens
cccagctgtctgacacaggctgtgcagccagtgaagcctcagccctcacagttgccacaaaactttgggagtaaaatctgaaaagcttttacattcaaaaccattaaaaatctacttgttggctgggtgtggtggctcatgcctgtaatcccagcactttgggaggccgaggcgggcggatcacctgagatcaggagtttgagaccagcttggccaatgtggtgaaatcccctctcctgtctctactaaaaatacaaaaattagccggtcatggtggcgggtgcctgtaatcccagctactctggaggctgaggcaggagaatcgcttgaactcagcaggcggaggttgcagtgagccgagatcatgccattgcactccagcctgggcaacaagagcaaaactgtgtctcaaaaaaaaaa

SEQ ID NO: 119503 - DNA, 562 bp, Homo sapiens
gcgcctagaggatcctcactggtcgagttccacataatctagttttttggttccacataatttgggaggtggggggagcaagtcaaggggacacaagtatgtccaaaatcaaatcacaggttactataactacaaaaaatgttcagattactgcttttgtgtaatgaaaaggtagaatagtaatttatgtcctttaaaactactagctattttattttaaaagcatatatcaaggtgatttaatagcactattaaaaaacctaaaaattgatatatatttatagacttaacataaaaaataacccataacaaatacatctagatgaaacaaattattggcttagaaacaacacagcatttctggaaaggaattatcaagagcagaatgaggaaagcataagggaatctaaagtacaaataaggccaggggctatggctcacacctgtaatcccagcactttgggagggccaggcgggcggatcacctgaggccaggagttcgagaccaggctggccaacatggtgaaaccccatctctactaaaaataaaaaaactagccag

SEQ ID NO: 119504 - DNA, 187 bp, Homo sapiens
tcaaattcttaggagttaattttctatgtttgaatctttaaaaagaaacatacaaatgtaggatgaatacattcagagggtttagtgcatgctttggctagcaattcaataaagatgacttggaaggatcaaagcaaagatttccataaaattgaatatgagatatttcagcaacatcaatgctata

SEQ ID NO: 119505 - DNA, 297 bp, Homo sapiens
ctggaagtgtggtgacaaccaaggacaggaggggctggggccggtggccgtggctggtgaaccctggccctgctagagacaggaggggcactggcgctggggctggacccggaaccttccctctccttcgccccacactgaggtgggcggggcctcaggctgcactttggcccagggcctgagtctgctcctggctgggatagcgggacacacccaggcggcttgtgcagcgtctggcctcgcctcgatctccgatctctcacgggcacttgaccctctgtctcacgacttaaataa

SEQ ID NO: 119506 - DNA, 714 bp, Homo sapiens
cttttattaaaaattacttttacattttacttttataaaaatgtcagtataacctggtcaacatagcaagaccctgtctctacaaaaaaataaataaataaatgaaaatagctgggtgtgatgactcacgccggtagtcctagctacttgggaggctgaagtgagaggatctatcacttgaaccaagaggtgtgaaattacagtgagctacgatcatgtcactgcactccagcatgggtgacagaatgaggccctgtcttaaaaaaaaaaaaaaaaagaaaaagaaaatgacaatctgcttcctaagcatgtttgttgtggagataaaatgaagattcagaatataggtgaaaagtgtttggaaatggagtttcaaggaacatgtccttccatcatgatctggtcccacttgcctctccaatctttctattcatcattatctgctcccattctcccaaactctatacttagtcctaaatactttctgatctcttgtgctttgggaacctttacaaatactgttctgacccagtgttctcccctttcccccaaaccccgccaaaatctagctgctactctcattgttcaggttcccattcctatcttgctttcttcatctcctcaaactggattttaggtatttcttcttatggcacttcatttattatgttttgattgccagtcttcttatttcttcccttcaatagtatggct

SEQ ID NO: 119507 - DNA, 125 bp, Homo sapiens
aagcaataaaactgaaagattaggaatatattaagaatcatagtatactggtaaattattaaacaggtacagaaataataaattttataatcattgtttatacatgtcttttatcagctgtttaa

SEQ ID NO: 119508 - DNA, 488 bp, Homo sapiens
taaggcatcgccttgatttcttcttaaaacgatttattctggggctgatttttcccaaccttaatgtaattgtactttaatcaataaaaaatttcctgtggaacaactgggaggggtggggaggagagaagcccagcaaatgtgaattgttgtttatttgtctctcttaaacaatgtttcacgttaaaccagttgcaaatgaaatgaattgtattataaccatcttggaaaaatagctgctgatctcataaattcatcgagcttcctggttccaaagccctctcttacaataatagtaagtgttgctgtgctcagtaaatatctgcctccacttggctggtagtgaaggaactagaatggcaaacccaagatgggccccccttctgcctcctccaaaatcacaggttttgtgctgaccctgaacaggaatggagaggaacatggcttcccaggacagtgactactgtcctgtctcctaggatgccagt

SEQ ID NO: 119509 - DNA, 231 bp, Homo sapiens
ttttttcctcctttgttagattcaagatagtgagacatatacatacgtagttactctaccctggcttcctggcaatcatttagatagtttcttttactaatttgatcctcttcgctgataactttttcttttctttcttcttcttcttttttttttttcctttttcttttttgagacaaagggaaacaccgggttaccgagcatcgaatcgtaactagtggtcactagctg

SEQ ID NO: 119510 - DNA, 704 bp, Homo sapiens
gcgagtaggaaatgccagccgataaaggaagagagcgcttggagactgatgccctgttaaaccaatagtgtgagagatgggagaaatttggacggggctttccaggatagaggagctaggggaggggctgaggagaaaccggacggggtcctttgcccggctgtccttgggcaacttcatttcaaaagcggcaccgtgtgcctcagtttccccactgatctaggaggtgcttgtatatcctccgtttaggacgtcgacgtgcctcagttttactgtagtcaataagtctggattaggggcatggttcgggggtgaagtctgggttctggagacatggcctgggaatccggaaaaggactttgagccagagaggacattcatctgtgtactcattaatgcgctcatacgccgtcctttcattcggttgacagactatgcggcctttttgctcagcactgggagatatactcctgatccatcactgtcaacccagagtggtcgggaaagtgggagccccggagctcagaggaactggctgacccagggacctgaggccagcagggctgcctagagggggccgcccgagctcagatctaaagggcatagtaaggtccggcgcggtggctcacacctgtaataccagcactttgggaggccgaggcgggcggatcacatgaggccaggagttcgagaccagcctggcc

SEQ ID NO: 119511 - DNA, 678 bp, Homo sapiens
tctcaggcagatcattgccccctacaccatggtcctgggcagctctaggattacatcattcttccaacttatgattcaagtaaacactcatctcctagcatgcattctgcaaaatatctctgtttagctctggttaggtcgcatggtcgcttttgaacaaatcacaacatccaaggatctgagatcatgtacccacctagagtcaggcgattgacagcttcagttggaagagggatggttcccaaaggacaagaaggcattttgttatcagaaaggaggagatgggatggaggcatggaaaaatcagcaggtatccactagagatcaccattatatacgtactttatatattttgtatctaagaagataaattttatatagcacgtatatacaatatttacatatataaacatatatttatagaaaaaagactagaaggaaataccaaaataccaatatatgaagagcagttatctcaggtggggggatttcaggctagtgggtttttaaattttattgtttattacttccctgaaacctccaagtttcttacagcaaacaaacattacttttaaaatctagggccagcggtggggggtcaggcccataatgccgccctttaggaggctgagcagggaggatacctgggtccagatttgagaaccgcctggccactaa

SEQ ID NO: 119512 - DNA, 503 bp, Homo sapiens
ctgtagtcccagctactcaggagcctgaggcaagagaattgcttgaacctagaaggcagaggttgcagtgagccaagatcatgccactgcgctccagcctgggcgactgagtgcgactccgtgtcaaaaaacaaacaaacaacactacaatgagatcctactacacacccattaggatggttataattttttttacaaagcgagtatatagagaaattggaatcctcatacatagctgtgggaatataaatgtgcagagaacacagtttgcagttcctcaaaaagttaaacatagacttactacatcacccaagaactccactcctaagttacagtgtggatgcacttcaaaagccagatataaaaggccacataatgtatgactcaatttttatgaaatgtctccatagacacagaaagtagattagtggttactaatctgagagtggggaaattggggtgtaattgcttaacagttatggggtttcttttatgggtgatga

SEQ ID NO: 119513 - DNA, 729 bp, Homo sapiens
  misc_feature (142)..(142): n is a, c, g, or t
  misc_feature (167)..(167): n is a, c, g, or t
gggagaaggaccttaggtacccaattcgctagggttcgtcgtcccgtcctcctacgtgaggataaggtagagacgagtggcgtctatcatcgtcgaactccatactgatgatcacatgggcttgtagacctcaatagcattngcgatacgttcatccatacttagtnagacagcgcacgcagcgccgactgccatgatcgcgtgcgtgaatagatccatcgtagggcgtccatcacgtcgtccttgggtcttggaaccggagtcaaaggcgatctccaggtcatttgtgctcggtcctgatctgtgagtaataaatattctgtcctctgatccagaggtctggggtgttggggtatgtgagtatgtgtgtgtgtgtgcatgtgtgtgtgtgtgtgtatacacacaaaactggcagactaatttcttagcttgtaagtagcataaaagtctcagaaacttcacagtttcagacttaatgattggattcctccttcctcttattttacatttggggaaagtcaactcctgaaaggagccaattgacttggctaaggcacacagctatttggacctgatagattctgtcttttccatcagacttgacagagagcactggcaaggtaataataaaacctggacttgaatctaagctctgccatttagttgtagtggaggttttaaaaagtgtggatgaaagcctttattttctcatctgtgagaagcatataa

SEQ ID NO: 119514 - DNA, 214 bp, Homo sapiens
gatgtcagctccttgggagcaggaccatattttctacttggtcaatgattcccacacatctagaagagtagaataccctgtacttgctaccacatgatgccaagggaagcacacaaattaagtgtgacaacacaccacaatgctcccccaatacaccactaagacagcagagctacaaagatagcaaatgttagtgccaagggctagtgatcct

SEQ ID NO: 119515 - DNA, 366 bp, Homo sapiens
attacaccgggtatcttatttttttaagagaagcccaaattaaatgcagtttatttttcttgaaaagaaatgctgatctctattcatagcctgctaatagcattatttctttttttttttttattttcggtacacacagaggaacagaagggaggggtgtaaaggaagggagtgttataaagacttttttgtagaagtgggattttttgcaccttcaattacctcatggcaggtgcaatgaccactttgtgctctcttgaggacaaaagtggcaatctgtacttacaaatacatgatcatatcagtaaaaatgaggccatgctgaaaatttgccccgagatgtttaaaggacactgaattttgact

SEQ ID NO: 119516 - DNA, 129 bp, Homo sapiens
taccacaacaatcaacaaagaagatttctgtgactaaatgtggggtggaggtgggggactttttccacacaccccaagcaagcaatcagttctgcagcagtcactagcagggtatcctccagttcaact

SEQ ID NO: 119517 - DNA, 658 bp, Homo sapiens
atatgttgcctacaagacagttcatttttaaggatacatataaattgaaagtgaaaggatggacagatatgccatgtaaatggaaactaacagagagcagaggcagatctcttaatatttacatcagatgaaatagaattaaagtaaaaatttttaagcagagacagggtcattatataatgataaaaagtggtctgttcatccatggggtataaaagtcataaaggtatatgcactcaacattacagcacctaaatatataaagccaatattaaaagctttgaaggaaaatataaaatctaatacaataattgatgggacttcagcacacctctttaagcaatggtgagatcattcagacagaacatcaatgagacatcagacttaaaccacaattgaaaaccaaagttgcccatatggacctaaaagacattgatgcagtcttctgttcaacagcagtggaatacacgtttttcaaaagtgcacacagaatattctccagagtaaatcatacgttaggtcacaaaagaagtcttaagaaattttaaaagattgaagtaatattgaatatcttttctgaccataatggtatgaaactagaaatcagttataggaggaattttagaatattcacaagcacatggaaattaaataacat

SEQ ID NO: 119518 - DNA, 331 bp, Homo sapiens
ggagcctcaggaagctaatcaacaacctcaaatcacaaaatcagaaaagtgttgaacatttagaagaagaatagaaaggaaaaaaaaatgcctctgagttgtggtattaactgtcagtagagcaaaacaaatgtgtacgcccattttcttttttttctttttctttttgagacaagagtctcactctgtcgcctaggcttgagtgcagttgcacaatctcggctcactgcaacctccgcctcccaggttgaagcaattctccttcctcagcctcccaagtagctgggattacagatgcttgccagaatgcccggctaattttgcattttta

SEQ ID NO: 119519 - DNA, 507 bp, Homo sapiens
ctctagaggggctaaacgagaggttctgggcttgagcctactaataccaggcatagttgagggtggaggtaagactctacattaagaacaggattaagtaaaattctctatgctgaatggtgattccctcttcctaccacttcctctgtttaactgccagaatgccaataggcaggagagtagatatgtcttctctgggtagttgaccaggtacaggaaagacctacaaattcactggcttttccacaatgaaatagccagctgccttgtcatcttacggtgaaggcctccagtagctaagttttattagcaaatagagatcttagtttttagtttcttgtcattaaataaaaagccaataaaaagcaagctgatttgtgctgtagacttctggggaggctcaggaatttgaagcattgggttctttttgggacattggtctctgggttagcctaaaacagggattagttaaaaatctgagaagcagatccttttccttagcacagg

SEQ ID NO: 119520 - DNA, 314 bp, Homo sapiens
ttcggctgtagtctgtaccttacaggggtccggagtgtgggcagctcctggcttgtttgcctgagagctcatagggcaagaagggtgactggactgaccttgaattcaggtatcctttggtccttcctaggccttcggcttaaaaaaaccaaaagtgctagtttgctttgggcagtggcaagaggagggagagctgacattgtaagatttgaagatgtgtaacagtggttagatttgtgataaatatgtgcttggatgtaaattgtggaaaactgagatttgaatgtaaaaataactgacatattagggtatca

SEQ ID NO: 119521 - DNA, 518 bp, Homo sapiens
cctgcgtagcccaccccttcccaaagtgactgccaaatcagcattctgtcaccccacagtgcttcctaccttgccaggcaaccaccccctcttcctgaactgccttttaggaaaatgaaaagtagataccttttctggaaaagagtaggggcagcaggccttagaaaaacacacaattacattggtcactgtggctcagtgtgaaacggttgcccacatggtacctagtgaccacaagacaccataaggcctaggtctgggcttctttaggaactggttcttaccctgctgtgggccccagtttccagagaggtaaaatgtggtctttggagcagacagtttttctagtcctaatatcctgggagttctttctcccaagatctagggtcttcctggacccatttgaggatgttagctgggctctgagtaggtggcagtgcactttcaggatggcatgggctttatgctttagtcagtgtaccatgtgagcccaggtatttcctctgtcaggaagcttc

SEQ ID NO: 119522 - DNA, 305 bp, Homo sapiens
tacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctgg

SEQ ID NO: 119523 - DNA, 467 bp, Homo sapiens
gggggggaaatagaagagagtatttttgaacctcaacatcctgttgttcgtttaagcacagagaagaattcaggaagctagactctgggttcataatttagattgatatatttcttttattcctcttcttccctaattcactaggaactgaatcaagcggtcagaaatatttttttgaattgtcgaaaatcactaaatggatttctgacagctcaaaaaaatattgacagttccttatgctgaatgattcacaaggccccattaaccactacccccagatctatttttagccacatacaattcattacttttgaagctgttaaaaacaatatttaaaagaagggaaaaaagcgttttatgttagtccaaattttttccccttttttttttaaactgggggagcaatgttgaaggcttttttttctttttttcattgttgttttaggtttgtgatcggggtggtttct

SEQ ID NO: 119524 - DNA, 266 bp, Homo sapiens
ttcaggtcttttagctcatttattattttagtaaccttaggaaacaagtaggataagccttattttccagatagggaaactgaggcttagattatcactgatccctggttacatagactccacacactaccttatttgcttataagcacacatcctactgtaaggacatgctctaaacatttctaaagaatcaccagtaacagaatatattagagcaaaatgggaggtcaaagagaaactacagaggagtctcacaggcttaacag

SEQ ID NO: 119525 - DNA, 423 bp, Homo sapiens
cctggggactgtagggatttacctttgtagccctctcgctgcctgcacctccattctccctccagataagggaaccatccacccaaacactctgtgccctggggctgtgtcgccctcgctgtgctcttggcaagtccctgtgatgcatgattaaagcaactgagagtagatttaatttcttggttggtctttcccttttcaaaatgaaagttttaagtgtggggactttcttacaacatgattattctgtacatttccaaagaaagaagaatctgccctacatctcaggctgctctccagcctgcacctaagctttattttcttcccagagactgtgctaggctttgtagtaacacttctccccgctgccgcatgtgattttgcagagcggcatccttcttgcttctccagcttattctctgt

SEQ ID NO: 119526 - DNA, 265 bp, Homo sapiens
tggagagtagaggggaggttctagtgggattgaagaattaatggagtgagatagctaaggaagcaagtagaaatgaatacttgaagagaaagttattattggttgtaatgagggttagaaattactatggatgatgtagttgattgaagaggggtgaagaacaacatcactgggggtgggaggtcagataggtgagtcaggatggagtgcctctaccaatgatgaagatgccaaggaatagtagcagggaagagacatggagcca

SEQ ID NO: 119527 - DNA, 367 bp, Homo sapiens
aatatctttcttcatacaaaacaacatttcttactcattaacactatattttttcttcccaagaaacccagtggctggttttcacacttgactctctactattcctttctctaaaaatggaaggtgcaaagattttctttctcacaaaatctctcatgcttcagggtttaaaaaaaaaaatcttctgacttagtaaatatagactctcaaagaatgagcagactcgtgtgtgacttttcataacatacacaggacagaaatactacaaataactttagataaacagagggaaatatcatgcaatatccctctaacttgatttctgaagaactgtgctttaaatgtgatggcatttcaagacaaaatt

SEQ ID NO: 119528 - DNA, 384 bp, Homo sapiens
ccagaaggacactttcctcctttgggggtgtccccacgtcttccagcagcgctcaggcactgagtcctcagggtgtacctcttcagacacgctggagacttagagattggcaagtctcagtagggcctgccaacctgagcggagtaagcatgaagcaggctgggctggtttcagcccctaccagcttttcctcatgctgcctttggccttgcattcttgcctctgagcgagtccagcaactagggtctgggtggcttcctgcatcccagagcaatcagaagacatccttaaatgatgagggagccctggcccaggcaagtgcatgttcatgtgcgcacacacgcaaacacacacacacaacatgcactcaggaaagccaccaat

SEQ ID NO: 119529 - DNA, 253 bp, Homo sapiens
tcgtctcatccaagagtgagaaaaagagtgaaaaaatgctcaacatttttagtaaaactatgcaaggcccagtacattgtactgtttcacataccttaaccttcaaaggacaaattcgccttaagaattcagtacagccaagttttgtctgtgtttacttcctttcaaaataggagatttttataacctctcattatcgctaaactttgccaagacgtcaagaactaaggtttcttttcaattacagtatact

SEQ ID NO: 119530 - DNA, 2759 bp, Homo sapiens
tccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggaggaacagagtattatggcgcatatgggcattgactcaggaaccactaacatttttgatgaagtagacaagagtgactttaaaactgactttggttcggaatttccaattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 119531 - DNA, 2654 bp, Homo sapiens
tccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 119532 - DNA, 202 bp, Homo sapiens
tcctttcttttgttctaagatagtgttaaaaatagatcagatccattacaggcatgagccgccagacccggcctttttctttcttaaacagctttattgagatataattcacatatataattcatccatttaaagcatacaatttaatggtttttagtgtattcagagatatacacagccgtcaccacagtccattttagaa

SEQ ID NO: 119533 - DNA, 302 bp, Homo sapiens
cctgattgacatagtgcactacaacttagaactcctggactcaagcgatcctcctccctcagcctcccaagtagctgggactataggcatgtgtgactgtgcccagctagaaatttgtattttaaacatgtacctagatttaatgcttatgaacactgaagttttatttcttttaattaattgattaattagttaatttttagagacagggcttcacttggttgcccaggctggagtgcattggtgtgatcataacttactgtagcttgtagccttgaactccaggcctcttgcttcctgag

SEQ ID NO: 119534 - DNA, 375 bp, Homo sapiens
aagtgcctagcccaagggaagcactccacagacaatccctagcgtgaggtgtgacaccaaggccccagccacctcagttctgagcgctgcagggaacacctgctctgagcctgctccgcacacagacacgctccccgactcctcaggaaaaagaactacgcaggtgggtcatcttgtgctcccagggccaagcacggtgacattccccaccctgtgacaggacacgggctcctgttcctgggctccccactgcacctagaagcactgcacgatgcagatctccacggcctgtgttcaggctagtcggggctgtcgggctagtcggggccccgactagcccgacaggggggataacacgttcgcgaggggtaccga

SEQ ID NO: 119535 - DNA, 303 bp, Homo sapiens
cctcacgcacatttgcaaagtccctttttgccatgtaagataatatattcataggtccggggggttagagcatggacatcttttgggtgccattattttgcctaccacatcaggttaacaaacaaatacaataaaatagttacatattgtggcacatgctgaaaaagacataaagagagtgctatgagagaggtgagaatagggcacccactttagatagtgtagttaggagagacattttagcgaaggtgatattcaaggtgagcaatgaaggatgagaaggaagtttccctcattaaatca

SEQ ID NO: 119536 - DNA, 95 bp, Homo sapiens
ggatggatgtgtttgtggtttgtaaccattacggtttaaaccatggtttaagaatttgcccaaataacagaaattttgttcgggaagggataaac

SEQ ID NO: 119537 - DNA, 381 bp, Homo sapiens
gcatagatttgtggtctttgacttgaatactttgtttttttcttagcatccttggagctggttggcaacacaggtcaggccagatgatgaggccgcggtgggcacagagggtagattaaagataaaattcctctgtaggagcatttcccaaatgtcagagaatatggacaaagcagcactttcagaattctgtttcggacaatgagaccaggtacttgcccataatgcgtctgttcaggaattcagtaggagaatcatagttttttgctggtaaagaaaggatctagctctgttcagatttgacagaggtaaggtctgtacttgatactgatgagagagtgaagtagtttttggagtgctctggatttcagggaaaatgag

SEQ ID NO: 119538 - DNA, 881 bp, Homo sapiens
caaataagaacatggtaactttttctctaaatgggtcagatagtaacctctactttatagtccctaatcagtgtgcccacctgtagacatagaaactttagtggttcctaggggcagagagggtgggaatcaggccttaaagagaggcagcaggagacattaactttgtgtaattgtactctgatgtactaagacttaatgacttaggttccttagcatctatatctttttccaaagctgcagctgtaattcattttactatttctcctaaagagtgtccattcagtgttattattattcatcaaataggttttgcatgcttactatgtggagggcaagtcataagatctttaactgtaagaggaatttcttggatccctttctttatggcgctcttagtctaggggaggtgttagaggcaggatgatggacactaagaaagatgtaattataaaactgttaagttatggcaacattaactgatagtcaggatgcagtgcttcccaggagaaacactgtgctcctttgaccccatgagtggagttgtcagagaagtctcagtgaagaggcacatctaaacttctgtagggggtcagagaagagacagcaatttattcagtttgggattgatgaaagtattgcaaatgtaggcggcactactgcctttacagaagagttagatttcaccaggaaagaaggaaggaaaaggtactctaagcaggaaacacaagaaaggcatgaaaaaaaattttttttaaagtatgtgatatgtgtgtgggatatgttgaatacccttgggttgcttgaaatagaattttgtgtcagcaggggagaaaaaggtagggtgaggacagcttgtgatataagatggatggtacagt

SEQ ID NO: 119539 - DNA, 602 bp, Homo sapiens
attgtatcccctatagcaataactgaaaaagcaatgccaaaaggtatatgtaaagagcctttaagtataacttaaaaactgaaatggaattataaaatatattgaaataatgtatatatagatatattgttcaaagtccggaagggaagctaaggaacaaaatacagaggctacaaatagaaaaacagtagtaaaaatggtagataaacacctaatcattcaaaaattccattaaatagaaatggaagaaccacttcaattgaatgaaagagattgtcagattgtcatcatggattaaaaattaaaagcaaggctggctgtggtggctcaggcctgtaatcctagcacttttggaggccaagatgggccaattgccctgagctcaggagtttgaaaccagtctgggcaatatgttgaaaccccatgtctactaaaaatacaaaaaattagctggatgtggtgatgcgcatttgtaatgccagctactcaggaggctgaggcaggagaatcgcttgaacctgggaggtggaggttgcagtgagccaagatcgtgccactgcactccagcctgggcagcagagcaagactctatctcaaaataa

SEQ ID NO: 119540 - DNA, 595 bp, Homo sapiens
aggaggcaatgtctgagctaagtcttaaaggatgaaggacaattggccaagtggagacaaagggaggaggggattacaggttgagggctcaacatgagcaaagaacgggtgatgcagatggctggggtaatttgtcacagtagcaacaggaaatcagtacaagccctggacctggcccattcttcatgtccccttcccaagcctccaagcccacatgggcacttgccaagatcagagctccaggggcctccagggacggggttttcagtcctttgggaccatgatccacagagagaaattgatcctacttgagacacaggaagcaacacatgtaatgcaacagccaagcacccaacgatcatctaatgcaacagccaaacacccagcgatcatctaatgcaacagccaaacacccagcgatcatctaatgcaacagccaaacacccagcgatcatctaatgcaacagccaaacacccagcgatcatctaatgcaacagccaaacacccagtgatcatctaatgcaacagccaaacacccagtgatcatctaatgcaacagccaaacagacaagtgatcatctaatgcaacagcca

SEQ ID NO: 119541 - DNA, 252 bp, Homo sapiens
gcgtttggctgggaagcagggcaaaagctggcactggaaaaccgatgccacttctgtgaactgtctgcagccaagcacccaacgatcatctaatgcaacagccaaacacccagcgatcatctaatgcaacagccaaacacccagcgatcatctactggaataggctaatcatgcagcagtatcatgtaactgtgtgtgccatagaccgtacggaacatctaatgcgagaggcaaagacgcagggagtatcta

SEQ ID NO: 119542 - DNA, 245 bp, Homo sapiens
gctatcatggcttacaccttccagagcctctaatagaggttttgtaaaaagggagaaagtatgcacgtattaatgcaagtactagacataattaaagtaattaataacattgacaagaattactaaactattgaaatataatacagtttctttaaaaatacatactgtatattcagaaagggtaatgttatttttacatcttaaaaggaattcattttcatctctggttcaaaatatatatcttt

SEQ ID NO: 119543 - DNA, 384 bp, Homo sapiens
tatagaagagagaagactgaggactgagtcttgtggcacttcaacattcagaatttaggaaaagatgggaatatcagcaaaggagcctgaggaggagcagcgaatgtggtaagagaaaaaactggagaacgtgatatcctagaagctaagtgaaggagagaatgacccgttgtgtcaaatactaagattatgtcctgaagaaagaccactttggttataggatggatgatggactacagagaggcaagactgtaggtggggaaatagatgctgttgctctacttaggggagaaatgataaatattgtcttaggccggggtggtggcatcgataaacagcggtgtttatcgatgccagaaaaataaggtcagagtgaagtagaat

SEQ ID NO: 119544 - DNA, 581 bp, Homo sapiens
gggaaaaatgtggaagacatgagccttgatcttcacctcacaaaactagctcaaaatggatgatagtcgcatacataaaataaaaaactataaagaagcttctagtagaaaacagaaaaattttacaaccttgggttaaacatttcttttttttttttttttcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaa

SEQ ID NO: 119545 - DNA, 569 bp, Homo sapiens
aaaaaaaaagacttttggtattaggctgggggtggtggctcacgcctgtaatcccagcactttgggaggacgaggcgggtgaatcatgaggtcaggagttcaagacaagcctggccaacatggtgaaaccctgactctacggacgtctgtaatcccagctactcgggaggctgaggcaggagaatcacttgaacccgggaggcagaggttgcagtgagccgacattgcaccactgcactctagcctgggcgacagaggaagactccgtttccaaaaaaagacttttggtactaagctttctcgtatgatttttctgtaatcttatattaatagacgtgggatgacgattatgaaaaataactttttagtcattcggtaggttgtcatgtagtcagtgttaagtctctctttactttgaagatttagagttctgaaaagttgatttgtgcctgcagtatctcttagtgtttaccacaagtcatttctcagagtgtctgtagatgtttaggctgtacttaagtactgcacctacctacttggaatatctttttgagactgtattcagagat

SEQ ID NO: 119546 - DNA, 345 bp, Homo sapiens
cactgcgcccagccagaaaatatattttttaattcacgtattttgagaagaaagtacaatttgaaaccaagaagtttcctttcattattcttaaaacgttttcagaagtaaaatatgtggttctgctaaaagcagttcttttagttaaatgttaaaggctgcaccatctttgtgttttttaaacataaataacttctactttattagttgttaaattagaaaaagtctgtaattttacaaaattcctaacactgtggaaacagcaaaagtgatttaactcctattgaagtcagaagcttgcttttatatttcccatctgatgattccaaatgtatacagttttct

SEQ ID NO: 119547 - DNA, 688 bp, Homo sapiens
gggcacatattataaataaggggggacaagactaaattgggataaaatatattattatgattatgtaatgttttaatataaaatgtgaataccaagatcttggatagtgaagttgaattttaagaaaattatacttgggaggtcttataacaaacataaaagacttaaataagagagcatagctcattttgtgattatcgtagtcaaagatttatttaaagagaacctctgcagtacaaagaatgaatttagcttccaatataaaatgtgtaatgtctatattaatcatttcaaatcatagttttccctcctgaactcaaaagaaacttaaaaaaataaatgaaatcctctgcttttcctttgctgtctgttttggttttttgacaatgtggaagtaacagactactaagttatttctcacaaaggcagcccaacacttttccatacacagattactttttcttaatgttttttttcctaactacacatgtgaagatttcatgtccatcatttgtcttcgttttacttggcaagttcaaagagccaaagttatgttatatttgataaataaacttctaaacataaacaggtcaagccacaaatgtctaataacattgctcttctgttcaaaagtaatgatcgtcctggtactttagatcttaaaacatcaaagaatataggattaaaa

SEQ ID NO: 119548 - DNA, 738 bp, Homo sapiens
ctaccccatcccaggcccatcactgagggagacagagcaggtcagaaccaagcctggcagcccccagggctgtgccccatggacgcaggtgtgtctgcagagcagggtcctcccctgccagtgccagccctcaggtgtctcgggtgctgcgttactcttgtgagcttccacgctgacacctgtggccacaatgttggtgtctgctggacctctggccctgttctaggtgcaggacatgtggccacagcaggcctggcccctgccccagggagtggacattccctgagcctgccccccacccccactgagaacttagtggctatgagagaacaggaaagcaggaagctagacagggcacagacccccgacggtggagaccctgacccggagcacgtgggtgtcagttttggggaagccagacagggagggtgctaacaggagggccagtgaggggaccttgggaccccagacagccctggaaggaaggcagccctggaaggaaggcagccctggggtccgggccacgctccatcctgggggcacccccttcccacctgcgtgcagtgtgcagggccgggggaggagcctggatctgaggagtgcagttccagttgtggctttgccgcggcgtccccatggcatgctgttggggaccgtgagactgtgggcggcctagctgtattgcagcctgaggccagaggagaggtcagtaacccttacccgtcccatcttgattta

SEQ ID NO: 119549 - DNA, 436 bp, Homo sapiens
gtacaaagagaaacacagcataattcctgatctctcccctaatatcacactctcctggcagcagctgcaccttgttccccaccctcccccaggactttcctgaagacaagctgtcatcttcaggcctcagccaagcagcctggctgagagcaagactctctcagctctccgaggacatgggggaggcccactcactctgcttcctcggaccaacaggtacacctagggtccaactgcgaagcgagatattttggacagcaaatgggaaggatatttatactgaatcatatatctagagatcacagctgagagtgttgcttattctttatgtctataacaatataagcaatagtataattaccactataacactaagcctaggtatgcagttgaacattgtctccctctgctttcctttttgtctctctctctactt

SEQ ID NO: 119550 - DNA, 233 bp, Homo sapiens
ggtggtgaatccgtgcatgtgtgttttttatatatatacacacatatatatacacacacatatgtatagatatgtgtatatatagacatacctatatacatacacatatatatgtgtgtatatatagtggtgcagtggtacaatcatagctcattgcacccttgaactcctgggcttaagcgatcctcccacctcagcctcttgtgtagctggggccacaggcatgtaccacc

SEQ ID NO: 119551 - DNA, 669 bp, Homo sapiens
tgggtcactctaaggatcccgatcacgtgcattgtggatccacgtccattgggagggcaattccattagccagtgggaggtagaaagtttgtaagaaataccatgccaggggactggagaaagaccccagatgtcattgtttctgggtggagatcctgtgtgagcggtggtggtatatcctaagagggggcagtaccactggatgattaagggtggtcccacaaggcctggggtgaagaaagacctgaatggataataccattaatagctgttggggaaaggaccagaaaaggtgaaaaagtgaaaccttggactggatggaggggacatcgctgggcttttaggaggtaccctgactggtactctgatcacttgtttctttttgcgggggactctgaggtgggatgaaaagctatagtactgcaccaggagtgggcccttgttgagagagttcctcactgggggagactttaagaaggggaaacctgaatagggtcctgtcggggaggagagggactctgagcgagaacaggttaaaaacaaaaacaagttagtaaaataattcaaataaaaacaaaacattaacaatctaagcactgatcttttttttctatttatattatgatgtactgaagttgctatttgataagcaatgatctttaacataaa

SEQ ID NO: 119552 - DNA, 694 bp, Homo sapiens
attacaggcgtgagccaccgtgccaggccgatgttgcagtcttgagtctgaagggagactggagacagagttccttcttctttagggacttcaatctttttctcttaaggccttcaactgatgatatatgaggcctacatacattacaaaggataatctgcttcactccttctactgatataaatgttaaacctcatctaaaaaaatacctgcacagcgacatctagactggtgcttgaccaagtatctgggtactgtggcctcgccaagctgatacatacaattagccattacaccatcctttcagaaggggtgatgcccacaccgaaggaaaaaacctctagactccacagccatttaatcttctattggagaccataatcgaggcaaggaattcagatgaggctactcttttcttcacaggtgaattccaagcgtctcacagcttccagggcatttcttgttctggttcctgctcacctgtcttatctccttgctcttccctccattccagccacacgtggtttttggtttaaagacactgtgttcttatcttgctctgcctgagtacgcgctacttccacggcctggggtatgctgttttcccactttttatctgggtcctcatcatttgagtctcatgttgagaaccacaactgcctctagagagcttccctgacctgacaaggttagg

SEQ ID NO: 119553 - DNA, 346 bp, Homo sapiens
gggacccccttggaggtttagcggacaggacgtcatccacacaaagaagagccggcaggtcccgggctcacacaggtctggaatggtgccactgcccagccagatccctgtccgcagccctgggaagaaggttctggaaggcactgccacagcccggggaatgatgaacccaaaactgaaccaagctccagcctgtctcacaaatcctaaaagcaacagctgaaagggacaaaaaggttccaaggaactatgtggatcccagaacaaagcccaagatgacttacaggaatatacaattatccagcacataatgaggtaaaattcacaatgtccagcatcccatcaa

SEQ ID NO: 119554 - DNA, 699 bp, Homo sapiens
gttagatgaatgaatcatgtagctttagtttgcatccttaaatgtttataaaaataatgaaaataaagtccttttatttacatggtggcaattaatagcataggctctggcatcaagctgcctgaaatcaaatcctactattagcttcatgagtttttgactaaatttcttaagctgtctatgcctcagtttttctctgtagagtgagggtagtaatagtacctacctcagagagttactgtgaaactaaaatgtagtttgtgggtgggaagtgcttagtacaggcctttgcacatactttgtgtccagccaatgaaattgttggtagtagctgtggtactagcagatcctagcaagaaaatgtttgcaaataacaggaaagcacacattgaagggaaatagatcagtattatgtcaattatgtatatggtgttaaagcatataatgtactctgaaaaaagtggccaggttgtgttttttttgttgttgtttttttaaatctgagagctgtcaacagaagcttctcaaaggattttttattatacattttttcctcatcattgtggcacctcttaaaggtatttagaagattaaataaactgcaaaaaagcttatacaaatgattcctttattatatacaggtctaagaaagctgttgggcactcagaagcttgcttagaaatctagtttgttcttgag

SEQ ID NO: 119555 - DNA, 351 bp, Homo sapiens
aggaagccagcggtgagggagtgagggctctgtgggataaggctcttcggaaggtgcgggaagtaggcttagaagcccttggggagctcagctccagatgcagaaggagagtttccttctcagaggcatgaaggaaagaagaagggcaagaaggaagaaaagttcagggcagagcccacgtgggcgcctcattcaatgccagtatctaggagggtgggggatttgtggagcacatttattacgtttcctacaagaatggataataatgtggacttacatttggcagtttttacacttttttaaattacactctttcagttggaaagagtgatgtggtgtgatatttattta

SEQ ID NO: 119556 - DNA, 629 bp, Homo sapiens
gcttgaacagctccactgacaaatgcctcactatcttctgatacatcgtaggcagttctgagggtgagaaagttcaaagcagatagatgttttaacacaacaggaggacttttaaacaatcaccaggactcactcctcggtggtcaattgggcctgtttggaggcctgacctttggtcatcttaaggtcatctaaggcagaaaagagaagctcacttataagttggcacttctgaatcatttgccttgaggtccattttttattcagcctttgtttaaaccttcttaggaagccagtttgtagagttctggggataagaaggcagaaaaaccatgtcaattcagtgcttttatttcacagaaaatgaagcaaaggcctagaaactagaaagacatttctcaaaaagaagatggtgaacttttggaaatactgagattagactacattttccaatttctatccctagcccactgctctttccaatataatatctgtattccatgggaaagacatgccatctgaattgatgtatcgtagttgttgagataattttgaaatgagaaaacaatagggcacagtcgtttgggaagaatttccagaaattgccatcattttcttaaaggctaagg

SEQ ID NO: 119557 - DNA, 112 bp, Homo sapiens
ctgagggagaggaagggcaatgtggacaagaaggaatttggaaaccctgtaaatggacttttgggaccgtctccgggtttcagttacccaggttctccccatgccccatccc

SEQ ID NO: 119558 - DNA, 132 bp, Homo sapiens
tactgagggaaggacacgatcagggtggaacagccagggtgcaatggcaaatgcacagagtacagacaggcacagggcctgcgtccctgaggggcctcagagtgctgccaagagggctcaggccttaataaa

SEQ ID NO: 119559 - DNA, 336 bp, Homo sapiens
cagactcaatttaaatatttttaatgttgagatgtatcatttctcaagaccgttttacaatgcatttctttattcattaagggtatgtattatgtggtgatattttctctgaaatgctagacactctgctggttttggaaaataaacatttgatttaaagcatttcatggtttggtttgtcatcctgaagttatttcacactttattttccttgtgttacaagcctgattactagaacaacatcaccagttcttctaggctttgatgtactttctctgttgtggtgatggcttttccatgtctcttttgcctcatgattttaaaagattaagatgc

SEQ ID NO: 119560 - DNA, 1034 bp, Homo sapiens
ttcctctggattccctgaggagaacatggcgactctgttagcttcactgctcggctgtttctatgtacatgctagcatgtgtcagtgagtgcaagagatgggagtagatttctttctgggctttttgggccaggctggcttggccaagtggacatgagtcagcctgtccctcagggctggtttcctttggtggaggctgggagcattgcaggaagccagccaagggcctaggagctcctgaagcttgggtcatgattgggtcataaaagtaatctgtggggatagagtggctcctgtttgtggtctgtgactgccaagctacaagtaggaagactgggccctccttgagacaggtggcagggtatatggagctggaagtggggtatggaaatgggtggttattttgcagcctttacttttcatctggacttgtattcagcaatccctccccaagtcagctctcagaaaaatattaaaatattgtgaaattggcagtgtctttcctaaatgttggctttagaaagcttttcattcctggatcagagaggactggcagtgagggtaacaggcctaccaagatctcatgagccctagagaggtcttgaggtgtctttagccacagatatctcaatcatttcacagcccagttctctaggtcatcagtccctaaatgtggctgtgtacagtcacccggggagctgagaccctaatctcaaatctgttggatcacattctggttggtgtggagtctaaaaagctgtgcttttaagaattgcccttggcccggcacggtggctcacgcctgtaatcctaacactttgggaggctgaggtgggcgaatcagcaggtcaggaattcgagaccagcctgaccaacatagagaaaccctgtctctactaaaaatacaaaaattggctgggcatggtggtgcgcgcctgtaatcccagctacttaggaggctgaggcaggagaatggcttgaaaacaggaggcggaagttgcagtaagccgagattgtgccactgccctccatcc

SEQ ID NO: 119561 - DNA, 292 bp, Homo sapiens
cctaaaagggggtttgacaaacaaagcccgacatgtaccagcagatcctactccacattccttcctctgaccatcacctaaaggccctcttaatgccttgtcctgtgctcgcacctccctccttcctggtcttaggctccgctggtcaccacctctggggccctctggggctgaggtgtgatgtgcacgtccctgccctcctgtccattcttgctttgcatctggttgaagaggaagtttagtatttacctcgttgattctgctcaaacacaaaccacagctacccacagcg

SEQ ID NO: 119562 - DNA, 361 bp, Homo sapiens
attataaactgtagttcattttgtagttcatttaacttcagaactcttaatctcttgatgagggagagcctacctggatcagagttagggagttctctatgttgagattggttgtatatgaggagacaaaacctgtaaataaggccgaggcaggtagtttgagaccagcctggccaacatggtgaaaccctgtctctactaaaaatataaaaactatctgggcgtcgtggcacatgactgtaatcccagctactggggaggctgaggcaggagaaccacttgaacccaggaggcccaggttgcagtgagctgggatttcactactgtactccagcctgggcgacagagggactctccatct

SEQ ID NO: 119563 - DNA, 707 bp, Homo sapiens
gtcgtttttacatagcacctttatacacgatataaaaaagtaggttttttgcatcaactgcaaacatgttttgtactctgtggatcggaatcttggtgaggaagagcattgcatcccgcaaaaggctgatgagtcagttagctggagagacagtgccatcattctgggttgcagttctggtgaagtaagtaggatgttaacactgcagatggaaatggttttcagattgccacatggaataatagtatggaacgtgaaatttcaggaataggaggagattcttttattattttcctccttccactttgtacatttttttaatagcctgcaactagttacatttatctttttttttttttttacatttttatccataatacaagtaacttgactaaagccagtgtctgtttcatgtaaatatattaacaggtccaaaatcaccaactaaaattagctttatactgactttttctaaagtcagtccttgtctcacccaaatattttaacaagtccaaaaatagcacatagctacttggaaccatattaaaatctcattataacatgaatttcaggtattccatgttgtagacttctccttgaaagataatgacattgaaaaatgctcttaagagagttgttaattctgtttcccaaaacttcctggataaaacaattctaccttaatgctattaagactatggtaggtg

SEQ ID NO: 119564 - DNA, 214 bp, Homo sapiens
gggtgcaaaaatgttgtgtggtatcatcccaagaggtttggggtttgtttttatgccctaaattgtaaagtaccaacctacaaagtatgatccagatcctctcactctgcagtttacattttcttctattaaacaaccagttcaacaaaaagataacttactggcatgtggtcttttaccaaaattctaaagctgtgaattgaaacaactattt

SEQ ID NO: 119565 - DNA, 441 bp, Homo sapiens
ctctagaggatcgtaccgggtgcatgcatgtgcaaaacgtgcaggtttgttacataggtatacacgtgccatggtggtttgctgcacccatcaacctgtcatctacgttaggtatttctcctaatgttatccctcccctggccctccaacccccagattttttcttttgttttgttttgtttttaatgatgtcttacaccgagcacttggttagcaggacagaatgccaattaatacagtatgacttctgttatatataaaactgacatatgtagccatatatcctttctttgacatctaagtaatacacatttactgaactgactaaatccacagcatgcacccaggcctgggtgcatgcatgtgtcccattcatccggtctctcaaatctcaggaatcttctccttcaattaactcatcaacctctcatggcaagactt

SEQ ID NO: 119566 - DNA, 512 bp, Homo sapiens
aacagaggaccattttttcccctaatgctaaaccttaaacattcaaagcaaaagcactaagaattgtatctcacttatctatacttgatggataacatgtgtgtgaaatctccagaaaatctttctttctaacaccatcaggtttaattagttgggtaatatgaagtcagaaaggtggcagaaatattagcagttatcatgatagtctaaaattatctcacaataatttctttattcttagataagactatacatagccttgaaataatagagcggagtagtaactttttactggcttttattccaattagcttagtttgacagtcaaatgtagccagctaggccttagaagattctacagtatacaacaaaataataaaattttccaactcaaaagcttaaaattcaccttagcacattacaggaaaatacaaccaaatactgctaaatgcaagacgtttgcttatttaccaatatctattcaaataaagttaaaagatactgccaaaata

SEQ ID NO: 119567 - DNA, 603 bp, Homo sapiens
tatgcttcaaaattttataaattaaaattttaaaaaaacatttaaaaagtactccccatattgactggggtagtaaaagagtataagggtagagatagatataaaatgaaacaaaataaactaggattctcataatgaacaatattaattaaagtctccaacatgtggagaggtgaaagtaagaccaatggccctgcttctcacgtgatgaactcatacacagagcacatcttagaggaatacaggatataaaacagaaagaagttttaggaggaaatggccagcgcacttcccgcggcatctgggaaggctttgtttttttcatccattcattcaaatatttattaagcacctactatggcaccaggcactgtggtagggagatactaaggttagagtaaggaacaagaaccatagtctttgatctcatagaatttaaactctatcaaggaaaacagtcagtgaattaatgctcaaaaggctctataattacaactggaggataatttccataagaaaaattacaggatgctacccaatcatttatcagggaaatatcttaatctaatattggggctaggggaagattcccttaggaagctg

SEQ ID NO: 119568 - DNA, 318 bp, Homo sapiens
atttgaattgacggaacttggggcccggcagttcaggcagtcagtcccagtctccttggccccttcgagtcatcagacgggacccaggcagatctgtgagtgcatcagtcctggaccagtctctaggtgctcagcgtgctgcgggagatctgggtgtctggggagggaccacacagcaggatcagaaccttgaaggaggctcctgcccctggtggcctgcagggcatgctggcctgccctgagcttctgcttgtggccccgacatcctgccacttcttgcctgtctctctgcataggctctgactggggtatcatgct

SEQ ID NO: 119569 - DNA, 362 bp, Homo sapiens
ggcaatttcgaagtgccatctgaaatgctttagtttcaaacagaaattaatacatcctagcatttattaactgagcaagacgttctaaatatgcaatagatgaaagatactgttccagacattcagaaggatgttttaaaaagtgtcctggcgacagttgtcatcatcaatgaaattaaagcctcatttaagggttacaacctgcatgtaaaaagctgtgaacaatgcaatataaagcaaaaagtggtaaaaaagtgttctaaaagagatagatacaatgaaatgaaaggttgaggaacatattaaaactgtgtgagtaatatgctacacttgtatcctgtaggaccaaggagtgatacaag

SEQ ID NO: 119570 - DNA, 582 bp, Homo sapiens
acccaccccttaaagcctagttaaaaagccacctcctccagaaagcctttcctaggctgtcttctcaggtggaaagaatctctcctctggaccctactcagttttatctgaatttctattaccccctcaaacaggtctaattcgtgctctccttccctttcatctcaagctcccaaggcagaagcatttgtctgctcattcctgtaccccaccgccccggcatcaagcttgacacactgtaggtgtttgattgacacctgctgcattgagccgaaccaggactgcattttaattgctatttaatgcacatgcccaggaagccactgcactttctaacctttgctcatcaaacctgattatgaaaggcaggagaaagtgcagtggcatcgataaacaccggtgtttatcgatgccagcttagccgaacaattcagccctgggcaggtggtcggctaggtgacagtagagctaaataaatgccaggggcaggtggggcagggggtacctcgaatgttgttcactgcaagtcctccaggatgattgatctttccaagagtcttgaataacatctctcttctctga

SEQ ID NO: 119571 - DNA, 710 bp, Homo sapiens
gttcattgtttccctaagtattaaacaaagtactgagtagaggtgaaaaaataaaaaaaaaaaacaaagtcgaatttgcactctggcgctggtatgtgaccgtaatcttttatatagttctagttcccaaaatacaatcctgtactgcataacatttcagtcaacaatgggctacatatacaacagtggtcccataaggttataatactatatttttactgtaccttttctatgcttagatatgtttagatacacagtaattgtcattgtgttacagttcctacaatatcagtacactaatgtgctgtgcaggtttgtagcttaagaacaatagggctatacatataccctaggtgtttagtaggctatgtgtatataccatccatgtttatgcaagtaccctctgtgatacttgcacaacaaaattgcctaacaatgcatttctcagaatgtatgcatccctattgttatgtgagcatgagtttataaaatgaggcttattttcaagaacaaggatggagctggagatccttatgttatgtgaaataagccggggacagaaagacaaacatcacatgttcttacttatttgtgggatctaaaaatcaaaacaattaactcacagacataggaagtagaaggatggttacccgaggctgagaagggatttgatatggtcggaggggagtggggatggttaatgggtacca

SEQ ID NO: 119572 - DNA, 383 bp, Homo sapiens
ctctgtcgcaaagaaaaaaaaaaaaaaagatcctgagttctggattctctccgtgggacatcctcttcagaggccatctaactcagtgctgctcagctgaactttctgcagtgatgttttatatgcactagctaatccagccaccaccagtcacatgtggctatccagccttggagatataacaagtgagacagaggagttacatttctggctttatgtaattttaattggaagagccagctgcggttagtggctaccatattggccagcagaggtctccactatctaattacctatcatggaagttggagaaaaacaataagctcctttggttaggtcttagtatgtgcaggctaactgacttctttacttactgtgttata

SEQ ID NO: 119573 - DNA, 943 bp, Homo sapiens
atgctgatgtcgagaatgacccaactaaatggcccagccagatgacccagttgaagctggtggacaagaagtttcattcatggaatcagaacttccaataaggtcttttagtacctcactcctaaatttgaatagactaccaaagattatcagacatctaaggggaactaccagcatgaaaggtagagaccaaagcaaacaaacaaacaaagaaaataatttggaactaaccaagactatgctgggagaagaaaactattattaatatccacagagcgtagtacagccactatggagaacagtatggaggttcctctaaagactaaaaatagaaccatcatataattcaacaatcccactgctagatatataccccaaagaaaggaaatcagtatattgaaaagatatctgcactctcatgtttactgtagcgctattcataatagccaagatttggaagcaacttaagtgtccatcaacagatgaatagatttttttaaaatgtggtacatatacacaatggagtactattcagccataaaaaagaatgagaaatgtcatttgcaacaacatggttggaactggaggaccttatgttaagtgaaataagccaggcccaaaaaagcaaatttcacatgttctcactcatttgtgggacccaaaaatgaaaacagttgaactcagggagatagagtaggatgatggttaccagaggctggaagggtagttgtggtgggaggtgggtggttaatgagtacaaaaatatagttagatagaatgaataaatctaatagttgctagcacaacagggtgactacagtcaacaataatttaccgtacatttaaaataactaaaagagtataattggcatgttagttacacaaaaaaaggataaatgcttgaggcaacggatataccatttacctggatttggttatcaca

SEQ ID NO: 119574 - DNA, 862 bp, Homo sapiens
aaaaaacgcagctgaaaacgtatttaaaaagacaattccaggaatacattgctggtttaatggtagaaaatgaatcactgtaagttattcaattagctgtataaatatgaaatacacgagatgataattcttaatgaagtggtaacagaaagaaactttcttaacctgttgaaggatatctaccaaaatcttacatcacatatcatacttcatagtggaacatcgaaattatttcctttttttttttttccagacagtctttcttgccctgtcacccaggctagagcgcagtggtgcgatcatggcccactgcaacctcaaactcctgggtacaagtgatcctcccgcctgagcctcccaaggtgcctggattacaggagtgagccgccacgccctgccattccccttgtaaggtcaggaatacgcaagggtggcctgctactctccacctgcattcagactcatgctggagagtttagtctgcacagtaacacaataaaaggagataaaacatatcagcctggaaaggaaggaaaaagcagctatcattcttcagaggcggtataattacctatgtagaaaacccaaaaagtcagaggtacatttttagaatgaagagtttagcaaggttgccagatataaaatctgtacaaaaagtcaattgtaaaatgtaactttaaaaatactctgtcgatagtagtatcagaaaataaaagtacttaaaaataaatgtgttaaaatctgaggcaagcatggtggctcatgcctataatcccagcacttcgggagactgaggcgagaggattgcttgagcccaggagttcaagacgagcccgagctgcacagggagaccctatctctt

SEQ ID NO: 119575 - DNA, 1344 bp, Homo sapiens
  misc_feature (967)..(967): n is a, c, g, or t
  misc_feature (1110)..(1110): n is a, c, g, or t
  misc_feature (1118)..(1118): n is a, c, g, or t
  misc_feature (1122)..(1122): n is a, c, g, or t
caggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtgtaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaattngggtggcgatagtttctgtaggctaaactttatgagaaaagtgtacctactctataaaggtataaatgtaaaacctcttgctgttattgaggaagctcttcaactaccctaaatttcacaaatgtaacttataacactatganagatttgnccancaattacgtttgcgggttgcctagtttgggtagcctatcttagctgaactctcgggtcgagaattaggcggttaagctgacattaacatttagtatatcccgaaataaattgtcataaaagaaactatacgaaaaatatcggacattaaagaacacatattgacttggggaaagaactatagtcaaacaagacaacaaaaagcaccaaaacataagtatcgc

SEQ ID NO: 119576 - DNA, 297 bp, Homo sapiens
cactccatctttcttgaagcactcttctcccttgacatcactaacaactctccttgttctcttacttctgggactgtgccttacttccttcactggttctccatctctctaaatatgggtaccttaccaagatctaaactttacactcctctttgcacaaggagtcagtcagctgcatcactctcactccctgatctctctaacccagccctcagtcctgaattccactatccacttccatgtaacataaatgtgctacttcacttcaaacttatgtctagacagagctcctctcac

SEQ ID NO: 119577 - DNA, 561 bp, Homo sapiens
tctcatctgtgagatgttaatgatgatggcaccatcctcacagggttgccgtgaagattccatgagatacacgtgtaaagggcttagccaagtgccgtgctgggcacataataagcagtcagcaacgtctgctaatgatgcagggagggcaggtgccccaaatcccagttagccgaccgggaaagtgaggcttggtgatttcaaggctagtaaatatcagggacaaaaaccaaggtcacctgacccagaaatctagggctctgagctcacctgcaccaagatgcctctctttgttgggcacccccttgggaggaggaaagaaaggacagtggtacttgttccatgtctttggatggcaaaacccaccttctttgagcagcctccccagctgcctctggaacacccaacaacagacttaggggctggctctggagttgggtctatgccgttgtctgcctccaaccccaggcccaccacatccacccctgcagcctggctttcagagagtccttctaggatacaaccgtagagtaggaagttagcctttgggatctcagcctc

SEQ ID NO: 119578 - DNA, 418 bp, Homo sapiens
gaggtcgattgccagtggcaagggatttaatcaatcatgcctacataatgaaaccttgataaaaacccctgaacaacagggttcagggagcttctgaattggtgaatacatttatgtgttggaggtggggttgaggctcacctggagagggcatgaaagctctgtccctccttccacaccttgtgctatatttggttcttcctgaggttttatttttttccatgcaacaaaactttgactaacattttgattaggttcaactgtttactgaaactggtaatttccaaacttaagttggggcgcaaatggctatagtgcagagtaatgccatcactgggcactgcgaatgcgagagtgaagaataaacgtggttcacttgaagtcaggagttcgagaccagcctatccaacatcatgaa

SEQ ID NO: 119579 - DNA, 333 bp, Homo sapiens
tgggaatgtgcgttactaaccagtctctggggatgattctgctaccagtcttgaggaccacactttaagatttgctctaagagaaacaataggaagcaaagagggataaagcatcctggactccctcccagaggaggtagattggtttgaggccccaaagaaaaggtaggattttgaacaggaaaaaattacatgagaaaagcagactggttgtgtttcttctctcccactctacctgctgctggaaagaatataaagaggtctatacaacatctatttacacagttatctgcctagagctctctctagcgaccctatcttttttgtggcaag

SEQ ID NO: 119580 - DNA, 822 bp, Homo sapiens
ggaaattcagttctattctaggacaaacacccgacaaaatttataaatctcaatatctaccagcctcagggcagaaagtttacttaggttatgtattcctaaaggctatgatgctcagagaattgctaaaaattaatagaaaaataggaatgatttcagataatggcattcagtgacctgtatcaggtagtgagaacaatatgtgactttagatcttccttttgtaccacagggagaccccagcaacatcctggtctctccttttattatgcagtcgtcatagttgaccccattcaagttgtaatcataggatccttaaacgactacattttgaacctcactctcagtatgcatttccattacttttgttaattttgcttaggaagacaactgccttcacctggttgattttgcctaatttcatgggggcatgaatacagaagacagagaaacttggttccggtgaggaaatacggcctgttgatgttctgaactatggacttagctagagcctagatttttttcagtttgagggatttctgtcctcatgagtaagactatttatgaccagctctgttgtaggtttttatatctctacacataacaataaacttactatcttgtctttgactgggttgagtatatgtcttagatgtttcttccctgcaagagaaaactcagttccaagacacaagccactttttcatccctagctcattcacagtgacgggctgctgccaatcagtcaaaccagacaggagtctgtgtagcattacacacgctcatatcccagtaattgtccctaaaaactcccacatggga

SEQ ID NO: 119581 - DNA, 249 bp, Homo sapiens
gtttgtgtcctccccaaattcttatgtggaaatcttataccccaaagccattgtagtaggaggtgggacctttgagaggtaattagatcatgagattaggacccttataaaagaggcctgaaagagactcctcccccttccatgtgatgatgcagctagaagacaccatctatggaccaggaaccagggcctcaccagacattgaaactgcctgcaccttgatcatggagttcccagtctccagaactg

SEQ ID NO: 119582 - DNA, 398 bp, Homo sapiens
tgcttagatcatttcagccatgctggccgccgttggagtatttgttaagcataccaagttcccttctcttccatggcttctaattagctctcctcattgccttggtggagaggctccccagcaccttacttactgcactcaggtcattcctcaaatgttatatcattagagaggccttctatgtttaaatttaccattttaatttaaaataccatcttccttccattttccatccccttacctttcctttctctccttctttgctttctcttgaatttgcatattcctcaggtctattgacttaaaaattaaaagtaagctgggtatggtggtacatacctgtaatcctggctacatgggaggctgaagtgagaggatcacttgagctgaagagttcc

SEQ ID NO: 119583 - DNA, 783 bp, Homo sapiens
aggataatgactatttggtaatacttttgggaaatacagttttggtttaattttttttctggtaaagtaatcgttaaattttgaaaatacaaataagaatatagaagaaaatctgctaggtgcagtggttcatgcctgtaatcccagcgctttgagaggccgaggctggtggatcacttgaggtcaggagttcaagaccagcctgggcaacatggttaaaccgcgtctctgctaaaaaatatagaagttgggccgggtgtggtggctcacgccagcactttgggaggccgaggtgggtggatcacgaggtcaggagttcaagaccagactggccaacatggtgaaaccccgtctctactaaaaatacaaaaaaaattagccaggcgtagtggcacacacctgtaatcccagctactcaggaggctgaggcaggagaattgcttgaacccgggcagcagaggttgcagtgagccgagatcgtgctgctgcactccaaccttgggcgacagagctagactccatctcaaaaatataataaaaattaaaaaaagaacataggagaaaataaaacagtccatcaggatttctaacattaaatacacacacacacacacatacacatatatacacatacattttttttttgagacagggtctttattgcccaggctggaatgcagtagcatgattatagctcactgcagcctcaaactcctgggctcaagcaatcctcctatctcagtctcacagtgtgtgccaccacacccagctaattttcaaaca

SEQ ID NO: 119584 - DNA, 305 bp, Homo sapiens
tacaggcacacaccagcatgcctggctaatttttaagttttttgagactgggtctcactgggttgcccaggctgctcttaaactcctgcctcaagtgctcctcctgcctcagcctcctgaatagctgtcattacaggcgtgagccaccactcctggctatcatgccagttgttttgatcaccttctcctcacccctgctctaggattatggggatggacaaacacacacatccaacactggagagacaagatcagcagcagtttatgagtcacatatatgcacagcccaggggaggaggacactg

SEQ ID NO: 119585 - DNA, 468 bp, Homo sapiens
ctgtggctacaaggacaggcttgtgcagcagaatatggctgcagggagctctgcagcagaggaggggagcagtgtgcagctctcagaaggcagggcaagtcacacaacccaacagctggccaccacaagcaccaattgaccagagttgtgcgtgtgaggcagtgaaggaataagtgtgtttgggatgaacattcaaccccttgccccgcccatgagaccgaccttgaattaaaagtaacttgttaagtgctgctggtgccaggcagccttttagaccctagagcccagataccagcaaatccgagctgcccactgagagcttacagtctaccatgtttgcagctgaatcagaaataaactcctggccgggcatggtggctcacacctgtaatcccagcattttgggaggccgaggcaggcggatcacctgaggtcaggagttcgagaccagcctggccaacacagtga

SEQ ID NO: 119586 - DNA, 443 bp, Homo sapiens
atattaatcagtaattgggttgatttcctgtaccaccaaccacctgcatttgattcctcattgataatcaaggcaactttttgcttttttagaagtctccagtgtaacaaaaatgagtacactgcaaagagagccctgttataaattgtaaattctgaacgctaattaagcatgctagtcctctccaaataatcaaatcctaacatgtccatgataattaacagaaaaaaattgttacataatcctatcaggaaataaaagttggttatgtatagatgggggtgaaggaagaggtttctctccttcccatgaaaattgaagtactaaaggctagccaaacctcatccacaacttctcaaagaccttctgtaatacatctgttttcatgcatttctttccatttttataagtcttttactttcctctcctctcaacttgaaatc

SEQ ID NO: 119587 - DNA, 581 bp, Homo sapiens
ggaaataagtggtaccctttaacttactaaaaaagatgagtagaaagaattttggctttagccaaaaagacaaaggttcaattataggccctatcacttaggaatgtgtaacgcagaggcaaagttattcactaactctatgcttcaaattttttcaatgtgtaaaaataataccttaatttagaagtttgttgcagaaattaaatacacacacaccacacacacataaacttcctggcacctaggaaatgttcaaaatttggtaggtattattcaacgattcaataaatattgtgtttcaaagggtaatattttctatatcatttattacttatggatatacttaaaaaatgacttgttctctgctatgtgtcatttgtttttcagacctcaacaatgcatgcttgggattcttttccacttctatactttctgcaattcctgtttgtatgtaagtagattttatgaggttttctttaactttgcttttgctgttttgtttttccacctttatttgatataaaagtgggctttaacagcaacacacattggctatgtcactggctttggctaaaacattt

SEQ ID NO: 119588 - DNA, 278 bp, Homo sapiens
tcccagcccaccctccagggaacgtcactgcttcctgctctttgttccagggacctgagctttccactagcgcagctgctccgtgcagggtgtagttagttactcgtgcctcctgccttgtgaactccttgagggaaaggactagagttcattcatcttggcacctcgcgtacaactttgtgaagatggcgggggcagggtggaaaaagttctagagcctttcagggccttcgtctttccaccacctgcctagctctaggggtttgaagatctaatgc

SEQ ID NO: 119589 - DNA, 371 bp, Homo sapiens
caaaggtgataggatagtaaatatcataagataacaaattcaagatgtatataagcaagaaacaaaaaatgaattttatggatactgaggaatccaaaagaataccagtagctactgttcagacatttatatggtttcaaattgaacactatgaacaccgtaacctttgtttttagcttgaaagtactcattttgcgtgtatagtagaaattcctaaaacataagaaattgatgttacatgtccatgaaaacctaaaatcaatgagattaggcatatttaagtttttgggaaactgcatatataagcctttaaaatgactactgggtgtgaagcaagatgagataatttgtaaagttcaatctttggagcc

SEQ ID NO: 119590 - DNA, 192 bp, Homo sapiens
tcctattcaattaaaaatcctggtaggcataaatttcatcttatcagaatataaataaacattttaagtttataccaagcttgtggcttggggtgtgtgtgtgtgtgtgtgtgtgtgtgtgtgtgtgtataaatatgtgtgtgtgtataaatatatttatgaggggggggacgagggggtagcgcgcgcgaa

SEQ ID NO: 119591 - DNA, 539 bp, Homo sapiens
ggggaggggctgcttccctgacctacctctgaaccaaaagatgaggccagtgtagctggtggagaaaggttacaggaagggtggcaggaaagtcagggcttcagttaccaaaggtggatggctaaggggagtggactcaagatggctggactccgagtgaatgcacaaaatggtgtcaggcagaaaagacacatgaaaaaatgctcatcaacactggccatcagagaaatgcaaatcaaaaccacaatgataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggatatatacccaaaggattataaatcatgctgctataaagacacgtgcacacgtatgtttattacggcactattcacaatagcaaagactt

SEQ ID NO: 119592 - DNA, 398 bp, Homo sapiens
taaaaaccgttgcataacctacttacgggttacaggggtccctagaagtcagagcaaagggcttccaagcagaagtgagacacacgtcccctctgatttgggccaactcttgcttaattcctagaagaattcaattctacccactttgagggcctacagctgttctggatgcatatttttttggagtatgcatgtacagaacccccaggactgtcattcttcccgtgcccagtggctcagccttggagaggcaagaagggcaatctgtcattcactaaagcaacactgcaatgtagaaaaaacccagccagtctgggtgcagtggctcactcctgtaatcccagcactttgggagaccgaggcgggcggatctcctggggtcgggagtttgagaccag

SEQ ID NO: 119593 - DNA, 680 bp, Homo sapiens
atctcggctcactgcaacctcctcctcaccacaacctcctcctcactacaacctcctcctcagtgcaacctcctcctcactgcgacctcctcctcactgcgacctcctcctcactgcgacctcctcctcactgcaacctcctactcattgcaacctgctcctcactacaacctcctcctcactgcaacctcctcctcactgcaacctgctcctcactacaacctcctcctcactgcaacctcctccttactgcgacctcctcctcactgcaacctcctccttactgcgacctcctcctcactgcaacctcctcctcactgcaacctgctcttcactacaacctcctcctcactgcaacctcctcctcattgcaacctgctcctcactgcaacctgctccttctgggttcaagggattctcttgcctcagcctcccaaataactaggattacaggcatgcaccaccaagcccgactaacttttgtattttttgtagatacagggtttcactattttggccacctggtctcaaactcctggcctgcccaccttagcctccaaaagtcctgggattacaggtgtgagccaccacgtctggcctgcattgcttgaattctcagaccacatggaccctctcatctggtccaattgcaagagtccaaggcaggaaaggcagaaggc

SEQ ID NO: 119594 - DNA, 461 bp, Homo sapiens
atgatcagcagatttctcacctgatactttggagaccagtgtattcaaagtgctaaaaaaaacaaaaccaaaaaactcaaaaccctgtatatggcaaaattgcccttcaaaagcataaggaaattaagatgttcttagatagacaaaagctaagggagttcattaccgctagaactgccctgcgagaaatgcttaaggaagtcctgaaaggtgaaatgaaagggcactagacagaggggacagtgcagattcaggcaggtgcaatggcttctggggaagacccagccagtggggctattgccagcatccagtcagctgccaccttccctgaccccagtgtcaagtgatgcgcagggtgatccaggtgtgtgaggggcagctggatgtccagactgagggcactggtgccatcagtggctatcctaccactcaattcatgacccaggtggtgatccagggtg

SEQ ID NO: 119595 - DNA, 401 bp, Homo sapiens
cccgcccggtcactgctctcggacctgtcactgagcatccaggaccccccccgctccgccgtgcaggccggccccgcccagtcaccactctcgacctgtcactgagcatccaggacctccttgccatgcaggctggccccacccggtcaccactctcggaccttgcagggtcttccctgctccttgagaagggggtggtttcggggacaagccatccccatggccagccctgtgggagctaccaccaatctccagacactgtcacttctgctcagctccagccttccctggggggaggctcaggcagctccttggacttcctgattgtgttaggcttagaccaagggcaaggtcgatttgcaccccttagcccatcccaggcagcagcaaaagagaataat

SEQ ID NO: 119596 - DNA, 295 bp, Homo sapiens
aagccattcaaattatcttgtggaaggcaattctcgtcagagggaatagcaagcacaaagctctaagacaggaacatccttggcttgttcaaagaacagcaaagacaaggcggctggagagtagtgggcactaagattacaagataaggtgagagaacgttagaaaagtagccagggcccatggcacatagaataaagaattctgaatgtattctgagtaagatggaaagctattagataattgtgtgcagagaagtggcatggcacgacaagttttagagagattattctggct

SEQ ID NO: 119597 - DNA, 325 bp, Homo sapiens
tcaaccctcacagcaaaccctgtggagatcttattacatttactttacagagaaagccaaggatttgaggttaagcagtattcccatgatcacgctgcccagggacacacagatggaatctctctcccggtgagtggctcccaaatctatatccaggtgaatgctactctcctcatggccagcctgtctcctgggcagctctgcttggagactccactagtatcttacactctccaaatgccaatttcattcctccccaaactagtcctttttggaatctcatggagggcaccacccaccacagcccaagccagaaggctaactg

SEQ ID NO: 119598 - DNA, 479 bp, Homo sapiens
agaaatagtcatagcaaacatatgtttagtaataataatactaactagctcttcatctatgcaaagctctatcttaagcattttaaatctattaactcatgcattcttcattgcagcacaatcattcaaattccaatattatccttattgtaatgcaaggaatatgagtttctagaagtttgagtaaatgactcaatatgtaaataactcaagtgactcaataagacaaaaaaaagcaaccaaatataaaaatgggaaaaagaaatgagtaacaatgaacattaaaaagtaagcataaattggtcatgaatatatgaaaagatgttcaaccgtattattcacattatattaaaaccataggccaggagcagtggctcacatttgttatcccagcactttgggagactgaggtgagtggatcacttgaggccaggagttcgagaccagcctggccaacatgatgaaaccctgtctctact

SEQ ID NO: 119599 - DNA, 370 bp, Homo sapiens
ggaacccctatcctcatccctgagagatcagctacatcaagatggtcatcacaacatctggacattgagctgcttcgatatgtacccgcctctaggtattccttaggcgggtctggggactccctatcaatggaagacaacagtttggggaatcatgcttttggtctcagtacaaagggcctccccttaaaccttaataatggcttgcaaagaaactgtaatgcacttgtaaggtgttatagaattttttgaaactaataaggaggttagaatagtgcttagcatctaataagcgctcacggataggctttcattagctaatcaaatgtaaaatataagtattgtatcaaaaaaaagagattcatttata

SEQ ID NO: 119600 - DNA, 900 bp, Homo sapiens
aatggccagtattttccaaaaatgtcaatgtcataaatgacaaaaagactgaggaactgctccactatgtcctgccaaaaaaaattttttaatagagttgaggtctcactatcttgcccaggctggttatcaagctcctgccctcaaacaatacaccagccatggcttcccaaagcactggaattacaggtgtgagctaccatgcctggcctaagtaatagcttttaaaggtaattatctttgattaatttttcaatgtttttgaagggataatttttttgaaagacctttctgaaggtctttccccatatctaacattcatagggtttctgattagtatgacttacttgatactgagttaactgaaagttatgaccaaagtctctgccacattccttatattctctgcatttctttccagtgaaatttctctgatgttccatatgatttgtgcaaaatataaaggtgctcccacacatttcattaagcttatcactggcatggattcttccttgtggagtaaagttttcacattttggcttcattcagactttctatagcttcaagtttggcttcattcagattttctatacctcagtgaaccaactagaaacatttacatattcctgtaaaatgaagtttaccatagatattttaaatttaattgaaatactaaacaaaataattcataatattaaaaatgcctgtaaaatttccatgttcccatttgcactgatgcatttatgttatttctcttactcatctcaatcataactggcaaatttagtctatattactggttatttcaaaccacttttagataaagtccactttctgtttagctcattttctttttaagtaattcattcaaattcactgaataaacagattgatttgtga

SEQ ID NO: 119601 - DNA, 280 bp, Homo sapiens
acagtgccccacctcattcagagcacaggccaaagtccttatagtacctacaaggtcctatatgacctgtgacacctctccatcatctgctacccctcctctgccctatttctacctccctctctgctctagtcaggctgacgtccttgctactcctcaaacacggcaagagcacccacttaggacacttgtaccttgcagtgtctccacccagactaatgttctcctaagaagagttgcgcagctcattccattccctcttcaagtctttgcataaagg

SEQ ID NO: 119602 - DNA, 861 bp, Homo sapiens
gggtttcaccgtgttggccaggctggtctcaaactcctgacctcaggtgatctgcccgcctcggcctcccaaagtgccgggattacaggcgtgagccactgtgcccggcctgaggagaacttttctgtgcctctttgtcttgccttctcttttgcagttctttccttgccttcctttccaactgtttgctttgtttctttccatcttcctgtatcaggcagcaattcctataaacattctttgacgttattggtagcccttacacctgaatgggtgaagcctatctcagagtagatcattcattccagctgaaaatgttagtctgcttggtaagtgcaatgtgatggaagaaacaacttctcaggcctgtgaaacattgattaaatatactttgtttgtttgtttgttggagacagacacgctctgtcgcccaggctggagtgcagtgtcatgatctcagctcactgcaacctccgcctcctgggttcaagcgattctcctgcctcagcttcccaagcagctgatattacaggcacgcaccaccacgcccagctaattttttgtatttttagtagagagagggtttcgctgtgttggccaggctggtctcgaaatcctggcctcaagtgatctgcccacctatgtttcccaaagtgctgggattacaggcgtgagccactgcacctggcctgttaaatatacttttgtagttactgttccttctgcctggtagcctggtttctcttccccgtgtttatctatttggtaaactccatttcttactcaaaagattttatttaaaagctgaatgtaatggcttctttgctccgtttccagattcacccaggcagttagtgactc

SEQ ID NO: 119603 - DNA, 399 bp, Homo sapiens
agttgggccatctattgggatatatagcagcagctgggaagaagggttgaggttaatgtgagggaatcggggaggcagtgactgtaggctaagaatggttggaaagatgataggagccttagtgtagtgtcagtgctaaagaggggatgttgatacaggatgtgtacagctcagatgtcaaggatgatgaaacttgaaaaggaatactgcattgagtgccttcagacagcaggttgaatggcatgaccagcaacgatctagaaaagtgggaaggagagggtgacggtgaaggcaaaactggtgcctgctggtttgagttaggccatgaggaagtgacagacatgggttagagagtcggtacaaaaggacttgttacgggtcgtatctaggctggtgagc

SEQ ID NO: 119604 - DNA, 208 bp, Homo sapiens
acgtatttgctgggtaatgggattgagagaggcgtgtggccagcaagcagcaaggcaaattcgaggatgggttggagagcacctatcccaagcttctgtttgtgcctattgactaatgtcagaattggtggcagaacccagggttgtgctgcttcaaaaagtaaagcacatttatgttagctgctgtactcttatccaaatccagaat

SEQ ID NO: 119605 - DNA, 406 bp, Homo sapiens
aaattaactccaccagagtaaatgttggaggttctgcaaagggaagaaggatgataccttgttattgatcttgttattgattgaggagagatgggaagggacccagaagcagctcatttgttgcacacaagataattctaaatgcattttactaaatgtaacactgtatctcttccctaaaatattggacctcagactcctttttgattaatacaccagaaagagaaaaaatgattttgggtaaaacatacaagaaacctgtaaaataaccatgaatgtaactttcaagaggtaggttctctaagttcatatgcacacaaaatgtccactgcttatttaacaactggcttaaaaaaaaacacacacacacacacaattataacagtttcacaaacccttatctgaa

SEQ ID NO: 119606 - DNA, 370 bp, Homo sapiens
ctgcattcactgcccctcctagtttggagctatcaaaacatttaataaatttgtattcaagttgttgatcaaatcttgaagacaactggaattaattcctgatggaattaatacattaatatacactttttgtatgtcattgttctactggctccaaacttatatttaatgattacctgatctggcatttattcattgtgaccataagaatatctggagatgtgctttctaatactgtgccaaaattaagttacattctgtctatgcatagtaaccttataaaaaatattatgtcggtttgacctaagatgttattaatgaatctatgctggcttctactactcattgctttcttatgagaggggttaag

SEQ ID NO: 119607 - DNA, 786 bp, Homo sapiens
gttgtctccaggagcctgccttattaaaactaacagcagaaaacaccacatgttctcactcataggtgggaattgaacaatgagaacacttggacacagggcggggaacatcacactctggggcctgtcgtgggatggggggcaggggaagggagggcagagggagggatagcattagcagaaatacctaatgtaaatgacgagttaatgggtgcagtaaaccaacttggcacatgtatacatatgtaacaaacctgcacgttgtgcacatgtaccctagaacttaaagtataattaaaaaaaaaaaccagaattttccttcccccttttttaaaaaatcgtgctaatccatatcgttccaattttagtatatgtgctgctaatgcaaacacagcagaatttttcaaatgagaaatacttaggaccaataaattaactttgtttttgacttatctggtatatatgcaaagaatgtatttaggtggcatttcccattagtagggaataaaacaattataacgataagataaagaacaactcttagggaaaatttcttcggggacagttagatccctgtacctcagttatgtctcaaaaattctacattgactaaaaaatgaattactctggaaaggagaccagaaaacatggcttccggcagtaggggattttgaggaaatctcatgcactgctagtgggagcctgaattagcctgatctttctagagagcaaaatgtatgcactttttatccagagcattagaattgccataccctttgagccata

SEQ ID NO: 119608 - DNA, 571 bp, Homo sapiens
atttttagtacagacagggtttcaccttgttagccaggatggtctcaatctcctgacctcgtgatcctcccgcctcggcctcccaaagtgctgggattacaggcgtgagccaccgcgcccggccatgaagtcctttcaaatagacttaattcggtgtcccagccttccctagttttttttaagccatcttccccttcgactcagtgcagtctgagttcattgcacacacattgtgtgtgtatgtgcgtgtgtgtggacatgcaagtgcacacatgtgcttcagctggattttaaacttcttcagggagattgtggtcagtgtctttaatttagcacagtgctttgtatgtggtagcatttagttgttgacttcaagctactgtcctaaaattgcttaaaaccatagcagttcttttaaaaagtgttctatatggaattttttaaaaatgccttgcatttcttgaaggtttgtcttttatggttggagtcaaaccacttagtatataaaaacctttacttctatttttaaaaattgtagattgcactaatatgaagtttctgtggaagacta

SEQ ID NO: 119609 - DNA, 593 bp, Homo sapiens
acagcctccctccactttgtgccgagaagccgcacagtgtggtcccgacattccacctgtccttgcccatgtgtggggaggcacatggccccaagtctattaaacagcaagtgaaatcttcctcatcttggataaacccacaactgtaattccacgtaagtgtgtctatgtgcacacacagtaccccacgttctaccgtagaatgtaaggcgcctgcgtgccaggtgatggctctaaggatgtggtagagaaaaccggagtagacatgagcaagcacagggtaaggaaagaaaacacacgggcctttcaaaagggaagagcaaggtgaggagaaaggtgacccacagaagggcttggctgtcagctcaggcaatggcatcatttcggctggcggctgccagctctggctctgagcccctagttctgtggctttggaggttaagatggagcttgtcagtgacgcccaggaggtggtggttctatccagaggaagaacgcacggaagagtctccccaggcagcccagccgagtgctccaattaaagccacgtccctgctccacttgtttccctataaccagacgccctgagagat

SEQ ID NO: 119610 - DNA, 609 bp, Homo sapiens
tttataacttaatactactttatttaaatttcaaacatatcaacccaaaattccttaaggcacaagcatagaaaagtggtagaaaaccataatgaataaactattatagattaccagtttaaactacttgtggtaataaaaaatgattaaggcaatttactgttcttccacaggggagtgaacaatttatatgtaaaagcagggggagtggaagcttcactctaacttccctcccagggatgaagaggagccccctttctgtgcctcacactgtgcctggtgatttaggttggtcatcccgtctaatccccttattacactctgaagttgatcttcccactctcattcaacagataaggaatttgaagctcaaagggcttaagtaatttgtttctggtcactagtagaaatgagaattgaactgtctgcctgcaaacacatactctgttcaagatggcaaatgcttgggttagaatatttttatatgtttgacaggacaaacaatggtaatgatgttcttttggctaatggtaacttcaaaaattgcttttcaaagcataaccttactgtagttttaaagtagaaaaggaaaaatggaaaaaaaaaaaa

SEQ ID NO: 119611 - DNA, 193 bp, Homo sapiens
ctgaactggggttttcaagcggcctttcttaatacattagagtgctgaaggaaagtagaatgtcagtaacatatttgtgattccaagactttcagtcataagataaatctgctgtaccattgtccctgatttaatatttaaattataagtagataaatgctttgtaagttcttaagttaagaaaactatatat

SEQ ID NO: 119612 - DNA, 311 bp, Homo sapiens
ttcacagctgactcttgaggatccactctccctactggatcctacctgtagttttttggcctgaggaactggatgaataatgtagctgaaatgagcaagaaaggagaggataagtgcgtctccttggtaaaaagtaagagttctgtttggacatgttaaatctgagatgcccattagacatccaaggggcactgctaggtaagcagctggatatatgagtctgaagcttagtgaagaggacaagtatagacatttagatttggaagtcagcttacagtttgtgattaaaaccatgggaatggatgagacca

SEQ ID NO: 119613 - DNA, 369 bp, Homo sapiens
accattaaaccttgaagtttaggaggagaagagcagtagtgttactggaccttggtgagagctggagctgcagcagaggagctagggctgacatagaaagcagccaaagccagaaccaagaggggaatgcaatgcgagggtaaaagtctataccccagcctctgtctcttcctgtcctttgctttcctgctagtgcctctcaatgaccaaaatggaatggaagctccagggcagagagcagaaagaaggtcagaggatgactggggactgtggcaaacagaggataaccagctatgagcataagcatgcattaatatacccagaaggtcctacaatagaacctggcagtgagttcctttgtaaaatgaa

SEQ ID NO: 119614 - DNA, 797 bp, Homo sapiens
ttttttttttttagatggagtcttgctctgtcggccaggctggagtgcagtggcgcgatctcggctcactgaaatctttgcctcctgagttcaagtcatcctcccacctcagcctcccaagtagctgggattacaggcacatcaccaccactcccggctaattagcgtcaaattttttaattgcattaaactgcactgtaatttaaagtttcttattttatattaattccgtttttttttgagaaggcatctcactgtgttgtccaggcgggggtgcaatggtgggatctcggctcactacaacttccgactcccgagttcaagcaattctccagccttagcctcctgagtagctgcgactacagcacgcaccaccatccctggctaattttttgtatttgtagtagagacggggtttcaccatattggccaggctggtctcaaactcctggtctgaagtgatccacccaccacctcggtctcccaaagtgcccggcctcttaattccttttctgataaatgttaattataaactagttgacaaatctctacaatatattttataacaatgaagaggaaaatggctctagggtacaattgtttgtgttcaaatttcagttctgtcttatattagctatgtgtctgtggctcccagttttctaatcaataaaataaaaacactaatagtataacagtacctacttcataaggttgtgaaaactgcatgagttaaaatgtttattttatggtaggcactattcagttaaaactcataaaataaacattcaataaatgtt

SEQ ID NO: 119615 - DNA, 337 bp, Homo sapiens
gggtctaagattaactttgttaatagcatggtaaggtttcaaaggattaaactgaaaatgaatcacaggggtaaaacgggatttacaggaaacacttggagccattgagtgaggggagagaacagactttattccatgagatctagagattcccagcactgcctacctactagaatcaccagaggagttttaaaacaataccaatgtctgggttctatcccagagactgatttaattggtctggaataggaccccaacactggtatttgttgaacattcttcaagtgattttaacattcagcctggcctgaaaaccactgatttagagagttgtgaa

SEQ ID NO: 119616 - DNA, 878 bp, Homo sapiens
tgtctggtgtatattgcaaatgtttatcatttgtcttttaaatttattcatggtgctatttactataaagaagatttaattatgtaaatagacaaacattttaatcttttatagtttcttgtttttgtttcatatttagataggcttctgcactcccaagattaaaaaagtattctcctatatattcttctaatcaaaaaatatattttttgagatatcgtctttctgtgttgtccacactggtcttgaactcttgggccaaagagatcttcttgcctcagcctcccgagtagctgggactacaggtgtgggccagtgtgcctggttcttccaatattttgtacgttcttattgcttagtactctatgtagaattggcttttcttttataagtgtttctatggtacaaagtaggaatctaagcttattttttttcagaagagagagtcagtttttttcaacttacttattcaattgaattatttccatactgatttggaattctctttttatcatgaactatatgggtatatttttttgtttcttttctgttcaactgataatatttctctagtactgagctagtacctcactgctttaattactgtagcattatgttttgacatatgatgggactgcttcccctacattattatttttttcagaatttttcgctattcttgtgcatcccatttttccagattaattttaaaattaactcatgaatgcccataaaaaattaatcccttggaaatgcttcagacctttgagtaacatgtcaagaactgccatctttatgatagtgggttttgcatctagtaacgagggatctgtctcaatttatttaaatttactgtagtctccatttagatattaaaa

SEQ ID NO: 119617 - DNA, 209 bp, Homo sapiens
actgagctaccagcctctatgacctaggggtcccactcgactctacaagccagcctacagaagtagggtaaccttttctgccttcctagacctttcaaggtctgctggcttgctcagtctaagatccccagaccatgcttaaacccccagactctttcctaaccctgttcaagcaaggtgtgcttcgctgcctgttgctttgtcttagc

SEQ ID NO: 119618 - DNA, 414 bp, Homo sapiens
  misc_feature (324)..(324): n is a, c, g, or t
catgcgcacacacacatgcacacccgcacacaggcgcacccgcacacccctgtagacacaggcacatgcacatgctcacgcacactcccactcccacccccgcccccacccccaccctggtgaaccgtggggcctctgggggtcaaaagagaaagagaggggagggccctgagctccagggtgaaggaggcgttttggtgggggcggggggggggtaatgtgtgtgcgaggacagacatggcaagacagcaggacatctttggggggcagtggtgtagctggcactggggtacaaccagaattcagagcaggggtcaataaacntgtgccatgggccagatctagcccgggccctctgtttgtacaattcatgaactaaaaaaatgattttacatttttaaagggttgtttaaa

SEQ ID NO: 119619 - DNA, 610 bp, Homo sapiens
actatatgatcaatttgtgttatatatcttaaaaattctatctcaggaattttgaacatacacaaaagtggacacaatagtcagtgaatcccaagttcctctcgttcatctccaacaaccatcagttatggcctatctgcttttctccttcctgtatttttttttttcttgagacaggatctcactttgtcacccatgctggagtgcagtggtgtgatcactgcttactgtgtcccttcaacctcccgggctcaagagatcctcccatcttagctttccaagtagctaggactacaggcgcacaccaccatactcggctaatttttgtattttctgtagagacaaggtctcactctgttgcccaggctggtctcgaactcctgggctcaagtgatctgtctgcctcggcctctcaaagtgctgggattacaggtgtgagccactgcacccagccttttttttttgagacggagtctcgttctgttgcccaggctggagtgcagtggcgtgatctcagctcactgcaacctctgcctcccgggttcaagctattcttgtgcttcagcctcctgagtagctgggattacaggcgtgtgctaccacgcccagc

SEQ ID NO: 119620 - DNA, 429 bp, Homo sapiens
tggtaaagaaaccagccaaaaccaagatagcaatgaaagtgacctctggtcgtcctcactgcttattatacactaaccataatgcattagcatgcaaaagacactcccaccagcaccatgacagtttacaaatgccatgacaatgtctggaaattaccttattttgtgtaaagaggagagaaaccctcagttccaggaattgcccacccgtttcctggaacactcatgaataatccatcccttgtttagcacataatcaataaataaccgttaagtatactcagtcgagcagcccatgccactgctctacctatggagtagccgttctttttttttttttgagacagactctcactctgtcgccaggctggagtgcagtggggcgatttcggctcactgcaacctctgcctcctgggttcaagcaattc

SEQ ID NO: 119621 - DNA, 193 bp, Homo sapiens
aagactggcaatggggacaggcctcctgggggcagatcttcacatttttcaagtgagaagccaaacattcggttattacctgaagattcttgattttcaaatgttggctacaaactcaacattttcaagagcagataaagggctggagcaggcgcagcttggctaggacagcttccctatggctcctcccccc

SEQ ID NO: 119622 - DNA, 410 bp, Homo sapiens
tgagtagctgggactacaggctcccatcaagtctggctaatttttgtatttttggtataggcagggtttcaccatgttgcccatgctggagaagctcctattttaatagcagctttctcagtacttgttcaggttgcaaaggaagcaaacacttttgtgatgatgctgtttgctttacaaatttactaaaatatttgatggctgaaggggaaacccagaaaagttccaccattttaaaaatggagaaccttcctaaagttaatgaccttagatcagattcaagttttgaattatctcaataaatgcagcacctccaaattgttacaagcttcccacaatgattctccaatgattcagtcttgaataggattgatttggtttttgaggcattcagctttcttggcatcttt

SEQ ID NO: 119623 - DNA, 588 bp, Homo sapiens
acggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctgggctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgagccggtctcatttgatcttttcttcttctgggtggctgtactaagcggtcgggtttccccgggaatttgatggttcctatagtctgcctg

SEQ ID NO: 119624 - DNA, 252 bp, Homo sapiens
caggagaatcgcttgaacctgggaggcggaggttgcagtgagctgagatggcaccactgcactccagcctgggtgacagagcaaggctctgtctcaaaagaaaaaaaaaagaaggaaaagaggatgaacccaagaatagaaagatggtacccaaaacttgatgtccgtaggaaactgcacccaattctgggctctccattcctgcaggcctaactccgggctctctgctccgccagcagtggctctgcaaga

SEQ ID NO: 119625 - DNA, 352 bp, Homo sapiens
cacttgaggtcaggagttcgagaccagcctggccaacatggtgaaaccccgtctctactaaaaatacaaaagttagctgggtgtgctggtgcatgcatataatcccagctatgtgggagactgaggcatgagaatcacttgaacctgagaaatggaggttgcagtgagccgacattgagccactgcactctagctggtgacgaagtgagactgtctccataaataaatgaacacattactcaaatattctgaagtgggcctgctgttttcaggcaaaagagaattaagagttaggtggtgcttttaagtgctcctttaaaccagcctttttctctctgccagaatctttaaa

SEQ ID NO: 119626 - DNA, 514 bp, Homo sapiens
gcccagagccggagcaccgacgcagagagacgtggaaacagaaagcgaacgtactacggggccgcagcgggatccccgcgccagacgccaccccgttagcaacatatgggagagcagggatggttcccagccccttgacaagcgcggcgacggctccgcggggcctggcggcgaaggcgaggcgaggctgcggcgacgaggggcgcggcgggcgggccgccgggggagccccgcacattcctccccgcggcggaggcgcacgtggggttcgaggccgcagggcctgcagaggcggccagagcagagggcggcaggtgcgggaaagaaagaggacgggccccggaggccgcaagcccgagcagcggaggacgattcccggagcggcggcatgcgggtccgcgaccccgaggcaccggcagctcggacagggtgggggaagggagggaggcaccgggacgcctagagacggcagtgtgggggtctgaaggagagaccggatgggggccccgaggga

SEQ ID NO: 119627 - DNA, 375 bp, Homo sapiens
aattggacatctttcattgttggaggaacttcctccattttcatttcttttaaaaaagtccctttttgagattcttaactgtcagaatagtactgcaaataactgttagggtaaaatttctattgtgtttaaaatacgtttgtggttgtcccatgaagaggaagcagttgagggtctagtacagttctagtcttatctttttgtcttctgacatttttctcctgaaataaagatcctgtccttagaatttaggtaaaaatttcattgttaatttgagaggggaaatagaatactctgcttgactcctcaaattgaatgtgattcttactcataaggttttagaccatcagtttacctgggaagaagtatctttaa

SEQ ID NO: 119628 - DNA, 200 bp, Homo sapiens
tttcttctccctcagatgcctttctctgcagcttcagtctttctccttatgataatgtatcacttttataatgttaaaatttaaaagaaaaatttcaagcttgggataagataaagttttgaaagcaataaaaataaatgtgactaggtagatgaattctcataattttgagttcatttttgtaggtagtactaatgtta

SEQ ID NO: 119629 - DNA, 290 bp, Homo sapiens
ttattttaatatttcaactgaatgttgtcctaaagtaaacttggggaaattattttagccatgttgaccttgttaaaaagatttttagaactctttcttaggtataatggttgtggatttttaaaattactatttaaaaaataacttggctgggtgtggtggctcatgcctgtaatcctaagactttgggaggccaaggcaggtggctcacttgaggtcaggagtttgaaaccagcctggccaacatggtgaaaccctgtccctactaaaaataccaaaaataaataaat

SEQ ID NO: 119630 - DNA, 418 bp, Homo sapiens
ccctgctttgtgtttcatcaacaaagttatacatacttgacattacatcaaatttattagttgattatttttctctcccactaacatacacattccagtagggatgaagacctagcatttagaacagtacctaatataccacagacagccaatacatagttgatgaataattcaatgagataaatgaattaagtgaatgaacaaattatttctatctatgaagtgtagaaatttcaatccagacaagctcctgagggtggaggactagggctatacatttggctttaactactagcatagtaaagtaatgggagtataaaacattgcctgggaggcagttgccaatgaagaaagaacaaatacctgggaaacactgatggccttttttgttttgttttgtttgtttgagacaggatct

SEQ ID NO: 119631 - DNA, 311 bp, Homo sapiens
agtggatgcccatcaccaagctgggccgcctggtcaaggacatgaagatcaagtccctggaggagagctatctcttctcccgcccatcaaggaatctgagatcattgacttttgcctggggggctctctcaaggatgaggttttgaagattatgccagtgcagaaacagacccgcgccggccagtgcaccaggttcaaggcgtttgttgctatcggggactacaatggccacatcggtctgggtattaagtgctccaaggaggcggccactgccatccgcagggccatcatactggccaagctctccattg

SEQ ID NO: 119632 - DNA, 291 bp, Homo sapiens
gcagcttctcctgagcagtggccaccctacttcctgagacgtgggatgctggcagtcagcctttgcagaggctcctgacaacatccaggtcttgattctgcagcgaggcggtgatttcagaatcccccagctgtgtgggggagggagggagacagtgggaagacaagctctgctcggctgagctgacaacaccaggaaagcttcactcctctttgagaaggagaaggagcttgtgaggctgagacggagcaggagacagaagtgcgcctgggtgcagaagtgcgcgggtgg

SEQ ID NO: 119633 - DNA, 634 bp, Homo sapiens
tccctgcgggaagccgggcggggtgggggagccccggccgcgccggctcccggcgcgctcggcctcggaggggagggggcggcggtagcggcggcggcggtgagcggcgcggctgccctggggccatgtggactggcggtcgccggccgggccggctgcgccgggcggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttcca

SEQ ID NO: 119634 - DNA, 195 bp, Homo sapiens
aggctcagcaggccgaaggaatccagcactgcagtgagaggcctggctggggaggggaagccctccagttatcttgggacaatcactccttgggggcctgggacctggctggctcttcatatctggttatctcgcctggctgatgggagacgatgttggccgataggagggagctgacaggcctctggatcagat

SEQ ID NO: 119635 - DNA, 474 bp, Homo sapiens
gcacgagtgcaatcctacacctgtatataagcactattgatattttgattaagttccttccagacatctttacaggtacatgtgtgcagtacatgtatgtgtttttgtcactctaaagaagagaagggatcacagtaatgcttttggggtgggaggaagcccaccttcacgttcagtaaaagggatacgtgaggccgggcatagtggctcgggcctgttatcccagcactttgggaggccaaggcgggtggatcacgaggtctggagatcgagaccatcctggctagcacggtgaaaccccgtctctactaaaaatacaaaaaattagccgggcgtggtggcgggcgcctgtggtcccagttactggggaggctgaggcaggagaatggcgtgaacccgggaggcagagtttgcagtgagctgagattgtgccactgcactccagcctgggcgacagagtgagactgcatctta

SEQ ID NO: 119636 - DNA, 506 bp, Homo sapiens
tcagagttattgtgccatctctaaagtatactttttctccctcaggaagcatgatacactttagccacactggcttaccagggccttgctgctcagtggggaaaggggcacattctgataggctttcttcctcttcacttgggttactttaattatgtatcagctgggtgcagtggctcatgcctgtaatcccagcactttgggtggccgaggcgggcggatcacctgaggttgggagtttgagaccagcctcaccaacacagagacaccctgactccactaaaaatacaaaattagcctggtgtggtggcgtatgcctgtaataccagctacttgggaggctcgggcaggggaatctcttgaacctgggaggtggaggttgcagtgagccgagattgcgttattgcactccagcctgggcaacaagagtgaaactctgtctctaataataataataataataataataatgtatcaatttggcttttctttcgtcacaataaatt

SEQ ID NO: 119637 - DNA, 344 bp, Homo sapiens
aggcgactccgaggattcccggctctgaacttaggctatttctctatctccctcacatttccccattactagcatcttgaaatagtgtggtacatttgttacaactgaagagccaaatattgatacattactgttaactaaggtccgtaatttactttagagttcactcttggtgttgcagtttctatgagtgttggcaaatatatcatgacatgtatctagcattatagtatcatattgagtagtttcactgccctaaaaatcccctttgttccaccttttcatccctccatctacctgaacccctgataaccactgatccttttacagtctctatagtttta

SEQ ID NO: 119638 - DNA, 633 bp, Homo sapiens
attccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatacagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcgcttgaacccggggggtggagattgcagtgagccgagatcaagacattgcattccagcctgggcaagaagagggaagttctgtctctaaga

SEQ ID NO: 119639 - DNA, 419 bp, Homo sapiens
tattttgctatacaaaggtcctgggctcaaatacatttgtgaaaatattaaatagttcaaacagctttatgtcataacttcttggctcctatgatgatgtgcttgtgaagctctaagactggggagatacgacaccccgagcctatttaaccatggaatacttttacttcagagcatttctcagcactggcattccattggctattttttgataaatgctgaactgcagcaaagaaaggaatcgtcttgaagagatttcactcagaccaggaagcagcctaataatgaaacgtccatgacccactgaacagaacacttcagtagtaaccaaaatctttcgtctctaggctcctcatctctttcacctggacagggatggattcatatggcaaaatattcttttccaaacccagtttatc

SEQ ID NO: 119640 - DNA, 527 bp, Homo sapiens
ctgtcttcccgtctgccacatgttgcctgttctccgtgactttggtaatagcttccttgtgtatgaggatgatgtccaggatgttggtctggtgtccctgagacagcactaacaggtccatggctgggtccaggtccttcctggactgattggcaaagagctcactgatgttcttgaagtcatctttggtgaagtggatggcctagtcaagttccaaggcctggctgaggctgaagaaaaactggccaccttctgatgctctttctaaaagcctgtgactgtcatctgcttgcttgtcaactcattggctgtgaggttgagctaagtggcctgtgtccatcttcttggggaagaatttgaagccatcagtctttctctcccacccctaaaggttgatggtcaccacctgggggtgtgctgagggtcagaaagaagccagcactcactatctcatccttctcagccttcctcttgcactctctccgggctgtctcttcagtgctggtaggatacatcagaaagtgatg

SEQ ID NO: 119641 - DNA, 405 bp, Homo sapiens
gcactaggattttaagttccctaggtgactctactatgcagccaattttgagaaccaccaaactaaaatactttttatccagcccttttcaaaaaaattttgtaaaataatggcaaaatacacataacataacattatcattttaacatgtaccatttagtggcactaaatatgttcacaatgttgtataaccatcataattatttctaggacttttttttttttgagatggagtctcacactgtctctcaggctggagtgcaatggtgccatctcagctcactgcaacctccacctcctaggttcaagcgattctcctgccccagcctcccgagtagctgggattacagacacctgccaccatgcccggctaaatttttttttttttttagtggagacggggtt

SEQ ID NO: 119642 - DNA, 227 bp, Homo sapiens
  misc_feature (10)..(10): n is a, c, g, or t
tcgactgttnacctatcttccctacttacctctattgttagaatcccgatagctccaccctggacactctttcttctcatttttctattagatctttcttatcggcattcaaaggcctagcaaccctagtaacctttaaaaacaaacaaaagttccatgacctgataactctcttcagttaccatcctttctcttgcctatctttcccagccaaatgcctggaaaag

SEQ ID NO: 119643 - DNA, 400 bp, Homo sapiens
ctggctctcagagactatgttgcgtccatcctgaaatcgtatggatatgagaaatctgagcccatagtaggtggctgcttttaatgtcactgaaaaacttagagaataagaagttcaaatctctaaagtctgaattcaagccacaggctgaaacctaaagactgcctagaacaacgcggaatttcattccttacagatgcgaggccaggatatctgaaaacccatcttaagagtctgagcctttggctgggcgccgtggctcatgcctgtaatccaaacactttgggaggccgaggcaggtggatcgcttgagtccaggagttcaagaccagcctgaccaacatggagaaaccctgtctctactaaaaatacaaaataagcaggtgaggggatcctctag

SEQ ID NO: 119644 - DNA, 239 bp, Homo sapiens
cttaaaaacttgactcccacatgagctacacagaaaactgtgcaagaaggaaaggttttcacaaacacactcacacctatgaattactgaagtccctgctctgtgttgacctgcagtgcagtatgttcagatcgctcccgttcatctacggtgtaaacttctccaaaacatagcttcttatttacacaggaaagctctgaagggcaactaatgataaagccacaggaaagttttctctg

SEQ ID NO: 119645 - DNA, 151 bp, Homo sapiens
gggtggtggggattgctccaggccctgaatgaggtagtgtggtacccttcttgcagggctatgggaacactgagtggcacagaacagagcaagtatttacaaatcctgtgaatggggagtcagagcctaccttatccgtgaagatgggaca

SEQ ID NO: 119646 - DNA, 468 bp, Homo sapiens
aattcagaaaacaaagtgatcccttatcacttttgatacagtgtgagaaatcagcagatctcctggatgacgttctggcggtcagcagtcttctggacactttccggacaccagcccacagtcattccctcccacagcccactcagaactgcaactggaaatccaaacgcattcaaaaactggctaaggcaggtcagcattttagccagaaagtatctgcttcactcaagccagcagattctcaaatcacaatcatttgactcaaaaagcaccattagttacagactcctgtgtatgccagattatgccagaaaagcatacatgtcctggtaatgcaataaatcttgacctaagctagaagagtgtcaaaaacctaaatacagaaaaaagagtgggtatcgaaacagacacagcatggagcatcaggcctcattacaaatcatgtttttaaagaatttcagtcgctta

SEQ ID NO: 119647 - DNA, 582 bp, Homo sapiens
tagaaatggaaactgtagactcaggaaaatgagcaggagaggtgaacaatgcagtgcgctaatgagatacaagtgtagagtcaacaactggatactcgatcatcagaaatactgcttgaaacgaccttcttttttttttctgagatagtctcgctctgtcacccagcctggaatgcagtggcacaatctgggttcaatgcaacctccacttcccaggttcaagagattctcctgctcagcctcccgagtagctgggattacaagcatgtaccaccacatccagctaatttttgtacttttagtggcaacggggtttcaccatgttggccaggctggtctcaaactctgacctcaagtgatccacctgcctcggcctcccaaagtgctgggattgcacgcgtgagcccccgcgcccggcccagaaccccttgataatgaaatgtgaagcctgaaccttagacaccagactgcagttaaatacggtttgtccgtaagactggaggctgcagttgaatacggtttgtccataagattggaggctgcacttgaatacggtttgtctgtaagattggaggctgcagt

SEQ ID NO: 119648 - DNA, 212 bp, Homo sapiens
tttagctacagattatcacagtttgtcccaggcttgcagatgttagaagctttttctttaaataggcacaggatcttgcagtgttgaccaggatggtttccaactcctaacctcaagtgatccatccacctcagctttccaaagtgctggggttacaggtgtaagccaccgcacctgaccctttcattcttttcgtcaatttgtagaccccg

SEQ ID NO: 119649 - DNA, 391 bp, Homo sapiens
  misc_feature (43)..(43): n is a, c, g, or t
tctagaggatctgttcggggcattctggactcacagttggggnttgtatgaccttgggcaaattcctcaacctctccagccctgcagcaatagcaccctcctcagagagctgttgagaaaatgcaaggtgttcagtgtctgttattatcacatccccatcacacagatgggacaactgaggtctgcccagagaggaaaggacgcttgcccagcgtggcacaaaagctgtgtccaaattagtaagcaggtatactgggtcctggttgcgaggggacacccagccctccttgagctctgcaaagtcagcagccccagcctcctctgcaggacacagccagaaaaccctgcagggagcgcccagatcctgtcccaacaaacccagtccacttgg

SEQ ID NO: 119650 - DNA, 449 bp, Homo sapiens
ggtaactgtagagagaaactaccacctttattctccctatgttgggtgaaaatgaaatttctgtagaaaaatttatagtccccagtccagttcaagctttcttgtacagatgctgcttgccttacaaaggggttgtgtcctgataaacccatcgtaagtagaaaatattgcaagttaaaatgcattaaatacacctaacctgttgagcatcatgacttagcccagcctaccttaaacgcgccgagaacgcttaacattagcctacagttagacaaagttatgtaacacaaagcctattttataaccgtgttgaatatcttgtgtaatttactgactatagtacactgtagaacataatagcagtcatttaccctcgtgatcacagggctaactgggaagtgtggttcactgccactgccccgcctcatgagagagtgttttcacacatt

SEQ ID NO: 119651 - DNA, 449 bp, Homo sapiens
ccaaggtgggggctacattaaaaggaggatacattaaaccgttaaggagagaggaaagtgggaaaaagccaccagctaatttcggtttcctcaccccatgcagctaaaaggttatgtggacttgtggttgatacctgtggggatgggtatcatactccttgctagatgctgcagatgcaggaatgaatgtgtcaccagcttagctcttgataacaaatggtgcatttcgattttcttaaaattgtgaacaattgaataagcagtgacattctttgtggtgttcaaggacagaatgaacactctactattgttgcaaaatcattttttatactccagagcattcagaactaaaccatttaaccacgtactgctcagtcttagaaatgacattgtgttggctaggtgtggtggctcatgcctgtaatcccagcactttgggaggctgagga

SEQ ID NO: 119652 - DNA, 333 bp, Homo sapiens
ttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatgg

SEQ ID NO: 119653 - DNA, 440 bp, Homo sapiens
tgtatctttaactccacaaggcatctcccatgaactgtctgaaatatctttcttcttcaagatgccaatatgccttccactctcctcctcccaggagatgacctctccaaggcatgtaaccttgaacaagttgcttaacctgagactcagtgcctcatcccattaaatgtcctcatgtaatgttatgagaccaagttaagagaatggcagcaaaacacttcatcaattaaaagtaagtgataagtgaagacttaattagtattgctcatctctgagactaagactgacaagcccttccaacattgctccttccacctcagatttctctgcatttgcagctcagctcaactgttttcctttttactggttttggaggaaatacataaaactctctcccatttcctctatagcccatcctaaatttcttttttttttttttt

SEQ ID NO: 119654 - DNA, 590 bp, Homo sapiens
gaggaacctggtttcatccatcttcagccactcagataaagaatgctcttggaaggcaagaagcagtgacaatctgttcacttggtaacatcctctgaagagatctgggtcagagacaagttcttgctctgttgcccagcctggagcgcagtggcgtgatcatggctcactgcagccttaaccttctgggcttaagtgatcgtcctgtctcagtcccccaagtagctgggactacaggtcttggctcaaaggtcattcccctcagagggaatttccctgaacatcatatgaacagaacgccttcccattcttctctattgcatcatatcacatcatcacgcttattcgcatcatgtcatttttcaccatctatagatatatttcattccttacttatgtttatgtttgcctcactagaacatagcttctgtaatgaacattattatgtatgtaatctttcctcttctttgaattattcctgtggactcttttcctgaataaattctcaggagtgagattattgaattgaatattgtgaaccttcttattgtttttgaaatacggttgccatagcactctccaaaagttgt

SEQ ID NO: 119655 - DNA, 379 bp, Homo sapiens
taaaatattgaacctctgcggtcaaagcaagtgtgttttgagaataaagatggaaacaataattatataaaagatagtaatttaataaattttgaatgatgacaacaccaatacctacaaataagtcatatatcaaaaacaaagaatttcatgaagattctaagctatatataaaaaacaccaaaatagcatgcattaaacagtttttggaataaatattgctagtatctcaaaaactaaagagaaaaattatcagtacaaaggatggactttgtactacaaaggaggtgaagcaacaacttcctctaaactaactaatgttaaatttttcatgctatccacattcataacttaagtccacatgcaaaagaaacaagct

SEQ ID NO: 119656 - DNA, 242 bp, Homo sapiens
tgagtggggacctattggctgccagttgtttggtgtctggtcagtgcaaacctgggctgtggggcttgatcagtggagacctggtcagctggggcttagtgctggcctggtcagcatgggctggggcactggtgaccaggtcaaggggtgctattcagtggaggactgggcacatgggacctagtcagcagaccctggtgggcgtgtcctcatcagtgaggtccttgtcagtggggccctgg

SEQ ID NO: 119657 - DNA, 169 bp, Homo sapiens
gttttgtgagagaaaaaaagataaagaaaacataaaatagtctcacatttcagaggaagttccatattccaagactccactggcattatcagagaccttcaatgaagaaagactctttcctggccttctgatacttgccaagctcttaactgtcccataagtgtctctg

SEQ ID NO: 119658 - DNA, 506 bp, Homo sapiens
aagctagggcatttatctactgattctgccccagtggttgacagtcgccccaatggtgtcagttctcttgcattaactcccctgcacttcctggcagtggctggagagagaatgcccttaggcagaggggcagagtcactggcacttgaggagaggggctgggaacatctcggggactgcctgtcacagctgcaagtgaacccagggatgggctggggacacagggcaggatatcaacaaagtcatacgcacatgtgcgtgcgcacacacacacacacacaagcatactcatatattaggacaaaatgtaaattcaagtgaggtctgtaataataggaactattaattttgttaagatatgagaatggtggttatacttaaaaagtctttagacaaatgtctgtgtctaattgagaaagtgatgtttatgggtaaaatgataggttgtctgggatttaccttaacatattatgccaaaaaaatgggataaatgaaataagaatggc

SEQ ID NO: 119659 - DNA, 602 bp, Homo sapiens
aattccatgccagttgtagttttcattacgtattttataaaagcattagttgggtttatggaaggagatgggcgagaaaaatgtttctttttaaagggaaggtgggaatgaatgctttcatatgtgtgtccagattggctttgcaaatacagtatcccacattgaaataccactgtactataaatattgctataacagtcttatggagatgtaatggtggaatcaggggaagagaactaaattaagagtcaggaaaccttaattctcattgggttttctgggtaagtggaatgatgattgtgccaatatcacttaccctgtctgtgcctgagaggtctctgacctaaactaagtcactgggcggttgggcagagccaaggagtttaatatgtgtgaaacaattttataagttatgatttctatctaaatctgagattgcattaggtctgagggaacaaggaaagcccttttaagtgagatagttacatttctttcctaaggaagttctgaatcagtaagttaattacctctctcagctagggaatcaattagctaattataaagagagccaaggtcaaatttaagccagtctttccattagt

SEQ ID NO: 119660 - DNA, 280 bp, Homo sapiens
tagaatgagccgggaccggggcaatctgggctgtgatttgtcataatgggttctttgattgaaagacaagtaactcattccactttggctataactgatgcaaatcagttattatttaagtagttggtttattttgcattttattttcgatcatcctgtctcccacacatagccttactgccaacttaatttaatggatattcccctaatttcctaataccaagtatacaaaattacttatatctgttactacagagaaactgccccttttccttcctaa

SEQ ID NO: 119661 - DNA, 283 bp, Homo sapiens
gctgctctcacgttggctgggcggcgggttatgatcctgtattcctgccttcctcagagagcagcctccttccccattttagagatggggaaattaaggtccacggctctgacggcctgacccctaaaggctcctcgagttcccgaaatccagcaccgtaactgccgctagaaggataaaccctcgactttctctaatttaagcaaccttagaaaaccagcgcctaaacctttcctcttaggaccctcaagctttctgaccaaacaccaccagcccagttagc

SEQ ID NO: 119662 - DNA, 348 bp, Homo sapiens
ccactccatcttccttttccagcaaaaggacctatgcggggggctgggatctaccccaggggctgagtaaagaaaccaggccacggtgtaatgcttctgcagttgatcacactagagcccgacccaaaaccccaaaccactctccatcctccccagcctcgcagactgctggcttctccaagccatctttccttctgtctgtctcctctgctgagctccatgtgccgctccttctcctccccattctcccgtttttctgtcctcagaacacttcctcatatccttccctggtccctggctctctgagtccctttttttttttttttttttcgttgttgttgtcgttgt

SEQ ID NO: 119663 - DNA, 181 bp, Homo sapiens
ccttttgagaatgtgatcacccaacagagtctttatctaggaaaaaagcaaatatatgctatattctgcatatgatttctgggaagccaaggaccctcagaagtatatgcatgaaattaagaaagaagcagggcatggtggctcacatctgtaatcccagcacttagagaggctaaggcag

SEQ ID NO: 119664 - DNA, 787 bp, Homo sapiens
gagggagtgggcttattttcttctgctcttctaccatgtgaggacccagctttcaatcctctttgtccttccctctcttctgccatgtgaggacagagcattcatttcttctggaggatgcagcaagaaggcatcatcttggaagcagagaatagccctcatcagacaccaaacttgctggagccttgatcttggactttacattctccagaacagtgagcaataaatttttagtgtttataaactacccagtctcaggcattttgttatagcagctcagactaagacagactaagacaatatacaatgccttagtttaatactttaatactttcatgaataacaatagtaaataaatgaatacaattatttaaattatgagattgttcattgtctcattgtctagtccttacctgtatctgtctctctccacattctgaaatcgaccttgtgatttttgcataattgtgttatacataactgtatacccagatgtccctcaatttcatatatatgtttacaaaatagacattttatcttgctcttctctttcctttttatttgatacttttcttatctattattggtttagctattcctagtggcctaaagatgtaattttattgcaaacatctgaacaactcaatatattcttcacactccctgcttactttaaagctttagtatttacacagttggggatatatctatatagaaatacttatcagtgaagtaaaccttttttccctgatgtttcatcttaatggtaaaatcatcctcctgttgc

SEQ ID NO: 119665 - DNA, 714 bp, Homo sapiens
gctcctgagagggactttgtcctataatccatccatccctggaaaatacatgaaataagacttggagataaaggctgaatgcaacagtaagccggtataaaagttatgttctgggaggcaatgctacgagttacagaggagcactttatttatttgtgtatatttatttttaattggtgtgatatttagagtagtcaatcattttgacccctcttaactacttattgatcagaatattgctaattccgcatggtgcatatactttttaaaaaagacttattcaattacagtgatgaatgtaatttatttgtctttaaatttgctctgatattaattaatgaaaaaatgcattacagcctctttgtaaaagatgagggcaaggtaaacaaggcatgctgtctctgagggcttcagattttatctctaatactcaagatgataaacttagatattacattagctttagatatgttagtaatcaagtgtggccagatagctgtctcctgattacgtatctgagaagataaatatggtatttatgccaatcaaagtcaacttcaattcactttttgacgagttccaagcttaacagagtgttctgcaaacagaagcagcttaagagatcagctgaaaatgaaaaaattatttatccctcagccatcttaaggctaaagataaacagtccctcgatatattccttaaatgtgagaaaag

SEQ ID NO: 119666 - DNA, 420 bp, Homo sapiens
cggaggcgtgaatggcccgaggcgtgaatggcccaggactgtggtggcactccacatgggagtaccattcatctttttctccatctctctggttatagcattgagtatgcaaggtccaaacattatcacaaggcacacgggaaaaagaggtcctagtagagagctaaccaggtccaaaacaaagactagaatccattaaaaagggattgtagccaactgagtttgcattttcacctgagtttgtcaatgattctaattgagtctttaagcactcataaattctcctctacctaactggaggtgttgatccagaaacagcatgtttcatttacaaatgcacaagcgccccttacttcagccataaggacatcaagagtttgtctattttgcatggccactgaggccagagaatttatggac

SEQ ID NO: 119667 - DNA, 309 bp, Homo sapiens
ccactctgcaggctttttaccatcactggccaacagcgctgagaagggagaaagtgctgatcaactgtggctaagatatgactccacactgtccacgcacatgccacctggtgccccaggtgagtcttggccggaccaaagggatgaagcaagaaaataaatcagcagcctggaaacagagaaatgagagccaccagaaatccagagggcacagccccggaaggcagactgctgctgtagctctcctggaaggccatggccctgcctgacatgcagagggaagcgggtggggattctgcccaagcatcc

SEQ ID NO: 119668 - DNA, 357 bp, Homo sapiens
tttttttttttttttttgagatggagttttgctcttgtcgcccaggctggaatgcaatggcacgatctcggctcactgcaacctccacttcccagttcaagcagttctgcctcagcttcctgagtagctgggattacaagtgcccaccaccacgcctggctaatttttatatttttagtagagactgggtttcgccatgttggccaggctagtctcgactcctgacctcaggtgatctacccgctttggcctcccaaagtgctgggattacaggcgtgagccactgcgcccagcccaaaaacttaactattgacagcatactgttgaccagaagccttaccaatgacagttgattag

SEQ ID NO: 119669 - DNA, 474 bp, Homo sapiens
aacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggctttt

SEQ ID NO: 119670 - DNA, 614 bp, Homo sapiens
gttattttatatatagcagaagcttttatgctgctaaagggaaggaaccaggagaggggagaggaatgattgatggagcaagaccctggaagagatgagagtacagagattgtttccagagaagggaaaccttcccttgcatctgacaccaaggagaatgtaagggggatgtaagcaaatatttaaaaagagcaagaagaatacaaataataccaaggtgttgagccaagaaaaccccgatgctcctgaatcatttgggtaatgttcgtttgctccttgttcattcatttttatgcagctgctaatcctgactcacagagaagcagcaacagaggcaaaatattaagaaaatgtattaaaaacttacatttggcatatttctaatagagaatccaaaatagattgccactttccaattcatatttatctcactcttagaatcccagggcaccatgagattgaaagtaatgagaactataaccaggagggtagcactagaaatcgaaatacgggcatgtgttcctgagtcactgagagctctgagggtacagaacatcacagcttttggaacctacatgagggaaaacagacaagagccagctggagcgacacat

SEQ ID NO: 119671 - DNA, 598 bp, Homo sapiens
aaagaaatcttaccttgagtacttctggctgtggagatcggtgccttaattagccacatgttctttttacctcctgggaaataagtacgggataaaattggggatcaagccgtagacgtacattgacttagcacacgccgctaagtaattcatcaaggaatgttggtaattagtcctgcctctttcaactcttggcttattttataaaaccggttgatttaaaataatgcctgctgatttattacccacacgtttcaagactggtacttggctcttaaacaaaagcaatattgtgcagcgatggaaatgcgccctcttgtttttgtgtttttacaaattctgaagggccatctatggcccccctattaactttgttgcctttccttttgccccattcagcattttactgggctttcttttctgtcttggtgaagagaaaaggggaacaaatttaaaacaaaaaacgaaaaaatccaggctcttagagatttgggatgtgaggtgcttgtcaaagtgtattggctcggtgtgatttgatggaatttaatttgaatccttcgtctggtaagacaggctgtagtaatagcctttggttttt

SEQ ID NO: 119672 - DNA, 561 bp, Homo sapiens
gcacgagaaaaaaagtttacattaattcaggtggagcaatatggggcaataggataagaaaggagtaataatattggtctaatgtgtggagaaaatgagaatacttgatgaagatatcacaggttacccagagaggcttgaagaccagctgctgggagatcaggaacctgagcagcaaggatagctcaaagggaagtcattttacatggtgtgaactggtgtaaaagatcagggaaaaatagaaatcatagataattaaccaatcttaaaatagagcagactgggcacggtggctcatgcctgtaatcctagcattttcagaggccaaggcaggcggaacacctgaggtcaagaattcgagaccagcctggccaacatggtgaaaccccatctctactagaaatacaaaaattacccgggcgtggtggcgggtgcctgtaatcccagctgctgaggaggctgaggcaggacaatcacttgaacctgggaggcagaggttgcagtgagccaagattgcaccactgcactccagcctgggtgacagagggagactccatctca

SEQ ID NO: 119673 - DNA, 658 bp, Homo sapiens
acagcctagaaagggaaacagtcaggtaaaccagcaattacaattagggcacagacattcatcaggtactacagcagtagcaaaggaggtgggaattggttaggaaaaacttcctatatttagctgatttctgaaatggaactataactatagggagatcaggtaagggtatttcagactgaagcgaacagaatggataaagcttgaaagaacatggtcagtttggagtcatgctggcaaggctggagtgtaagtcatggggaatagcaagagttgagagtgggcaggagttaagatcacacactgtcacacagagctgacagagttaatggtggtaaaggagagatgacagagccaaagtaaatagcatgcttttaatttggtgactgaatatggtgacatcattcaccaaggaagggaataacgatttaacacatttttatgtggctttgagtaggaaaacactaaaggtaatttcatgcagtgaatttgaggtgccttgactcattcagatagggatgcttagatagcagtagtacatataaattttgtttgaaggaagagatctgaagtagaaatacaatttatgcgtctagaaggtttaacttgtgttggtgcagcagtcctggaaataccagcactctatggtcacattcct

SEQ ID NO: 119674 - DNA, 277 bp, Homo sapiens
tgtagtcccacctactcgggaggctgaggcaggagaatcgcttgaacccgggaggcagaggttgcagtgagccgagatcatgccactgcactccagcctggcgacagagagagactccaccacaaaaaaaaaaaaaaaaaaaaaaaaatcaatagctcaaagttttactttcatattgcatgtatttatttttttattttttgaaggaaatactaaccaagtacctacttaaagtgagaactagaggaaacaccaggggcataacagggaacaagct

SEQ ID NO: 119675 - DNA, 804 bp, Homo sapiens
agaaagaaaagagaagagaagagaaaatggagaaagcatccaaagagacatttctcaaaagaagacattcaaatggccaacaggttcaagaaaaaaaatgctgagcaccactaatcattaggaaaaacaaattaaaccacaatgagatatcatcttacatctgttagattagatgttatcaaaaagacaagaaacaagtgttggtgaggaggcagaaaaaagaaaacccttgtacaatgttggagggaatgtaaatcagtacaaccactgtattggtctgttctcatgctgctaataaagacatatccgagactgggtaatttataaagtaaaggtttaatggactcacagttccacatggctggggaggcctcacaatcatggcagaggtgaaagaggagcaaaggcacgtcttacatgggagcaggcaagagagcatgagcaggggaactgccctttataaagccatcatatctcttgagacttattcactatcattagaatggtgggaaaaacccacccccacgattcaattacctcccaccaggtccctcccacgacagctggggattatgagagctacaattcaagatgagatttgtgtggggacacaaccaaaccatatcaaccactacgagaaatagtatggggtttcctcaaaaaactaaaattagaactactatatgatctagcaattccacttctgggtatatatccaaaagagatcaatatgtcatatcaatatgtcaaagaaatacctgcactcccatgttcattgcagcacttttcacaatagccaagata

SEQ ID NO: 119676 - DNA, 419 bp, Homo sapiens
ggcattaaaaatgctaatttttaacaattacctaatataaaattattgcccttttgatttgtgctttggctaaggtagagcctgaaatcaactgtgatttggttggtatttgagcaggccagagtctttaaattaacttgtctttacgatttaatggaatattgccaacatattcgttaagtaagtggagtgtgacattactgcttccttcctcccatcagactgtaaatttagactccgttttattgtgcacacatggacacttcagaaaggcagctgtggctgagttgtagcctttattaaatctcttgtcttgaggagcccgagaattgtgttaagggagacagtggttccaaatgactgaggaccaagcagggtacgttctggattttagaggaaaggaaatcttctatccaaaa

SEQ ID NO: 119677 - DNA, 748 bp, Homo sapiens
cgcctttgggtccgcgccgcctttatgagctgtaacactcactgtgaaggtctgcagcttcactcctgaagccagtgagaccacaaacccacagagagggacaaacaactcccaacgggaggaacgaacaactccggacgcgccaactttatgaactgtaacactcaccgcaaaggtctgcagcttcactcctgaagccagcgagaccacaaacccacagagagggacaaacaactcccgacgggaagaacgaacaactccggacgcgccaactttatgaactgttaacactcaccatgaaggtctgcagcttcactcctgaggccagtgagaccacgaacccaccggaaggaaagaacaactccagacgcgccgcttttaagagctgtaacactcaccgcgaaggtctgcagcttcactcctgaagtcagtgagaccacgaacccaccggaaggaagaaactctggacacatctgaacatcagaaggaacaaactccggacacgccgcctttaagaactgtaacactcaccgcgaggctccgcggcttcactcttgaagtcagcgagaccaagaacccaccaattccggacatactaggttataaaaatcaaaatgtctcaagacatggccagattcttttgggaggtaaaaatcaccaccagttgagaacctctgctttcatgctatagcacaacactgtctgatagaacttgctgcaataaggggagcagtctctgtctgtactg

SEQ ID NO: 119678 - DNA, 281 bp, Homo sapiens
tggaattacccctgccctttgtctcctggtgaacctttgctttttcaagtctcaattcaaaagtcaccctgacttctactccccagtgtcctacccagagttggatgcccctgcaccgtgttgctccagccctgaattcacaccctctgtgagaaaacacattacgttggcttctaatcagttgcttccctgctttcttctctcaatgggctgcacgcttcctgagaacagggactgagtctctttctgcttttcattttcagaacagagtgtctgtaata

SEQ ID NO: 119679 - DNA, 527 bp, Homo sapiens
gtgcacgtctggtactcagatattggtttctaaacaccattgtccagtaaaaggacccaggctccttagggaagtgactgattccaaaagtagggcaaggaaaatacaagattagcctagagcatcaggggatgccataatgtgaggaagtacttgaaaaaagatggaagcatgtcaaaaggacatcagagtcagcctgaaggagctcccagtggccaaagctagaataatttgaagaagaaaataatgatgataatattgggttataacccacagaatgaagtaactgtccatgatgagtccacacgaatagcactagcaataagggaaactgacatcaagtaaccagttatgaggcaataaaaaagatacatcattgcttttgtggtcttctttcaaaacaaaaaaaagcataacttaaaggtaaacactaggaaacatcagacagccccaaatctagtcattccacaaaataactaaccagaaataactgacagggaatgacaaggaactgtcacaaactgtgg

SEQ ID NO: 119680 - DNA, 374 bp, Homo sapiens
ctatgaaaccagtagaatttcttcaacacacacccaagtttatcctgagcaagtataacaaatacctttacatagaggactggtgactcaattcatcgggcatacattattattgctttaatttattactttttagctatttattaatttttgtgtcaagtaaagccttgagcataaataatttgggacacatatacttttactttccctttgacacagttaaaactgaactaacaatactttatccaaagaaagaagataaccactgactaacagatttatttatatcaaagacttctatagagctacaaaaccacctctttccaaaggggttcaaaattgactgaaatcattcaagtggtaccacaaaatac

SEQ ID NO: 119681 - DNA, 504 bp, Homo sapiens
agaggtggcatctttccctggggctgcctcccctgcttgcccatggcaggatttctgaaggccacagtcagcctgggaagttaggatgccagggagttggcatggagtccctgtgggacttggtagctctggggggcttctgaggaagagactcattgttactggagtgaacgtcagaagctctgcattggtggattagtgagtcctttcctcattttctcctcttgtgcaggcttcttgttcctaatgcactcattctaactgatgagataattacagcaaaattttgtatagctactagaaccaggaattccgtcgacacaattagaattggtaatccttaccttcaaatcttcattctagtgaaacctaaaataaaattagcattgctttcaagcagagcttttgtgcttaaattgccccatttctgttccatatcttaaggctgacctccattccagatttcccatttggggacttggatggttctcctgtggagccaag

SEQ ID NO: 119682 - DNA, 299 bp, Homo sapiens
tacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactc

SEQ ID NO: 119683 - DNA, 192 bp, Homo sapiens
gatcagggaagggtaagctggcctgcttctaaccacagaggtatgaggatgtgtctagagtacaaaaggctaagctcaggctgggcgcggtagctcacgcctgtaatcccagcactttggaaaatggtttgacaatatccactaaagctaaacatatgtcttccctatgctctgggccattcaacgcctgcg

SEQ ID NO: 119684 - DNA, 487 bp, Homo sapiens
accagagttctgttgtctccaatgtcatcttccacagatttcaagttgtgaagccctgaactgttaatttatcttgagaatgtatatttaagcttaatttaagactatatacctaaaaattgagcatataatttctataatttgtttatgtaagtttctgtaagtcataagtatgtggtttccaagtgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtccca

SEQ ID NO: 119685 - DNA, 582 bp, Homo sapiens
gcaggcctgtaatcccagctacttaggaggctgaggcatgagaaccgcttgaacccaggaggcagaggttgcagtgagccgagatggcgccaatgcactatagtccagcctgggcgacagagcaagactttgtctccaaaaaaacaaaacagaaaaaagaatgttatggtaaattagtaatgtctgccatgatcgtgcagtgtaagtggcaacatctgccagttatttactattccttgataacactgttcaatataactgagttaaatatatgcttcagaaataatgctttatgtagcattcttcagagtattctcaacaatgtataaaatacagttgattatcctaagagatggcaaatctagatttggagaaactgagatgaggtggttgtgaggtttttatgactgtttagtaaaaaatttagaaattgaatttatttacctgatttctagtttaatattcattagacaagatagaaagtattgaggatttactattagaggtaagatgattgtgtaaggtggtagaataaaaagctaacagaaagaagactgctaacagtttagtgtcactctgacc

SEQ ID NO: 119686 - DNA, 173 bp, Homo sapiens
ctgccttagcctcccacagtgctgggattatagctgtgagacactgggcctcgcttgtcattatacacttctgtccttcctttatggacaacactgagttcttcatagacctgcctgagtaggtgttcctgcctatgtggcgtctgcctcatcaatccccagggccctcttct

SEQ ID NO: 119687 - DNA, 791 bp, Homo sapiens
gacggtggctcacgcctgtaatcccagcactttgggaggccgagatgtgcagatcacgaggtcaggagatcgagaccatcctggctaacatggtgaaaccctgtctctactaaaaatacaaaaaaattagccgggtgtggtggcaggcgcctgtggtcccagctacttgggaggctgaggcaggagaatcgcgcgaacccgggaggcggagcctgcagtgagctgagatcgtgccactgcactccagcctgggcgacagagcaagactctgtctcaaaaaaaataaaataaaataaaattcattaaattcaatctgttcatcctattttaaggaaactgtgggacagagagataaaaatgaataaataaaggtcaaaaagtcggagcttggaataaacaccaagtctgtatttacagtatgctggctttctcagtgtacattcactctgtcctgtctaatgaaaataacagtggtagtggtagtatagcccaggataaataaataacaatggcattgcttattaatctacctcaaggttatttttccatgtggcatgagcatcaatctacctatattttttacatggatagccaattattgagtgacctattcttttccactgataggccatgattattataaatgaaattatcatatattcatgagtagcttttaactttcattctctgtacaagtattagatgaggactaacagtgacagtgtgctactcacaggtgacaaaaagataagtcagtcaggcatactgtgtccttaagatctgcagaagaa

SEQ ID NO: 119688 - DNA, 358 bp, Homo sapiens
aggtgacccatgccgcgggagtggccaagctacccaacaggcttcacaccactcgttcatgcaaccttctgcggggctcagggtccaagcccttcctgcctatccaggccatagatggggtaccatcaacagagacacataagatcaactctagtaggcagctggtgccactccaggtttacagatggggaaactgaggaagagacagatgcagtgaaatggcccacacagccaagatagggcaacagcaccccaagaccagggtcttcctgagccagctcctccctgccagggcaagtgcatgtgacaagcacatgacatgcctacagccaccctccctggggaccacttcattcca

SEQ ID NO: 119689 - DNA, 391 bp, Homo sapiens
gagatctcactatgttgcttaggctagaaggaccttcttatcaaacttgtaagaaataaattattttaatatatcattatatcttaggaaataaacctatctgattttaaaacaatatctgaaaatacattactgtggccaagaaatgttcttggttctttggttgttttcacttgatgttgaaattaaaagaaacacagccacatggtttttgttgctcttgataggacaagagcaaatgcagatattgccaaacacttggaatttgctgaagaagttatgtaagaaaattagaaatctgcaagccagctaaaacgtgtaaaaggaaattgacaacctaggagaaactggataatgtagaatgcttaaaagatttcagaagttttggata

SEQ ID NO: 119690 - DNA, 602 bp, Homo sapiens
ggtttttctagtctgactttgctgtgatgtaatctgtctgaggttttgtctgtcttcctctgtgtgtgtgtgcgtgtgtgcgcgcgcactcgcgcatgtgtgtgtgtggtagacattgcctgatagattgcatcttacgagagatctctgagtgggaaccagaacagtactcatgccctgatagtccttttcattgagtaatttttatttatttatttaaataggagtgcagtggtgcaatcttggctcactgcaacctccgcctcctgggttcaagtgattctcatgcctcagcctccctagtagttgggactacaggcaagcaccatcacgcctgtaatcccagcgcttttggagactgaggtgggtggatcacctgaggtccggagttcaagaccagcctgatcaacatggagaaaccccgcctctactaaaaatacaaaattagctgggcgtggtggtgcatgcctgtaatcccagctactcggaaagctgaggcaggagaattgcttgaaccggggaggcagaggttgcggtgagctgagattgtgccattgcactacatgcctgggcaacaagagcgaaactcctgtctcaaaaaa

SEQ ID NO: 119691 - DNA, 603 bp, Homo sapiens
catcctgaactttttcatgcatttacagacatgtatgtttttatatttcgtggtggctttatcctcttggtgtatgtatgaccttccatgccagtttctcagcaactacaatttgtaaggaggatctgcttgcaggccatggtgtaatacttttaatgctttccttttccatcctgccgttagagatcgtcttgtgaatggacaggatagacaaaagatggcttccctttagtgttggttggaagagtcaccctgctgtttgcacagttaacagcttctatttagttattcttttctccttccaactcccacaactacggcaaacattgttcaaggcaatgctatgcaaatagcccacatccttgcccttgtcttttctctcccagttaaggcagtgtccaaaaaagtgtcccactcaccaagtagcagctttctgtatttttaagtgctgttttgagataggaggaaggctagaagaggaatagaagaaaaagaatcttgaaaaggactggcagcgttactatgactacccactacaaagttgagtatacttaacagcgagtgccatgattaagccccggatagtgcagagaatgaggtacc

SEQ ID NO: 119692 - DNA, 363 bp, Homo sapiens
cagagggcagcgccgtgtctgaattgtttaccactgcggtgacaaggcctaaagcaggcccttggctgctttgtaccaaggctgggaggcactcagtgacttgcaaaggagggaggagggaaagaaggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaac

SEQ ID NO: 119693 - DNA, 606 bp, Homo sapiens
ggattcaagcaattctcctgcctcagcctcccgagtagctgggattacaggcatgtgccaccacacccagctaatttttgtatttttagtagagacagggtttctccatgttgttcagtctggtctcgaactcctgacctcaggtgatccacccgcttcggcctcccaaagtgctgggattataggcaagagccactgcgcccggcctttggtgtggatttttaaaaagaaataagctaaataataaaatggcaatcttgaaaaatgaagacgtgtacatcaatgaaagtttggaggaacagacaccaaaatattagcaatggtcatcttcagtggttgggattatgagtgtttaatattacttccccttttttttagctgtattttctgaaacttctacaggggaaatgtgctaatttttaaaaagttatttctaaaaatgaacagggattcagtagcagaatacccgaaataagcaaaagagaaagaaactttagaccttatttatattaagtattctgttgactgtgttagttgtgatctagtcttctagtcttattgacataatcttgattctttacttccaactcttgttaattcttgatt

SEQ ID NO: 119694 - DNA, 641 bp, Homo sapiens
gctagtgaagcttatgccgtgaggtctgattctcatctctcccatctaaatgaccacggggaccccagtcaataatgtctcccattaacatggactgttgtctagctaaggggccaagacagtgggcccaaggagaggggtgagaattatcaaagggagcccattctgtataatcaatacaatttgggcgatggggccgggagtgattagtaaccacaccagtaatattaatagagctaaggcctaataggtacataatatttccatggtaactcagccatgcttgggattgaattgcaaggcaactgcagttgagtgaggtatcctgggtgacgcataaaggaagttcctccaatggagtggtataattgataccattgttctgagagtctaattgctctgtgtcaggggagattaggggtcctggtgcctatgctccttgatcatgatatatctcaggaggagtgtcgttccagagtatggtcacactaccagtgggttaggaacatatgcccaatatgtttttgcctctgcacagggaaaacatacctcacaggatattacagctagcatggccataaacatggagtctggggtttttgcctgaccctggcgctccagcagtttttcaacttcctgtg

SEQ ID NO: 119695 - DNA, 334 bp, Homo sapiens
ttttgttcttcctctttcacttccctacttctttttttttcttccttgccaaccatccttatttactcacctggcaagtttagttaactcttatcttcattggtgctgaaataagggtactctactgaaatgtgctgtttagggactttctaaattgttgcttttcacttatttaaatttattttttattgtttaaattctttcacataatatttatcccaaagaatttgcatttagaaagagccaaaaacagagtgtgagaagttctcagagatataagcagtagctgttaagctacagttgtaatgggggagacgcagcaagctccctctac

SEQ ID NO: 119696 - DNA, 226 bp, Homo sapiens
  misc_feature (1)..(1): n is a, c, g, or t
  misc_feature (12)..(12): n is a, c, g, or t
natatcagctcngtaccagtgctactccacaaacaggtggtcagggaagggccccacggaagagccatgtgaactaaaaatgctgaaatcgggcacggcaaaaccaagagagtgcatggatggctgaggcaggggtaagagcaagtgcaaaggcccaggtgtgaggaagagattagcacgttcagcaaaaacaacaaagggccagtgagcttagggagtagcagat

SEQ ID NO: 119697 - DNA, 178 bp, Homo sapiens
gcaaagaaagcaacttccacatctcagagggagacacagcatttttttattccataactcaaagtttaggagcagaagagactgattattaccctggagatccatttcacttcgatgagagtccatttcattctctttttctttggataaacaaccaccagtgtatcttccattcaga

SEQ ID NO: 119698 - DNA, 226 bp, Homo sapiens
tgctcttggtcctggctttcttggggttggtattatggtgatcaggtgctactacatgtcagatacaagaagttacaaggtttccttgatttcatagttgatgattttaaaagtgaaactgtcttgattgtattagtagaacctcttaggaacacaatggaatggcccaggcttctggccctatgcctctagggactctcagttaaactgtgtccctactgatttt

SEQ ID NO: 119699 - DNA, 178 bp, Homo sapiens
cacaggttcttgcccatctggaacacacaccctcctccccctccccttgctgaaataactactgctttcctcggagtctcaggtcaggcattgtccccccaggaggctcccccacccagtccttgaggtgactcttaccatgccccttgtcacctcagttactgcggactgtccatgt

SEQ ID NO: 119700 - DNA, 935 bp, Homo sapiens
tattcactaaatgtacacagtggtcaccattatatgaatcagtattccaatttattaattcacaacaagaaatataacttaagaagactctacatttaggctatctaactgatacatttattctctgaatgcaaactctttgggatgccaaattataagcagcatcagaccaaagttatatgttataggtatttagtggcattagatattgacatcaagatgcagtatctccatgttagagacatacctattaccagaatgtaacaggtttaatctttgggtcaaaaaaacttctatccttgccttctgatattagttctggccttctttctctagttctaaaatacttagtataatgatctccaggctgttccatctcttaaagatgatcttgtatatatctctgttttgatatatgtctcttttctttaagggaaggcagccttgttcccaggatcttggagagacccccaaaatcaccattaccttgtttactgatatatttttgtatattgaatcaatagacattaaatctgatgctcaaaatgagaccatctgtaactgacagggaaaggagggaaggatgagatagttatctatgataacttgaaggatgagtgatggggaaaatttctccattattgtgagtctgtgactactcaagagtttttgttggtgtagctttctggaagcataatgacatttggggctattgagtgtcccaaggcagtaactggggaagggtctctagtacattaaatgctatcaggatggctttaggagtccgtgctctcttaaatagaaaggagactacattctgggtgtggtggctcacacctgtaatcccagtactgcttgaggccaggaatttgagaccagcctgagcaacatagtgagactctacctgtataaaaaaaattttttttaaagaaaag

SEQ ID NO: 119701 - DNA, 827 bp, Homo sapiens
aacaaaaataagcaatggggaaaggactccatattcaataaatggtgctggaatacctggccagccatacacagaagactgaaacaggaccccttccttataccatatgcaaaaaaacaattcaagatggattaaagacttgaatgttgttaaaaacttaagccaaattaaattttaaggagtttaattgagcaatgaatgatatgcaagtcgggcagcccccagaatcacagcagattcagagagactccagggatgcctcgtggtcagaacaaatttatagaccaaaaaaggggaagtgacgtacagaaatcagaaatgaagtacagaaacaactggattggttacagctcatcattttccttatgtgaacacttagcagtgtatgagtggttgaagtatggctgctgggattggccaagactgagctattgttacagatgcatactcctaagttaagttctcaatcttgtctacatattaagttaggtggcagttcatctacaaggactcaaatattgaagtatggagttcttctcaggtcacatttagcctgttttaacaatgtaaaacctaaagctgtaaaaactctggaagataagctaggaaattccattgtggacataatcgctggcaaagattttatgataaagatgccaaaagcaattacaacaaaaacaaaaattgacaaatgggacctacttaaactaaagagcttctgaacagcaaaagaaactatcaacagagaaaacaacctacagaatagaagaaaatatttgtaagctctacatccaacaaaggcctaatattcagaatctataagaaat

SEQ ID NO: 119702 - DNA, 617 bp, Homo sapiens
attgtgacatatcactgggcctcaaactaaggtgaagttacactttcattttcgaactgtactcagaaggcatcgtgacatattcctgggcccagcaccaaggtgatgtgagtctcctgcctgcactttgcccacaaatggcattgtaacatatctttagacctatcaactacttgatatgacttatttttttaaagtgaaagcaagtttattagagaagtaaataaacaaaagaatggctactccatagacagagaagacctcagggctgctcattggctcttttcatggttatttcttgagtacatactaaacaagggatggattatttgtgagttttccagggaaaggatgggcaatttccagaactcagggtgccttccctttttagaccatataggataccttcctaacattgccatgacatttgtaaagtgtcatggtgctgttgggagtgtcttttagcatactgatgcattacatttagtgtataatgagcagtgaggactaacagaggtcactttcattgcagtttttctttcggtgggtttttgctgtcttttgtcctgcatcctcttttatcagcaaggtgtttgtgaatggtaccttgtggtgac

SEQ ID NO: 119703 - DNA, 375 bp, Homo sapiens
actggtgatgaaataaaagctgcaaggattttttcacataaactctgtgaaaacatttcctcatatgtctgtgcagtcaatgttaagtgctataaatccatctagtgtgcactttgattttagcatttatcattctagttcatatatttaataatctccttcttccatatgtatacatagtaggaagagatcctgaaggacaggccaaagttcattaaaaaagtattcctagtgcttactaccatgtctattcagtaaataaataaagagataaacatatttcttaaagatttttggtagattttgttaagacctcctcccattaaattttattctatggttcaaatcttttgaaataaatttatgttctatttt

SEQ ID NO: 119704 - DNA, 696 bp, Homo sapiens
atccttcctgagacttttttgggcttcaagaaaattagttttaatagaaatttgtggccgggcgcggtggctcacgcctctaatcccaacactttgggaggccaatgtggatggatagcctcagttcaggagtttgagaccagcctgacaaacgtggaggtttccatgtctactaaaaatacaaaattagccaggcgtggtggcagaggcctgtaatcccagctactcaggaggatgaggcaggagaatcgcttgaacccaggagacagagattgcagtgagccaagatggtgtcattgcactccagcccaggcaacaagagcaaaactttgtctcaaaaaaaaaaaaaagaaaagaaaagaaattagtccagcctgggtaacgtggcaaactttgtcaatacaaaaacatacctggtcatggtgatgtgtacctgtagtcccagctactcaggaggctgaggtagaaggatctgttgagcctaggagtttgaggctgcagtgagctatgattgcaccaccacactccagcctgggcaacagaatgagcctgagaccctgtttcagaaaaaaaaagggaagaaaagaaaaaagaaaaaaatgagtttcaatagagtatgttgtcttttaaaaattacattcaacaggttgtggctgataattgaaattcactgagatttatttttgtataaagtgt

SEQ ID NO: 119705 - DNA, 401 bp, Homo sapiens
caagctctctggtatctcttcttatgagtacagtaatctcatcagatcttggccccagacttattaccttacttaactttaattacttccttagaggtcccagaccatctgtaaatataggcatactggtggttaggatttcaacatatgaattttagattccatccataacagtgtgcttggtacctaaattttagattttcatatttactattcatatcaacacatgagttttatatctttaactctaaagaaaaaaagttctgtttatatactatggtacaatatggcagtttttaaaaagttaaacataagcttatcctatgacccaacaattccactcctaggaatcaacacaactcaaatattcatagcagcattattcagaataaccccacacc

SEQ ID NO: 119706 - DNA, 202 bp, Homo sapiens
tgactctcatttgctgtaacataattcaacttcttttagctattcacatagataaccagttgagacccataatacatgactaacctcttctcttatctccctggaccaattatatttctgtctcaggcatgtagcctctctcttaaatctcagccaaaggccccttcactcctatacttctcctactgagcagggtagaaaa

SEQ ID NO: 119707 - DNA, 345 bp, Homo sapiens
gctgtctgaatcaatgacttaattatgttcacaacagatttgatgctaaccaaacattatactgtaatactttgaaaaactggaaccccacatatataaccattctttgaaacggatcacttgctcaaccaggatacccaggtgacttcctgaatgcgccatgaacagtcaactgtgcaaaaggaaaaatatctaatgcagtcaagagctgccatgagcaaaatgtttttttttcttctttttttttcttgagacggagtctcactctgttgcccaggctggagtgcagtggcacgatctcggctcactgcagcctctgcctcccacgttcaagtgattctcctg

SEQ ID NO: 119708 - DNA, 807 bp, Homo sapiens
attaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagt

SEQ ID NO: 119709 - DNA, 618 bp, Homo sapiens
agtgggctgagtgagtggagtttgcccctgccagcacccgtgcactccagttcccacctgtgaaggtgtcagagagatattctgcttaaaaatcagagtgactccatcttaaatagcagctgggtgagataaggctgagacctactgggctgcattcccaggaggttaggcattctaaccttctatcaggatgagatagaaggccagcataagatataggtcacgaagactctgctgataaaacaggatgtggtttaaataaatgccagccagaacccaccaaaaccaagatggtgatgctcattctcactgctcattatatgccagtataatgcatttgcatgcaaaaagactctaccaccagtgccatgacagcttacagatgccatggcaagatctggaagttaccctgtagcctctaaaatggggaagaaccctcagttctggaaaatttctgccccttcctgaaaaactcatgaataatctaccctttgtttagcatataatcaagaaacaactataagtatagtcaatcgagcagccaatctcaccgctctgtctatggagtagtcattcttttctttacatctctaataaaattgctttcactttactgta

SEQ ID NO: 119710 - DNA, 367 bp, Homo sapiens
aacttcaagcgatacttttctgtttcctcagcacctacagcctttaatgccttgttcacaaatcaaggtcttgtgcatattcatttagcactttctattatattttctttttccattttgtaacttcatgtcaaaatgacccacaatagaatagtcatttctagtcaatattgctaatcatttcatgttacactttcctgtctccccttatgatgcattttttagggttaacttttagcatttgattagtcaaatacttgcaaatgaaatactgtattttcatagcattttactgtttcgaaaggtctttcatacatcttctttccctaataaccataccaaacccaaataactattgtttacttta

SEQ ID NO: 119711 - DNA, 168 bp, Homo sapiens
ttgaagcattccttggagatattgtgggtttggttccagactgttggaataaagcgagtcacacaaatttgttggtttcctggtgcatataaaatttaggtttacactatactgtagtctaaatgtgaatagcattacatcttttaaaaaacctatatatcttaattt

SEQ ID NO: 119712 - DNA, 285 bp, Homo sapiens
ccagagttgtcataaaattaaagtacagatgggctcagcaccgttcttagcacatggtgcaccctcaataaatgtgagctattatcagtccttgtcagcactttttgctaatatttaatgccttaatcattcactgacagatatcactttctgccatcataagagaggctgagaacagatggtatttggcatattccttttgcttaaaaaccaagaatatacttatttgacctttcagcctcttttttctagattagatattcctggaatctaagatatgagtga

SEQ ID NO: 119713 - DNA, 807 bp, Homo sapiens
tgagaaatctatcgatggttctacgagatactcttctcacgtcgtacatactcgagtcttaatgatacgttggagttgctgtggggtcatataatttgaaatgtcatagatactaattgtgataaaaactgcagagattttcttttttttcttcaagagcagaaatccgcttttatttattgacttttcgttagtttaaatccttgaggggtacagcatcactcagattttgtgtccaatggtctcagcaggaagattgctttgaaatttggcacgaaccatgccactgtttccatgggcccagattactctggctttgtttagtttgccgccaggagtctctgtgttgttctttgttttatgtacataagcacatctcttgcccaaagagaattctgtttcacctcatgcgtcaacatcttcaattttaacaagagctgtgtgtttcctttggttctggagaccctgcttttagccagcagaaaaggccttgggccacagccttccagacatacttccttttagaagtcctattcccagcaggctgcagttatttgcccccaaatttcagcagcagctgcttcactccagagattttattaatgaaaacctaggctataacataaacctatgctataacaaacctatgctaatgaaaacctaggctataacattagagatgatgttaaaaatatggaattataactaggtactctaactctattactgcactaatataatccaaatattcgtaaaccaagcaggaaattaaaagattagcaccacccattttgctgtgctaattag

SEQ ID NO: 119714 - DNA, 877 bp, Homo sapiens
atgtatatgatcgatgctatacgatcctctaagataggagaccatttaacagattgcatttgagactcatatcgaatactctcttatttgtctctccctttattctgtatcttgtaaaatcaatttgctgacttgtatgcagtgtttccggggggtcatattattacgtctgtcgtgaataaaaccttgcttaacgaactgcagagattttcttttttttcttcaagagcagaaatccgcttttatttattgacttttcgttagtttaaatccttgaggggtacagcatcactcagattttgtgtccaatggtctcagcaggaagattgctttgaaatttggcacgaaccatgccactgtttccatgggcccagattactctggctttgtttagtttgccgccaggagtctctgtgttgttctttgttttatgtacataagcacatctcttgcccaaagagaattctgtttcacctcatgcgtcaacatcttcaattttaacaagagctgtgtgtttcctttggttctggagaccctgcttttagccagcagaaaaggccttgggccacagccttccagacatacttccttttagaagtcctattcccagcaggctgcagttatttgcccccaaatttcagcagcagctgcttcactccagagattttattaatgaaaacctaggctataacataaacctatgctataacaaacctatgctaatgaaaacctaggctataacattagagatgatgttaaaaatatggaattataactaggtactctaactctattactgcactaatataatccaaatattcgtaaaccaagcaggaaattaaaagattagcaccacccattttgctgtgctaattag

SEQ ID NO: 119715 - DNA, 705 bp, Homo sapiens
ccctgcctgtttccaaaagctggccgcaatatcaaattcatgtccctggacaaggctccagtaaggcactgcctgcagtgtgcagagagcacttaggtggttgcagagcaggcagagacgaatgtggggagtggaagtcaccatatctgcccactcggcaggaggccgtccattcctgagacgcccccgggaggcaggctcctgtacggcactcatgctgggtacccaacccctacaacccaggcaaacccctaccctgggcagagaagggcctggacacaccaggggcagaaggagaaaggggatggagacaaacctgggtgggggtgacctgggggcagctggggtggggtgacacggggaccattggggtggggacacactccgggagggggagacacggggcagcaggggtgggggcacacctggagtggggtgacatgggggcccctggggtggggacacactcggggagggggtgacacagggaccactggggtggggacacactccgggagggggtgatacggggcagcggtgtagggaaaagagagatcagactgtcactgtgtctatgtagaaagggaagacatgagactccgttttgaaaaagacctgtactttaaataattgctttgctgagatgatgttaatgtgtagctttgccccagccactttgccccaacctggagctcacaaaaacat

SEQ ID NO: 119716 - DNA, 490 bp, Homo sapiens
cctcccgagtagctgggattacacgcacccaccatcgtgcccgggtaatttttgtagagatggagttccaccatgttggccaggctggtcttgaactcctggcctcaggtgatccgccccccgctcagcctcccacagtgctgggattacaggcgtgagccaccgcacccggtgtaagttgaatttcctatgaccagataagtttgtgaatgaaagtagccagcattggttgctgttatggcagaagtgagtttcacttcaccatcaacatgttctttctgcttttttgtggtgctgtaatgcggtgtgagcacttagacaagagccaaaatagtgtgaacttggccacttaattctctgaaaagaaagtttggtccatacattgagaagctagttttagggttcacgtggcgaggctaggacactggcgaggctaggacactggcgaggctaggacactggcgaggctaggacactggcgaggctagga

SEQ ID NO: 119717 - DNA, 197 bp, Homo sapiens
ggtcttgaactcctgacctcgtgatccgcccgcctcagcttcccaaagtgctgggattacaggtgtgagccaccgcgcccggctgagaagactttctggataaagttgatgtttgagctgctcagcgatgagtaaatgttagccaaggttgttagggagggaagattatgggaaactatttcagagagagggaaaat

SEQ ID NO: 119718 - DNA, 466 bp, Homo sapiens
gggatcatttccatcaacatacaaaatacatctcctatcttaaaactctctctcaaaccttccagcagctgtcccatttctctattcccattacagcaaacctcctcaaagctgtctatactcactgtctccaatttatttcctctcactctctctcttttttttcagagtttagctcttgttgcctaggctggagtgcaatggtgcgatctcagctcactgcaacctccgcctcctgaattcaagcaattctcctgcctcggcctcccaagtagctgggattacaggcgtccgccaccacgcctggctaattttttgtatttttagtagagatggggtttcaccatgttggccaggctggtcttgaactcctgacctcaagtgatccacctgcctcggcctcccaaagtgctaggattacaggcgggagccaccaaaaaaaagtctgcaacctctacctcctggg

SEQ ID NO: 119719 - DNA, 464 bp, Homo sapiens
gctgccgcctactactactaaattcgcggccgctcgaccaggtgtggtggtgcacacctggctaagttttttgtatttttagtagagaaggggtttcaccacattggtcaggctggtctcgaactcctgaccttgtgatccacccacctcagcctcccaaagtgctgggactacagatgtgagccacggcgcctggccttatataggttcttaacaaaataaatgtctacttcactgcaagagctttcctttttatttaaaagtaaataagtccttacaatatgccacacatgtgcaaagagacaggaaatactctctctcagaagattctctaaaagtgaatttaggccatataaaccatttctgctctaaagaaaaatcattaacagtcatgtgttttgcctgttaaaaccatgtgtcactgaaagttaagctatttaaagtagctaacaaaaagcacaaag

SEQ ID NO: 119720 - DNA, 422 bp, Homo sapiens
catggggtacagggtaaagtaagatagtagatataatcaggagcttctagctgaactggagtcacctttaatgccaggcacatgaacttgacttcattttataggcatcaagaaagagcatctttgaatgttgctgaagatgaaaaatatcttgggcatggtagtagggaggtgggagggaggtttactgttccttaaatgaggcttatcccttcctgcttccatgcggctgatcaccattgtgatgaggaaagagatgattttgagccagatctgggtttgagacctagatttaccttgggcaaatttcttaaactggttaaaggctttgagagatacaccctttcctagggtcatctgttgtgaggttgtgaggtacagatgagaatttatgtgtaagtacttatcatggtggtatctgt

SEQ ID NO: 119721 - DNA, 518 bp, Homo sapiens
taaataacgccgcaaatcatgtcattaggagttcaggcagaaagcggtggacgtgtccccaaagcagtttgagcgcttaagatccctactacgttcaaggtagcatttgccaaatgatatatatttgggtgagcccgaaaagccggatctgaacaaataacaccaggcagaacgaccgctcttccagttgatgggacaggagcaggtggatttgtccttcaaagaatatcgttttattcttagccaaatgctctcaccaacagctgggttttaaaccttctcgcagttttccccaacgccccagtttcagactgcgagggagggagcaggacttcaggctcctctcggccagtgcagacaagcgaaagagaaagagggaggggcccacggccccgaggggcgtgggaggcagttcgggccagctcggccgcgcatccgtcccttcccgtgcggtaccacctgcggaccactctcctagcccgagcttcagggcctacagagctgcggggcgcggccgc

SEQ ID NO: 119722 - DNA, 652 bp, Homo sapiens
gtcagactcagaaggctcaaagacactccaagagtgagccgtgtgccaggctgcggacttgcggggaggtgtcacaggacaggggtgggggagtgagcatttcatggaacttcccctttagcccagcagcagtagggggcgtggaggaccccagggaggagcctaggtcggggtcttgggctaggccctgcgttctgcagtgggagaagggggagacctctctcagtctcctgaagtcctagggggctgtggggggttcttgaggctctgaaatgtctggtgatgtctgagtgtggctgtggttcaaggatttacagggtcgaggattttagtgtgtggggggggattgttcagggacataatgttttgtagatttggggccaagggcatcttgtcttggggtctcagcccccatgtaccctcagccctccaggccctggccacccccagagggataagaagggaggttcagtgtcactccggaggcctggctggcacaggtgaactcaggcaacacgttccctggcccaggcctcagtttccccatgtatacaaggacaggactgaccttggatcccccaaacccctgcctgatgggggcctggggagctgagacatctgaaactacacagggaggtgggacttagttcct

SEQ ID NO: 119723 - DNA, 447 bp, Homo sapiens
gggattacaggcgtgagccaccatgcctagctatcttattttctataacttattttaatatattagcccaccaatcagtaacaattaacaaatatttatttagcatcaagtattagatcagctttttccatatctccttcctactctctgacacatgcctcagttcttcacttgtggtttggtctcactcttcttcatgtgtgtcatgcttatcccaaatccatttaggattataaaattctccctattctttctctgacctaacagtccatggctttaccacagtttgtagtgcagcatatggttttgggtttttaagtaatgggttttctccttttttctttctttctccttccttcttttcttcctcccttcctcccttccttcctcttttcttttcttttttcctccgtccctcctccctctctccctctttctcctcccctc

SEQ ID NO: 119724 - DNA, 132 bp, Homo sapiens
ccttcctgcttcccatcaaaattcatatcctgtcactgttctaggagcagaaaggcttctcattatagcatcattcccctcttgcaaaaaacactgattgctgcactggtggctttggaaggcaaagatgta

SEQ ID NO: 119725 - DNA, 393 bp, Homo sapiens
acatgttcagctatccagtagctctttgtaccccatcctcttgagccttttatggagatttcaatggataggcatgactgaagcatggacaatcattttggaaatgtgattggacaaaaaagatatgatctgatactaacagactgagtggggaaacccagcaaggcctgtctgctcagattcttcttggcttctctgttcagcattccttccaggatatagggcaagacccattctgaaacaggggtcttatgacctacagctagacaagataggtcagagaaaggcagggatgattagagttctgctttggagagaaggagcaggtgaaaggaggagaggaggaagtcagaaatagattctgttttctgaggcctaaagcaccctaacata

SEQ ID NO: 119726 - DNA, 801 bp, Homo sapiens
gatctctccactgcactccagcctggtgacagagtgagaccccatctcaaaaaaaaaaaaaaattcctcatgagagagttaaagttcgtcttattctcacactgagattttggaatgagctgtgtattttacacgtgccaaagtctctaatcagagccctatttcaggtgctcagtagcttctgtggtcaaccttcaactccacgggacaatgctgttccaatggcctccccagcagaagacaggcagggaacaaggctgaccccagagggccaggccacagcaggggctgaggatgcctggtgaatggatgcctgggagaaaggatgccagaattcgtgctcgaggacatgatgaaacagggaaagactcaatagaataaagaaggaaggggacgggtgcggtggctcacgcctgtaattccagcactttgggaggctgaggcgggcggatcacgaggtcgggagttcgagaccagcctggccaatacggtgaaaccctgtcgctactaaaaatacaacatttagatgggcatggtgtcacgagcctgtagtcccacctacttgggaagctgaggtaggaaaatcccttgaacctgggagacagaggttgcagtgagacgagattgtgccattgcactcgagcctggctacagagtgagactctgtctcagaaaaaaataaaaattaaaaataaagaaggaaggagaaggatggaagcgaatctcaatgaacaaaatgcactgggacctactatgtacccagaaaaatgaaaagtaaataaataaaataaggacttgcat

SEQ ID NO: 119727 - DNA, 679 bp, Homo sapiens
ttctcaggtcttttttgttcttcagtgagggtctggagtaaactagctcaaagtaattcattttcagagtgaaggaaggaggtcctttctttgatgatgaagaaatcattacagatttagaaatatttgtatttcatgtgtctgtatctcccactttttagtgagtaatgccagaaaatatctagtattcagacataacgttgtgtttgtaggtaaagtttgtcttctactttgtagtagatgaagtagttattggtcagtaatatgtaggtagttgtgttacatatgagtctggattaaatcttttacaatcccttttgttactgtaatgtagcactgccatatgctgctatgtagattgtgtaaccctaacactatcttttaatttttcatgtaatataattggtctttatgcttaatttttcctcacattggactacaagaagtcctcatttaaatataatttatttgaagaacatatgagtaattttggaacacaagatgaatttattttagagaaatagtgatgcagtagcctgctatttcagctcgattgtggtttctttgggctttaaatcagctagccttgaaacctcattattgtgtagtccaaataaagttggacctgcttgctttctcactgggcgcccatctcattattgtatatgatctaagataa

SEQ ID NO: 119728 - DNA, 376 bp, Homo sapiens
ccaggcaatgtgttttaaaaatatatgttcttctttgtggctatacacaacataaagccaggcttccctgttgaaaatctttctggggtcagttttaataaatagatgagaaggtttcctgttcagagtggattgcaggagctatggtgagagctcctttcgaagtccccgaggagtttgttttctgaagcagtttaaaggaagccctccgtattcctgtttgtaatcagtattgcgctttatggcttaaaatgcacactgatgttcgaggattgccaggctccaaaacagaagcttctctgttttgatccagagccttaagaagtaaaaggcgttctctgccctggctgtcccaaaaggttccctcagcgtcctc

SEQ ID NO: 119729 - DNA, 400 bp, Homo sapiens
gaactgaatttttaattttaataaatttaaatttgcatagttaatatatggctaatagtaaccatatgggagcgtgtagctgcagaacatttattcaccctaccacccattagagacttttcagccatttccattttttgtgataataaaccccatcgggatgactgtcttcatgtagaaatgcctgacgcatgccctgtcattttcttaaattagattcttagaattggaattactggggcaaagagtaccaattcatttgtgggtttggtacacattccaaaaacattttctaaaaagtctgtgccaatttataacatttaaaactgttactaggctaagatttccaaatgggttaagaggcttaaggtaatcaatgaaccacaccccaaaatatgta

SEQ ID NO: 119730 - DNA, 108 bp, Homo sapiens
ttattaaagacctagttaaaatacattcttgaaagcaaaagaaaaaaaagttgtgggggaggttcaaaatgacctgttcccgtcagtctcctctggaaatgtactggg

SEQ ID NO: 119731 - DNA, 509 bp, Homo sapiens
gcacgaggatttactctttgtgtgtcacttcttcactctcaaatttagagatttatccatgttgttctgtagttgtagatcatttattctcattgttagtatttcattacgtgaatgtaccaaaatgtgttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaaccctcaccatccgtgtatgagggttccggttgctccacattctcaccaacacttgcttctttcagtcttgttagccaatctagtgagttgataatatctttgtaagcgcaaattagtgctatttttctatccaataaaatttgtgaagcctcataccca

SEQ ID NO: 119732 - DNA, 478 bp, Homo sapiens
tatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaataaataattgccttgtgctgtgtaccttggagcagggccttacatagtgaatatatcaatagttgttcacaaaaagagcaatataccacttagaagctacagaacttaaaaatggctacttatactccatagaagatatagtaaataatagaagaaaaaaatgaaatggctaaagacattttgttttacaatggggctgtttttacatgttaattaaaattctatgtttaaacaaatctcttg

SEQ ID NO: 119733 - DNA, 363 bp, Homo sapiens
gagattagagcaacttagctcacaatcaaatctggtggagctttttcccatttactgaggtaactcaagaatgctgtttggtggtttctaataaaattaaacatacgcttattctgcaaggcttgtatgagaatgtgtgtagcaactttataattgtcccaaactggaacaaaccaaatgttcagtaggattatgaataaacaaattgtggcttatttatgtatttgcacattggagtaatactacacaataaggttaaagaattaagtattgatacatataacaacctagatttatctttaaaaattgagcaaaagaagggagacacaaaagatgtacaatagtgtttactgctgcaggttt

SEQ ID NO: 119734 - DNA, 347 bp, Homo sapiens
tgagacggaattttgctcttgttgcccaggctggactgcaatggcgcaatctcgggtcaccacaacctccgcctcccgggttcaagtgattctcctgcctcagcctcccgagtagctgggattacaggcatgcaccatcatgcccaactaatttttgtatttttagtacagacggggtttctccatgttggtcaggctggtctcaaactcccgacctcaggtaatccacctgcctcggccttccaaagtgctgggattacaggtgtgagccacctctcccagcctgtgattttttttgatgaatgtgttctagacatggatctgtgtcagcacctacagactggcct

SEQ ID NO: 119735 - DNA, 250 bp, Homo sapiens
acaatgtgcaaagtgggggtatgcatgcttatgattgccagtatagctactgaggctactcacactattttaattataaacttaagaatttactacaaaattatattacaaagtcacacaagcttctgtctacttagataaacaaagcagttacagatgagagatcagcaaccatggttatataaattttattttttgagacacagtctcgctctgttgcccaggctagagtgcagtggtgggatctcac

SEQ ID NO: 119736 - DNA, 235 bp, Homo sapiens
agtctcaagttcacttctatcccaggtcagtggtgcccgaatgctgccttttcctgtttggcaggctatgtgatgtgattgttagaccagctcctagtgcagagctgtctacatcagagaatggcacttctattgacagtctcagcagtgaggctgaatggtcctagaaatccaactacctgcagactatcggagttggtcccttaggtcagggttcaaaggatgttgtggaaca

SEQ ID NO: 119737 - DNA, 209 bp, Homo sapiens
accatggggtgcagtgactgaagaaagcctgcctaaatgatcagagcaggaaggattgggttgggattcttaggattgaaaaggttttaaagccctggaggctctggggtttgctttcttaagattttttctaccacaattcagtttttatttttttagacctagtctcgcactgtcgcccaggctggagtgcagtggtgcaatctcgg

SEQ ID NO: 119738 - DNA, 229 bp, Homo sapiens
ttctactaatttctctcactttctcccaggacaggtagtgaattagaacacagacactggagcccaattgccggggaccagacttcagctctgccatttactgtgggatgacctcgagcaaattttttcacatcttagtgttgttggggttttctcatcagaagtatgagggtataatagtcttcaccttatagaattgttgtgtgtataagttaataaatatctagat

SEQ ID NO: 119739 - DNA, 814 bp, Homo sapiens
gaatagtcaagttcagatagtcatctggggtcaccaatcatttgatattcacttggcccttaaatcacaataccacaatacatttgagttttaactaagacaaacatttcagggtaaccttcaagtaggaactctttgaacagtgttctctaagtgaaaactataatttacctgagagcccttaataattgaggagaagaaagtgacttttaaagtttgggattatctaattttcaggttttcaaattgtttatttttcaatccttagcactaaggtagtagcttaaactatgacagcactgaaaaatttatgttgatgcttattaaatttagatattttcaaaaagttgcaaagcagctctctttgtttaggttatatttcctttattgcatgtttctttttagggttatgttttccttttacagtcttcactgctgcttttattcaacaaatatttgggtaagactatgtgccaaacatattcatagttacagaatgatcttatcttttgccctagtaattaggtttctttccttatcaagtgtaacactaattaaatgtgttatgagctgctttccctttcttatatcttgttttgtaaataatggttttgtttaaatgtgttatttagttatttaacctattttgtgtggtttgacagtttttagcatatataaattaatgtcccggctgtaagtgggatcaaactatctagatctgtgaactggtacgttctaattctagtgctttatacattgcaacattaaaaaatcagatattcattttttctttttcccatgttttactgattct

SEQ ID NO: 119740 - DNA, 111 bp, Homo sapiens
agtaaacatggagtagttatactacaaaacaaatcagatgacctccctcactgggtattatctgccatgaagtgcctagcaaattggccaagaagcaatgatatgaataat

SEQ ID NO: 119741 - DNA, 708 bp, Homo sapiens
tagtatacgttggaacactgctgtaactttgtgctatggaacatggctgtagaaactgcttatcaataacagctgtagcactgtggcttttctccatggactcatggtggtctttggaacaacgttcttcaactttgacagcttcatagggaaaacagattctatagaaataattggaaaatcagtttttccctattgttatcacaatatccttccactgctgaatgattctggcaggttaatgctccaaatggaatgacaatgatatttcaaaatagagattttgatagtacgagtagtaataatgtacaaggtattttttgacgctaatgactaggaaaagtttatggatacaattatttaggcaaacttctaaatgggatatttgactacgttatacaaaagatcattgggtaaaagcaatctgattaagtttttattaactttgtaaatgcttttgaagatactgttatataaaaagtaatcctaaatttttgttgcagtagttttgactttaacaagtatgtaaggccttcattgttttcctttttctgttttctgctcttctttcttttatactattttatttttatattctggatgtgaaattttttttaaaccgtttcataattatctgcaattttataattttgtaaacgttccaaggaaggtatcatcattattaaaagattcttatgacagataatg

SEQ ID NO: 119742 - DNA, 386 bp, Homo sapiens
tcacaccccaagctcccaattctgtccgccaagcactgcccatgcattgctcacgagaaacgcctctggacggtgctgcttctctccagcctcgacctcctgcctttcctgctttgccccacctggcctctcctgcctggatgacagcatggctcctgggaggcccccacctccagcgtcaacgctttgcaatcttcttcatgtagcagtgagggcacgctttcaaacgggccagtggacctggtcactcccctgctgaatgtcccccaagtgctcttctgccatcctgcctctgctgaagagcccctccatcgtgtggccatgttgcccctgcagcctccctgccaccctgctcccgaccacgccgctggctctgcatccctcat

SEQ ID NO: 119743 - DNA, 284 bp, Homo sapiens
cgtattcttaaccactattctccattaccttcgattccagcacaaagaaaaaccatttacctgccaaagaaaatgcaattctaggaactcacttgttggctacagttggatttgcttgtattactagtatactttaaagcagagtaagggatcatttaaaccaaactgcctggtttgccccaagagaggtttttattcagttcatttagacagagtattacagccaccacacagattctaatacaacctgtgtggtggcatcgataaacaccgggtaccgagct

SEQ ID NO: 119744 - DNA, 619 bp, Homo sapiens
tagaaagtgaagctttattatcacaaccataagagactgccaccatgaagagtttgtgttaagatccttacagacattgttgttttatgtataaaaacatgaaaaaccaaaacatatcatgcaaacatgtttcaagtataccctcttgatgaagtaaatgtctacaaaaggtatccctctccctgtagccctccaaccctttgaatgtacttgttctgacacactcaaatattatcattaagttcatttaccagaggcaaataggtaacttgataaagtcggtgggccgagatgtcttttgcctcatctaagagcacttctttgttttattggtcactaatgcgtgacacacatttctaggtaatgcatgttaatctccagctgtttaatcacaaattgccatttctcagaccttgctcatggtggctgtacactgtacagccatatatggaagcccttttacctctcactgcttttttctagaacaaactttgccctagtcataatgaaataagaaaagtcaaggggccttgtttatagagacagctgcattagcagagatttttgctgtgggtgtctgccaagtggtaaagttaaaatcttactgcttgcaaagaat

SEQ ID NO: 119745 - DNA, 357 bp, Homo sapiens
ctggcgtgaaactagcctctggtaaacatacaaaactgtatcttgccctcagttatagatacttttaccaatgcagaaagttggcatggagctagaaatgtctaaagcttggccatgagcctacaaaatattataccagaaacatatttttgaaaccagtggttattattcttagtttaaaattatctattttaaggaaaattgatttttaatttgttagatagttactgtgaaatgctcttctgtgtcggcataaagcttggtgagcaataattttgcttctctcttgcagctattctgtactgtctttttaagtcctcctccaacatatagagttcaaggtctcagtatttctca

SEQ ID NO: 119746 - DNA, 623 bp, Homo sapiens
ccccttctttttgtttgtcctgtcagtgaggtttggaagaatacaagccttccacattttagatctgtctcattgtttttaatgatttgttttaggttaaacattttgacaaggattcttaattttaaggtgaagttgtgtacattttagcacaccagtgataaagtgaaaaagtgagttatagcacagatctaaaaataccttaaatgctttattttaatgtaaaacgtaaatgtacattgccattagtgtgaacataatgtcaagttctccccttgtgtagaaaagtttgatcacatgtgccatgctgtgcgctgcacccactaacgtgtcatctagcattaggtatatactaacctgcacaatgtgcacatgtaccctaaaacttaaagtataattaaaaaaaaaaattaaaaaaaaaaaaaaaaagaaaaaaaagaaaataattagggagcttcctgatagcttaacacatggagtttcctggagagtggcccactcaggaaggcttggaagctcccagcaccttccccactaccttgccctacacatctcttcatctgtatcctttgcaatatcctttataataaacaagtaaacttaattttcaaagaaaaaaaaaa

SEQ ID NO: 119747 - DNA, 451 bp, Homo sapiens
ccccttctttttgtttgtcctgtcagtgaggtttggaagaatacaagccttccacattttagatctgtctcattgtttttaatgatttgttttaggttaaacattttgacaaggattcttaattttaaggtgaagttgtgtacattttagcacaccagtgataaagtgaaaaagtatatactaacctgcacaatgtgcacatgtaccctaaaacttaaagtataattaaaaaaaaaaattaaaaaaaaaaaaaaaaagaaaaaaaagaaaataattagggagcttcctgatagcttaacacatggagtttcctggagagtggcccactcaggaaggcttggaagctcccagcaccttccccactaccttgccctacacatctcttcatctgtatcctttgcaatatcctttataataaacaagtaaacttaattttcaaagaaaaaaaaaa

SEQ ID NO: 119748 - DNA, 357 bp, Homo sapiens
ctccggcgaggcgaaccttgggaaagttatcttcccaataaaagagtgcactttggtttctcgtgttggtctgccatcagtaacccctcctttcagacctcatttacccgttcctgcttccaccccggccagagaaagaaggcattcccagggttcgaaaggcaaggcaaaaatctgtacagcaagacactaccacttttgcactcccgacccagtctgaaacgatccctagtttccccatattcttctgacacatagatccctcaactttggctactggagctttgggggggcggtgggggggtgatgttaatgtcccagataccttgcactgagggcagagacctacttgaccat

SEQ ID NO: 119749 - DNA, 499 bp, Homo sapiens
aagtctcatgttggccatgattgggagccatgaccctaccaacagcacggaggatgatgtagaggtaggaaggcagaaagataggaggcacaaaagcaggcagataggagacatgaaaacaggcaagaaagtgggaggcctgtgcgccctgcagtgagggaggacactgcccccacggtgcagcccaccagagcagtctttccaaattacacaccaggaaagctcccctgctgcaagtttctccttcccatttccccgttctttaatcctataaatgtttattgaatgtctgtcatatgctgggcctgtgtgaggttggaggcatacaggagaaatgtcccagtccctcatctcaagctcaaggctctgtgtgacttgatgcttacatggtttgtgtgcagaggacgggaattggtggagctaggagtgggtcgtgacagtgtatgtgtgtgcatgtgggaaggagggttgtggagtgagggaaggggtcattcaagga

SEQ ID NO: 119750 - DNA, 214 bp, Homo sapiens
cttataatgagacatgtagttagaattatgagaataaaaataggttagcatcccctaatacagaaatggttactttgtcataagaatactaattctataacatattacatggtgattaaaatgagagtgtatttagaataatgttaagtcttaacattattttataatataatttattgaaataattaattacggatatttttaaaatatgtag

SEQ ID NO: 119751 - DNA, 411 bp, Homo sapiens
agcaacttcagatataaaatgaacctatgatgggacacagaatgaacattttaaaaaactgtgtttgagcttagccaattcctcaaaagttgtgatgaactcaaaaagttacttgagatgcttatttatttcacagaaatagaaatggaggctgaacgcatttggctcacacctataatctcagcactttagaaggctgaggcaggaggatctcttgagaccaggagctcgggaccagcctgggcaacatagggagacccctgtctctacaaaaaataaaaattttcccggtgtggtggcatatgcctgtaatcccagctactctgggaactgaggtgggaggatcacttgtgcctgggatgtcgaggctgcagtgagtggtgatcatgtcactgcactccagcctgggaa

SEQ ID NO: 119752 - DNA, 212 bp, Homo sapiens
catttgttgagataattatatatcttctctctttatgctgttattgtgttgaaatacattgatttttgaattcctgggataaatgccctcctcctgtctggcgcctgcacctgggcaactcttgctcctgtttgaatgccagtctcagacaccatctctctcagcaagtgttttgtctctctgttttttttttttttttttttttttttttt

SEQ ID NO: 119753 - DNA, 755 bp, Homo sapiens
acttcctgtatgagcggcggcccagccctaaccgccactcatccccttgtctccctctctgaacccgcccatcgtgggtaggacactcagccgtcaccgcctgctctgctggccgctacctgcagcaagatagggccgccaacgcccggcgacgacaaggaggaggtggccgccggagccggggcacccgccgctgctggagcgacaggtgatttggcttctgcactgttaggaggagcaccaaactgatgggaggttttgtcagccacacctacaactataaaagatgaagctggtaatctagtacagattccaggtgctgctacttcaagtgggcaggcagtatgttctcccccttcagaatctgcagaatgagcaaacattttcagacgcagcaggatcagattcatcaaatggtacgtagtccaatcaacagatggtcggcaggttcaaactggtttcacaggcttttcagataatgggggtataaatgaagaaggcagtcaaattcagatcattcctggctctaatcaaaccttacttgcctctggaacacctgccaacatccagaatctcctaccacggactggtcaagtccaggttcagggagttgcaattggtggttcatcttttgctggtccaacccaagtagttgctaatgtgcctcttggtctaccaggaaatattacgtttgtaccaatcaatagtgtcgatctagattctttgggactctccgacagttctcagacagtgac

SEQ ID NO: 119754 - DNA, 123 bp, Homo sapiens
tgcctggattacggatgtgagtcactgtgcctggtttaaataagacgttttagaatactgttaagacagctagaattttgtgttaaggagtttggtactgagaatatgagggaggggatttcc

SEQ ID NO: 119755 - DNA, 536 bp, Homo sapiens
tatttgttttatgtaaacattaactttttacttattttattctataaatgtggatctcttaaattcaaagggataatctgctagaccataagaattactatactaattagtacattaatgaacatataagggaaagagcatggaattaagaacacctggttctaccactacctttgttatgtgaccttgggtaagtcactgccagtttgtgttttctcatttgtataatgagagtgctggactggattattctaatatccttttcaaattctaatattctgtgatgcttactaaattaaattactacaagcaacaacaaataggctggctattttccttacacaatgtgctcaattattcacttatgttatttttacatctgtctggaaaaaaatgtctcaggctgtttaggtgcttgcacaaaaagggtaaagatggatggctactggtgtacttatgtatgctctggcaccaagaaattcctattactgtactttacatggaggtacatggtcattctaaagtctccacatgca

SEQ ID NO: 119756 - DNA, 268 bp, Homo sapiens
cagtcctgtggcctagactgcctttcaagtatatttaggaccccagatatctttggcccgcagtggtgaggtttatcaaaactcaagttcctatcactcggatggacgattaccctctggctagggctagtccaaatgctccttctatgtgtgggtgctggctgagccctgcatggctttgctctctgctttgacagggcagtactgagttcaatgccaaatctcccagttgctgtgttctccctctccaagtgcacagattctctct

SEQ ID NO: 119757 - DNA, 173 bp, Homo sapiens
aacatgctgtctcagagaagtaaacccaacaaattattggggtaaaaatgaataaaattatgtatatatactagtttgtacttatttgcataaaaatataaaaatatgtaaggataaaaacaaaattttttactagttaacaatcatgagatttttttgagagatggagtagg

SEQ ID NO: 119758 - DNA, 264 bp, Homo sapiens
ctgtcacctgacctctaagtgggttttaacacctcataaacaaaatacaaaggtctagcctagaataatttcctgaacccaaagtacagctgttgtaaatatgcaagactgatcctgtagtagcagaatacttgctataattagaaagtttatgatgaaatgtgtcatttatagtctatactttgacctacattaaaatctctcagtaaagtttatttgttgcaaagtttcaatcattatttcaggttatacatttccacttac

SEQ ID NO: 119759 - DNA, 261 bp, Homo sapiens
gcacataggaaccctgaaaggaaagtactatttgcaattgttcgtgcctccaaagtaggcacgaacctgcatcagtgtagaggcacagattgatatagcctccaatgtagtctcctttcccagttcaattagaatgattcagtctagttctagtttttggagagactgaggacaggacagtcagttgacttctttcctatttatttatttatttattgagatggagtcccgctctgtcgcccaggctggagtgcagtgaca

SEQ ID NO: 119760 - DNA, 720 bp, Homo sapiens
cgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactg

SEQ ID NO: 119761 - DNA, 354 bp, Homo sapiens
attcagtattttgccccaaatgtaaacctttaacagctacatgtttatttttgcagaggtgagtctaaaacacaagcagattttggcgatcatttgcataggaagaaacagacttcacacttgtgagtcagaggtgtttgctttggagggttgcattttcgctttctatgctgggtgaagtgagggtgttgtctttctgtgtccccttcctcctatctcccaaacatcacctacaggctttcccatgagaattcaacagctgttcctttccaattcctaaaggtttatgctgtagctctccatttatcttggacgttccccctgggttgagcttattaacttattgctttgcca

SEQ ID NO: 119762 - DNA, 312 bp, Homo sapiens
tgttgtattctcttgcatgtgaacattcttctttgaaaaatcttacctcctttcttttactgtgtttttctattttgttaccccctggccctctgtcacctgggcagttaggaactaaagagaagttctaggcagagtttttctctgcagggttgacccttttattacttgtggattatttgcttctgggggtgaaataggggttgagagggagggatggttgatttccatttcatcactgggtttggcagctggttctgcatgggacaggggtctttggagacagaggagcatgttctgtgtctcgcagtc

SEQ ID NO: 119763 - DNA, 681 bp, Homo sapiens
agcgggcaggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcgtgttgaaaggtgtccgcagccacacgcaaaaaagaggatccgcatgtcactcaccttcaggcggcccaagacactgcgactccggaggcagcccagatatcctcagaagagcacccccaggagaaacaagcttggccactatgctatcatcaagtttccgctgaccactgagtcggccgtgaagaagatagaagaaaacaacatgcttgtgttcactgtg

SEQ ID NO: 119764 - DNA, 928 bp, Homo sapiens
ctgagattgggagtttgagaccagcctgaccaacatggtgaaaccgtgtctctactaaaaaaaaatacaaaaaattagctgggcaaggtggcacacgcctgagtctgtaatatatgtgtctgataaagttcttatatatgtaaaataaggaactcttacagctcattaatgagttagacacttgtaccaaagatgaatttgttctagttgatagtctgaatgcagctacaaaaacacacctaaaagttagtatccacaattttttctttaatagtttttatttgtactgattttacgtagggtattaacatataatggtttaaaaatcgtgatcatacagatgtaatgtatagggtgtacttcttattaccaaagcctaacgtaacctaatccaagtcttcatgttgttacaaagtaaatcttattttgggacaaaggattttattgtactgtaaattgaattgaagcaaataaccccccaaactttacaaagtgttaaaacaaaattgctggtggtaatttcttaagtaaacatcatgaaatatagcttaaagtagaaataaattaagtcaaccatacataacagaactggacccacagtaaatgaagtgtgctgactgggctatgtatcttttgtctgtcttgataaaagaaatgaggtgaccagattttgagggagttatttttccccagtgctcttcctgttgcacacactaaataaacagtgaattctctaattttgcctatctataacttttaaaacacaaatggaaaaatttagacttgagaatcaaaataaaacactgaatatactcaaagaaccttgttcttcatgtgatactaaaactcaaattctaaaatgggtcaataggctggtgcagtggtgcacacctgtaatctcagcactttggcaggctgaggtgggagg

SEQ ID NO: 119765 - DNA, 439 bp, Homo sapiens
tatatgatgagacagagaagaatctgggatggctccaagatgtgtgacccaatgttgtgaaggatagaggtccaatcttcccggaagattggacctctagacacacaggagaaggctgggggtttttctaggggagagacaagacacgcagatgttccacagggtggaggggtgtttcagatggagcaggtgtgtgtgcaaggcccaggatgtgcaggagtgcaaggatgagtgagtggttgctgcctggaggcctgggatggtggccttgggtcacttcccctgagtcccagaccaaatctccagatgttcccaacagcccatcaaagagcaggtactgaagagggggctgaggagctccttatgtccacttaagtggaggaacagagacacagtacaagagaagggaacagagacagggacacacaaaggcagacac

SEQ ID NO: 119766 - DNA, 106 bp, Homo sapiens
cgctgctgccagcccgtagctgccccaggtgtgtctggtggctcatctgtggcttcctagtagaagcccttaaaaaatccagatcactagttgtacacctgtcaac

SEQ ID NO: 119767 - DNA, 658 bp, Homo sapiens
tagggaaaatgtttaaattcacttgaaactaggcgtatgcaaattaaaaccactcagataccatttatcactttccagactccatgaaatgtaaaaatatggcaatacattctgttgggaaggctgtgggaaaataggtacattcatacattgctgatgggaatgcaaaagtttattagttgcaatattgttcttagttgcaaagtattggaagcaacctaaattcccatccacaggagagtgatttaataaactatagcatgtcatgcagtggaatattaaataggtataagaaaagaatgaggaagagctctatgaactaatatggagtgatttccaagatggactgtcaaatgaaaaaagcaaagcacaaaagagtatccatagcatgctaccttcatgtaggaaagaaaggatatagaaagtaaatagttatctgctcatttgttcaaaagaaatacaggaaagataaaatactagtaaggctgattacctagagggaaaggaataaagaaggaaatgaggttagcaaggatgaagtacagtaacatttctttgattatatctttctgtgtagctctgactcttggaatcataattatgtctcacatacccttcacataatcccaaataaataaatgataaaaccaaccaagaa

SEQ ID NO: 119768 - DNA, 464 bp, Homo sapiens
ttctctttttaaaaatattgaagtattggttacataaaataaaattattttacgtgtatgttttgatgaattttggcaaatgtatacagctgtgtaaccatcaccaccatcaaagtagagagcagttccctcaccctaaaaagtttccttataaccttttgtggttgatctccctgctgcccagtatactcccttctcccgccctaggcaatcacacatcagctttctgtcagtatagttttggtatttcagtagtttcaagtctgggcaatatagcaggatcccatttctaaaagacattttaaaaattacctgggtgttgtggcgcccacctgtattcccagctacttgggaggctgaggtgagagattgcttgagcccaggaaattgaggctgcagtgagctgtgatctcaccactgcactccagagcctaggcaacagagtgaagccttgtctttaaaaa

SEQ ID NO: 119769 - DNA, 224 bp, Homo sapiens
tggtgcgcgcctgtagtctcaggtaatggggatgggagggatcagaggcagaacgaccgtttggtcggtccaaagcgttgaggttggggtgatcctgggcggcagagacagaggaagaccctgccagtaagggagggaaggaaggaaggaaggaaggaaggaaggaaggaaggaaggaaggaaggaaataaacaggcaagcaggcaagcaaacgatgaacgtga

SEQ ID NO: 119770 - DNA, 571 bp, Homo sapiens
ataagcattattttttaaaaacatctttgtccagtaattccagtggctgaagtctgtgggctatatttctgcttattgttgctcatgttgttgtatttctttgtgtttggttaatgtggctgcttccttgttattgtcattgagaaaattatttgtaaggttccccaaggactagtgtggatttgctcctctctagagaggcttcaatttggcttctgctgggtcctgtaagcattggcattagggctgccatgtgcttaaaggtttttggtctagccaagcaatatatctccatgctgcaactcttccctagggttgatttcaacaatttctccaggatggttttcccctacctactttttcttttttcttaccttagtctgacctttctgtagtttgttcttaccctgagactatcctctggtttgtaatttgttcttatcctgagcccaccgtttggaggtgggctgtatctcagcttatcatggaacctatcttgccaaagactaccatgagctggtgttgggctttgaatgttctttctccttagctctttctctccctaccccat

SEQ ID NO: 119771 - DNA, 370 bp, Homo sapiens
aagcatacagagaaatggtatatactctccgtacttttgacatcttaatggtggattttaataaggggaattctatatctctggcacgtacttgtggttggggctcaacggttttcataataggattctagcccctcgggagatggaagttaggagcagaatgaaggctttggtcccaaagatgggagttgtgagagcaaagtggcagatgtgtggtagcaaggatgaactatgtagaataaggagcctctctaaactctctgtatgggttttaagctttaaacattgatggctttcattgtgggtatgacagaaatattttacaaatgaccatcacctaaggcaaattgaattttcttcttacaactta

SEQ ID NO: 119772 - DNA, 260 bp, Homo sapiens
ttcatcaccctgttgtatttattttttcatagcacttattaccatctgaaagtatttcgcttatttccgtacacagttttatctttttcccctgccaccatcaccagaatgtgagctctagaagagacactgtgtatgtgttgttcactgtaatgtcctcagtgtccactgagacataatcatcactgagtaggtgtttcttgaatgtaagaactaataaataatcaaatgaattataataaaggagaataaagactata

SEQ ID NO: 119773 - DNA, 517 bp, Homo sapiens
agatgaaacccgggtgagagggctagaaaaaaaataaaggtatgaatgagatgtagtaaacctctgaatatcacactgatgactgatttcaagccaaaatgtatagaactcatgacagaaagtgaaatccacatgattaatatggtgtcacttccaaatgcattaaaggtctgctaatactctcggcactctgtgaaaaaagaaaaaaattttatagtaaagaagagctcaagttcccatttgctaactcaggtaccaccctaccattttgcagattttcctctttatgtggcccttgctgttcctttggaatttttaaagacctgggatttgagtaattgtagccatttctgaaatagttatggacaacccagttacttatacgctgctttaaacatttgcttttgagtatctggtttatagagagactacatttgcaatcttacctagttctttcatatccagaaccttcttaccccagtatcatttgcttgctgtctaccaacagtcactcatt

SEQ ID NO: 119774 - DNA, 446 bp, Homo sapiens
ccatgttccacccaaatccctggaactcaccaacactgtccatttgttcctaatcaaagggcctttgaacttactgtattgtctacctagaaaatgcttcccttctacttctgtcgttaattccaacccaatatttaagtcctgcttaagtgttacttcctgggaaaagcctttgctaactatgccaaaccctccaattgagctcaattacacagtacttatcagttttaatttcacatttgcctatgtcattattcaattatcatctgtctcctactgtaagctataagttccaagacagctaggatgcctgtttttgctcatcattgtaaccctagtggctaatacttagtctagtacacaaaaaattttcagtaaaaacatttgaatgaatacatcaatgaatggtaaaggtgtatcaaagatgtataaggaaagaacttacc

SEQ ID NO: 119775 - DNA, 337 bp, Homo sapiens
ccaaggaatatctataaaggaattcgggcccctacgtgagaagctcggagggggtggtttcaggagttccttgtggagaggggatcgtccgtgactcagaccccgtcgaaaagctctcgatttcacgcaaccaaccttaccctcgtccccaacacaatccttgattttacccctgggaaaattagcatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgatt

SEQ ID NO: 119776 - DNA, 1274 bp, Homo sapiens
ccaaggaatatctataaaggaattcgggcccctacgtgagaagctcggagggggtggtttcaggagttccttgtggagaggggatcgtccgtgactcagaccccgtcgaaaagctctcgatttcacgcaaccaaccttaccctcgtccccaacacaatccttgattttacccctgggaaaattagcgtaggtggtcatgaccccggcttcctctttaaaagccctcagaacctggaccgggctcctcaatgaaccctagtgttagaggccacaaatcgggaatcaaggtcggggagcggctgtttagggtgcatcactgttcaggatgcatcggggctcctttttctaagcggaagtgtgcgccctgcaaattggaagcccgttagttttggggaagggtgaacaagggccccctaggtctagaggaccgcatggagtctcgcttaagtgttagtggggtcctcagttctagaaatctgcgttctcctgctctcggtttggggtgagagcacccttcctaacggtcttcgggaactgtgcgcgccggctgcaatggggccgcattttaccctcctgtgtgcggcgctggccggttgcttgcttcctgccgaggggtgtgttatatgtgacccgtctgtcgtgctggcgctaaagtccctggagaaagattacctgcctggccacctggatgcgaagcatcacaaagccatgatggaaagggtagagaatgccgtgaaggatttccaggaactgtcgcttaatgaggatgcctatatgggggtcgttggtgagggcaggggggaccacggacccctgggtcctgggaaaggagggagataagaccaggggaaggaagaggctgacagcagggtctccgggattcgggaatggagaaggctgagatgcagattccgaggttccccgaggctagtaaataccgttttccctatcctcggctggcaattttatgtaataaaactacaactcccagaaggcaacgggcggctgagtccttaaccaggcctatctttgcccagtggcctcatgggtattgtagtttctaagattaggcgcgccaatgagacagtaaggctggaatctggggttatatctcctctgacagatgaggccacactgcaaaaggggtcctggagtttgctgaaggatctgaaacgcatcacagacagtgatgtaaaaggcgatctcttcgtgaaggagctattttggatgttgcacttgcaaaaggaaacctttgccacctatgttgctcgatt

SEQ ID NO: 119777 - DNA, 437 bp, Homo sapiens
ttaagaagaagttacattctcagggtatatcgggcgtttctctatctactagaatcaaaaagacagatgagaacaagtgttggccaggttgtggagcaattggaaccctcatccattcattgctggtgggagtgtcaggtggtgcagctgccaagcctgctccacagtctttcccatctcagctgatggcacctccatcctcctgttgctcaggtcagaagtcctggggtcttcccaacccctctgtcatacataaactccacacacaatgcatcagcaaatcccattgactctacttcgctacttataaggtagatgctaagtacatcaccacttctgccaccaccaccctggtcgggggtgggtggactcctgaatccccgcttgccttgacctcctctcgctggcccctgatggtccattctccacataactgc

SEQ ID NO: 119778 - DNA, 803 bp, Homo sapiens
cgggggccaggagcctgtagtcccagcaactcgggaggctgacacaggagaatggcgtgaacccgggaggcggagggtgcagtgagccaagatagcgccactgcactccagcctgggcagaagagtgagactccatctcaaaaaaaaaaaattactcagtctcaggtattctgttacagcagcaaaagcagactaagatatcacctctactaatgtttttcacattgtttgatagaaagagttcaatcaatggccactgttattatgagcttattatatctgttcggaaccccatagaatgttccctgcactggaagaaaagtgaactagagagtatctaacccttcttttcactcatctgtagttctagtgaaccaataattatgcaatcccaggataaccaagtccctctacctctcagaaaataagtaataatatactttaacagcaatttgtacaattatgtgacattcagaccaactaaaggtcctatcatacagcactaaattatcaacttccctctgaatttgaaaatgtcaaagccatttttaattaaagaatataaaaatagttctgtcctccaaacaataatgaatgatatttgctgttgttgataaattgccagaagataaataatgaagtatacttcaataatcccatttaagaaattttccacacagaataatacatagaacaaaaactcttagcaatggcacgttcacatttaaaatcagatcaccagcaggagcaaaaacaaaaggcccatggagaaatcccctcgcataagcgtattactcaggtga

SEQ ID NO: 119779 - DNA, 396 bp, Homo sapiens
tataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggagg

SEQ ID NO: 119780 - DNA, 247 bp, Homo sapiens
agaagtaaaccatcagaagaatggttggggcaagatgagaaagataaactgggcctgaaattctttatgtttgtggacaagctcagaggcaagagggaagtcattacatatttttgtgtaacacataaacaccatcaaggcactgtgaccaattatcagggcagagtggaatgtatatgaaaccaaaccccttgtttttattcccctttccgacataccttttaagagtactaaatacataatagcg

SEQ ID NO: 119781 - DNA, 427 bp, Homo sapiens
ctctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatggtagaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaagg

SEQ ID NO: 119782 - DNA, 880 bp, Homo sapiens
accagcaaaaagatcatgaattgctgaaagctcaaatgatggttagcttttttagcaataaagcatttttaatgaaggaatgtacatgttttagatataatgctattacacatttaacatactacatatagtgtgagcataacttttacacgtactggaaaatcaaaaaatatgtgtggctcatctgttataatgtttgttttattgtggtgatctggagccaaggctgaaatatctctgaggtatgcctgtaatgtataagtgctagtagaaatgagttgtgcagaattgctatttttttcaatttttatatttgggttaatggtaatatactaagcgtccagtctataaacttcagcattcgttgcgaaatccagaggagacttttaagtgctgttttgtagatgaaatatgaaagagaaacaagggcttaatggtaaagatgacatatgactatattaagaaactgaatggccctttgtccacaaacagtaacccacacagcattgctactgtggcatgcccactgctctgcactgacctcatggagcagagaacctccttcagacacctcacgcaccccctgaggagctaatgtttcttcccaacatggaaaatttggaagaggcctattcttcacagctgtcacttctcattttgaaagaatatgcccacccttattcgcaggcaaggtgtgaggaggtctttgggctccagctgttgccagcagaggtggtgaaagtcaacaacagggcactggacacacatagaaatgtgacccacagctatggtttgcaaatacagtctttcaagaagtcctgccatgtcctaaatgcccaaaccccttgcctcccatgattcttctcctcaaaggaccttc

SEQ ID NO: 119783 - DNA, 634 bp, Homo sapiens
catctcccaggttcaagcgattctcctgcctcggcctcccgagtagctgggactacaggcatgcgccaccatgcctggctaatttttgtatttttagtaaagacggggtttcaccatgttgaccaggttggtctcgaactcctgacctcaagtgatccgcctgccttggcctgccaaagtggtgggattacaggtgtgagcccccatgcccagccgatacagcctatttctgattactgcccagcacactttgcctatgtttatgatgtctcttttagtgcccttttggtctcatctcttctttttctctgtccattcaagtcctcttccatgaagttgtccccaactgcttcagcaactgcttcagcttatactgtccttgttcttccctaagttcagagccaggcctggctctgaacttaggaagctcttaagaattatcagtacactgaatttgttgaattaactattctagtccaccttgatctattctttttcagggcatcttgaccatttctcttcatcacacaatctagactttaaaggtatacaggctctcattaatttcaagacattcctcatgtcccagctagactgaactacaggcaggggctggttacttccacttaggtac

SEQ ID NO: 119784 - DNA, 862 bp, Homo sapiens
ttaatgagaaggattgaaaatactatcccgtgacaggtcaaccttgtcttggaaatctcagaaatctcaatcttatccatagaaaagtcatgacttctgtgcttatgtccatttgttctttaaataccaaactgtcagctcataggaaccatttacacacacacactgacacacacacaaacacgcacacccctacttactgagatgttcctggggagattcgaagacctgttccattgagaaaacaagaataagcccctggggcaaaagactccgcgtctctggggaactcagtatccgcgccgcgagcacccatgcccattttgaacacaacgcgactgctaaggacgtggtgtaatcatatggaccttcactcccaagagactcgatttcagagaaaatctgggagacaaatttagatccctacccgcacccacgcgatcaataaagctggggagacctttgggggaggggacagatgtgcttgcatccgggccgtgcgtgcctgcttcacgggttttccgggcagcaccggcccgcacacgccggtgcactctttttctggaattcttgaaatagccgggcctgaggacagtaagggagctgagttgtgtctgctacagacaagcggcgcagagcctgggggccaagccagggatgcagggagcgcggcgttagcggatgacggatagctcagggctaaggcctggcaggtccttcctacccccgacccagtacaccccgcagccccgccctcgccccagcacgcgaggtgaaagcgcgaggcccggggatggcggagagcgtgcgccactatcggggcgctgtctcttgccccgctctcgccctgggccggagaacg

SEQ ID NO: 119785 - DNA, 580 bp, Homo sapiens
gatcagacaaacccaaattgagggaaatttcacaaaatacttgtcaagttcccttaaaagcttcaaggtcataagagacaagaaaagactgagaaactgtcagattggaagaggctgcggagacatgacgagtaaatgcgagacaatatcctagattggattctggaaccgaaaaaatggatactggtagaaaaattagggaaatctgagtagttaatagtattgtgccattgttaatttctcctttttgataaatatgtcctgattacatacgaagttaaacaggccgagcctcatggtgcctcacacctcttatcccagcactttgggaggccaaggcaggaggatcgcttgagcccatgagtttgagactagcctgggcaacataaggagaccccatctctacaacagattacacaattagtcaagcatgcttgtagtcccagctacttggtggtgcatgcatgtagtcccagctacttgggaggctgaagtaggaggatcgcgtgagcccaggaggtcaaggctatagtgagccatgatggcaccagtctgggcaacagagctagatcctgtctca

SEQ ID NO: 119786 - DNA, 200 bp, Homo sapiens
gagaaatgctgggtgccttagctgggtgaaggctgggaagccagatgggactgcagaagacctagaatgctccctctcctcaacccccttcactgattctcctcttcgtccttaacttctcatcacaagatcgcttcctcagtgaccatttccctaacctcctagactagaccaatgttctcgttgcttctcccttgtta

SEQ ID NO: 119787 - DNA, 492 bp, Homo sapiens
cagggaagcagaggttgcagtgagccatgatcatgccactgcactctgggaaatagagcaagactctgtctccaaaaaaaaagaaaagaaaaagaaaagacagaaggagggaaacacccttccacacatcaggccttgaagaccttggggcctctcctgtatgactggtcaacccactccagtatccagcgcagcacccagcataggtgaagggtgggcttacggaattcactgaaagaaaccaacactgctcagatgctttccccaccccgtgcaaagggacatcttcacctcaaagacatagattcctatgtaagaaatcatctcaggcaggccctcccagggcttggaagattcaaagagatggcactcgaagtatgagtaacacagtacctggcccacaataagtacccagaaatgggtgcttttgtttagatgtcagacggatggcaaatctgatgcctacacttaagcagaagaccattaagcaca

SEQ ID NO: 119788 - DNA, 461 bp, Homo sapiens
aagaaaaattgcacgtggtatgtacatacaatagaatactactcagccataaaaaggaattaaatattgatacatggtctaaccctagaaacatgctaagtaaaagaagttcaatacaaatggtgacacattgtctgcttctattcatatgaaatatccagagtaggtaaatccctagaggcaaaaagcacatagctagttgagaggcggggggcaaagtgtaatgaggagttgatacaggagatagaaagtatttaggcaggcagtgagggcaaagagtcctcagcagaatttcttttctaacagaaagtagcccctgatatcatttcttttctaataaatagcagcctgaaaactcaagctgcaaacatagataaggaagctggaagcttgcacgtgggaatgctggcagctgcaccaacagaaaatggctacctgggagccaggcatatccaacacgg

SEQ ID NO: 119789 - DNA, 849 bp, Homo sapiens
actcggattgtgcagcgactccccgtggcggttgaggggcagtggtggcggcggaagcccaagtcgatgctgatgttgatgctggtggcggctgtgaccatgtggctccgaccgctggtcacagctcagctctgtcgttctcgcacagtgaggacaggaaaagtgtttaatctgatacaggacgttcaaggggaccgcctgtattttcatcctacaacaacacgcttgattaaacatccttgcgagaaaaatatagcactatatctagggaaacaagtttttttcacaatggataactttgagactagtctccttccatttaccatccctacatcaatgcaggtcggcgtaccagaagtgacatcagcacattttgctggttcgttattgctgttagtagtggatcaaaaagtctatatttatgattatgaaaataattcttggagcatgtctttaggtataaaacaccctgttacacatgtctctggtgataattgttgttatactggaagtttgttttgtgtgcatgtcagtaatttggtttttgcatatttccgtggagatcagatatcccagacttatatatattattcaaatactgggggattcagtttttggaagtatcactatgacagacaggcagaaatcattgggtctttaggcggaatcttccactttttttctttgtcacaggttgcgatgcttgtagtgaatcacagggaagggcatgttcaagtactcagatcaccccctcaaccggagttcgggctgtcttttgactataatgggactctagacatcctcatcgcccccggccagagaggcatcctgccctatggtttgagaaca

SEQ ID NO: 119790 - DNA, 267 bp, Homo sapiens
tccccatttccctctttctgacctccccaaggcaaataccttgtatgtatcatttttctgctttactttatggtgttgcaaagtgtaaatgtatccttatataatgtgacttcatttttgcattcctttagacaatgtaaatggagtcactttgttctttttttgcccccactcaacattgtttctgtgatccttttattcagatgtttgagtacttaccatgtcttaaacactgttctactgctgggcatgtcaacagtaagcaaa

SEQ ID NO: 119791 - DNA, 358 bp, Homo sapiens
ttggatggtatctatgtgtctgaaaaaggaacagttctgcaggatgatgaataaggtctaagagttgcccagctacagaaacaagatgctggatgattcctaagacctatttgtgatatataaacaatacaataaaagacctattgatggccaggcatggtagctcacacctggaatcaaagcactttgggaggccaaggcgtgacgatcatgaggtcaggagttcaagaccagcctgaccaacgtggtgaaaccccatctctactaaaaatgcaaaaattagccaagcgtggtggtgcacgcatgtaattccagctactcaggaggctgaggcaggagaattgcttgaacccaggag

SEQ ID NO: 119792 - DNA, 333 bp, Homo sapiens
ccccacccaaatctcaccttgaattggaataatcctcacctgtcaagagtggaaccaggtggagataattgaatcatggggatggtttttcctgtgctcttcttgagatagtgagtgagttgtcaggagatcttgtggttttataaggggctttccccctttttgctcggcacttctccttactgctatcatgtgaaggatgtgtttgcttccccttccaccatgattgtaagtttcccgaggcctccccagccgtgcagaactgtgagtcaattaaacctctttcctttataaattacccagtctcaggcagttctttatagtagggtgaga

SEQ ID NO: 119793 - DNA, 618 bp, Homo sapiens
gggagggggaggtgttggggatgaaaagtcttgttgcaattcattacccagggatagaaagaaaaaacttatagttgttataattttaaataaataagacctgacaccaaagtcagggaaatgaatggacaggaaatgcagcaaactttaaagaggaagtgggtttgagcctccaactggaggacattgaggaggaggaaacctacaagacgtgtaaaaatggaaaatcaaggctctcatcttaagaaagaaactcagagcccatgactaaattatcggaaagatatgaaatacaaccaattaacgtttatggctatttgaagcgatcataagacataataattgacacaatggttgtacagatttatgggatacagagtgtgatattttgatatttgcaatgtgtaatgatcaaatcagggtaattaccatactcatcacctcaaacatttatcatttctttgtgttgggaacattaaaaaatcctctcttctagctatttgaaaataaataacaaattattgttaactatactcaccctacagtgctatagaacaccagaatttattcttcctggttataatttgacatcctttaaccaacctctccctattccct

SEQ ID NO: 119794 - DNA, 186 bp, Homo sapiens
gctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgt

SEQ ID NO: 119795 - DNA, 627 bp, Homo sapiens
gtttgtatcctttgactcagccaagagcacaatttgctctgtttttgtgaaatattatttatggacattgtcaaaatttgaaagacataggaaagtgttaagaatataacaatcttccagggaaaacattttggcatatttccatttaatcttctctgactgtaactacaattacattgctaccatcatagaatctctcttaacccacttcccttcttttatttatttatttttttgagatggagtctcactctgttgcccaggctggagtgcagtggcatgatcttggctcattgcaacctctgcctcccgggttcaagcaattctcctgtctcagcctccccagtagctgggactacaggtgcacagcaccatgcccggctgattttttgtattttagtagagatgaggtttcaccgtgttgcccaggctggttgcgaactcctgagctcaggcaatctgcccaccttggcctcccaaagtgttgggattacaggcattagccaccatgcctggccaacccacttcttaaccaagtcacaaattcatgagttttctcgactcttctacagaagccactgactgaagtccacagcctgctgggcattcatagctggcatggaaccc

SEQ ID NO: 119796 - DNA, 481 bp, Homo sapiens
ccgaggtaagtgtcgcgcagggccggggagggaacagcagcaggaagaggggacctacggagcgcacagcagcactaggggaggctcgcctccttcctgacgcctctacacggaacatggatttgagtcttactaaaactgtgtacagagacaaaaagcccactcagcacaaacagagttgtctgttgttagccttcaaaatcgtccgtggtgtcactcttagtgcaacagtttctagattggcaaacccaagtctggggccccaaatgcaaaccccagaagaacggcccatgccctctgctggccctgctatccttgggcctcccagggccaggcaagctccttcgctgtgaccgacggcctcacgcccagcagagccaccaccaacagctttctacgaatctcagtgcatagatctatggaagtcatctgacaaaagagcacacggagaggagtgagtccccacacatcaatgtttccc

SEQ ID NO: 119797 - DNA, 415 bp, Homo sapiens
acacagtggggtgagggctgctactggcagctcgtggggagagaccagggatgctgcttaacatcctacagtacacagggcagcccccaccacaaggaattatcagctgaaattgtgaacagtgtctacactagacccttgctactcatagtgtggtccgtagaccagcagcattggcatcacctgggaccttgttagaaatgctgttagaccccaccccacatccactaaagccagctcttcatttcaacaaactccccgatgatgtgagtgcacattcaagtctgagaagggcttctttgaggtgagccttagtgcccatccccctttggtggccccggataccaagggtgtgtgaaaggggtgggtagggaatatgggtctcacctgccaatctgcttataataacacttgt

SEQ ID NO: 119798 - DNA, 145 bp, Homo sapiens
agaaaaaaaaagaataaaccatattgatttgctgatgataaatcacatacgatcccattccccttcttcctggtattttttttacttaaagtaatacatggcaaccatatagtgtaatactatgcagccattgaagagaacaagg

SEQ ID NO: 119799 - DNA, 344 bp, Homo sapiens
tctgattctgaccaaactctcttctgtcctcactccctcattctgactaaactcttctctgcttcttctaccaggcagctgagcacttttaggaaaatcttatagattcaacagtcctcaatttcagcacaaacttccacggcacctaaaattcctttaatctgcccttggtcagctctccttcccattccctataggatattaaaccaaaccattattccttgcctcaaaacccctactgccatcctgacttcattttagcaaactgaattaacatcctatcttcagaaaactaaaggccaggagtaatcaaaacctctgcaacttcctagctgggcacagtg

SEQ ID NO: 119800 - DNA, 791 bp, Homo sapiens
ctgtggatctagatttgcatagaagacatttatagacggttcctgatgtgagctgcagctggtaaaatacattccttacctatccaataagaatataataggatttgctttttaatttttaaagcacaattatgagtcaatattaaactataaagctctgaaactggcgaagaaaacaactatcaggaagagagcagagaatattttgtatatttcacataaagggcatttaacagtattgttttctaattttactttcatttcaatctgtttcattaaaaaagaaagttgaggtgacttgcctcaaaggtctgtataatttttgaggcttctttctgcttgtgtttttgtaactgtaaaataagaacacactgaaaatatactggaattaagaaagccagtgtgagtaaatgaaaatgtcattaaatttggtagagaaatggacagatgggtaacttgaagttaataaagacataaaaatcaaagcagaggaatgtattttaagaataaaacaatctaaattgcatgacttaaaagtaaaataataggtagggaattatgtattataaagaaacatgaatgtgttaactacaggtgttaatatttaaaaaattatagtgggaatgatttgagacttcagacttggttacatggcttttatgacatcactttttctaaattactggaacctgtgtttgtttttacattgttttgtcatgagaaaatacatttatataacttaaggctcttttcttcatttatttcaccttgtcttcaaaaaattacatgaa

SEQ ID NO: 119801 - DNA, 833 bp, Homo sapiens
ggaacatctttggggttttggtattacctgtcttattttaagtggatttatggcccactaggatgaaataatggaaaagtccatcctagaataattgaacaaaatataatttcagaggtaactacttacgacagactatttgaacactgattttgggtttggaataattaatagaaaacagtcaccttgcctaaaatggcaattttatgcttaaaaatttaaattttgcttggacaacccccaatcaacttctcacagactgaattgcgtgtatgttctttcttgtgtcttcagatcaatgtaggactgttggaggtcaattaaattatagtttatggacagggaggccacttctgtattgtttaattcctactgaggtcatgtcactttttaaatgttaagtagtatgtcaggtttccctggaaattcagtgtttcctccttgaccttgtataggatcattttataatctccatctccaaatattcatcatttaaattgcaaacgctgcttcaaaagcaaaataaatgtaccaccatttaaaaatgtcatatacagacttaataaaaggttctgtgtctgtcacagtttatatattactgtttacttttatttctagtttaaaatcccagttttacattttcagctgtgtttaagctctagaaagaaggaaaatattcatagggcaagtattttagcagcactgcgaaatgaggagatgaaactctgttgggaaaaaaatcaaggcaagattttagtttccatatgtctgacaagaagattttacaaaagacaattatatacactttggacataacatgaaaaaggaatcac

SEQ ID NO: 119802 - DNA, 317 bp, Homo sapiens
ggtgcagagatcccccaaggataagttaatccaactaaacatcgagaaaagcctacggcggttgcaatttcctattataaaaacattccagtggccgaaactcctcaacttagggagagaggtgaaatcaagggaaacaatgaactgctcggcgagggagagtccaggctctggctgaatgtggccccaaagaacaccttgggaggcaggccccgactccggaggctcgtcgggtgcccagggagctgcaccgggtccctgggccccgggcccggtcagtctgaggcggtgcggacgcagcctctcccgctccttct

SEQ ID NO: 119803 - DNA, 470 bp, Homo sapiens
aaaagtggggctaattctggacttcactgcacttttccctaccagagtgacttgcctgctctgcttatacatacatttttgtcatcaatattatcatcaaacacgttaaaattaatatatgcaagtggtttggatggtcactatagaaaggtacaaatagttctcagtgcccagttgtcaaaactgagagtgctcttaaataccaggctgaggagctctaaggacatgctagaggcagcccttttattttctgaaaccaaattaatgtcaaccacacactgctgggctttcctgagcctccatatatgtcataataacttgatttttaaaaaacccactactgacaataactataataactatgaaaaattggcattagtaggccaggcacagtggctgatgcctgtaattcctgcactttgggaggctgaggtgggtggatcacctgagctcaggagtttgagaccagc

SEQ ID NO: 119804 - DNA, 615 bp, Homo sapiens
attgtaactttttaaatgtctatagcactgaagttattttcaggttttgtattttctttcattgtggaatattttaattaatatagcatggcacctcattttcttttgcctgctgttaaagatggaagctgttgtcaaatgacaactttaaaaagggaagtataaataaaaagcctgattattttaggccagtttgccaatcactgtgtaattcctctggtagtattctacctactttaagtctaattttactagatagagtaatggaaaatgaaaatttaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaatgaatgatttttgcatttaagttgtttgaagg

SEQ ID NO: 119805 - DNA, 264 bp, Homo sapiens
gaacttttgttacagtaggtggactagcactatctagaagagtctgaaaggaatcccaggagttaattggagctctgtgggtgagtgggtatgtgccccatacacgcccacttgctcccattgtgccttctcaattgctagtgttcaagtgcactttgaggccctttttccagcagtgatgatttaggttagtaatacatcagtcttggcttgcttcccttgtgacctcccggaaataggattcagggccagacttttggaaaa

SEQ ID NO: 119806 - DNA, 355 bp, Homo sapiens
gcacgagtgagagattttagtttgtttatttttatgcttttaacataaaaagtgaagccacaagatggtatatgattgattgcctagcaaaaggttcaagtatgagtcttgaggtagggaaagaaggccttaaggtctggggcttttggaagaaggtagaacttgagctaagtttgaagatgagttggatttaggtaggtgaagagcctggcggggttgctgatgcctgtaatcccagcactttggggaggctgaggtgggaagatcccttgagcccaggagtttgaggttatagtgagctgtgactgtgccattgcactctagcctgggtgacagagtaagaccttgtctctta

SEQ ID NO: 119807 - DNA, 248 bp, Homo sapiens
gcacgaggccatctttcccatgaggttaagatttttgtctcaaagaccaggagctcttggtagtgtgcaaatttattatttaagttcaaataagatctctggtcacctagaaagctttgaatacacacttgcacacatactccactcataatatacactggtacatgcaggacaggtagggaggttggagtgagccgagatcacaacactgcactccagtctgggcaacatggtgagacgctgtctca

SEQ ID NO: 119808 - DNA, 294 bp, Homo sapiens
aataaaattgggcttctaaaaaaaactggggagaaaaagtacaacaattacaactgaatcccaacagtgtcaggatccaccagtcagtagctgctctcatcttttgctactcactccagttagggtttcccaaccaattgtagctgcaggtacaacggcagccacagctggagactgcacgggacaagaaaagtagcaccctcatggccctggagtgtaggcgttgctttttagcccactgtgtgaccctggataagtcatgtctcatctcagttttctcatctgaaaactgcc

SEQ ID NO: 119809 - DNA, 675 bp, Homo sapiens
tgtcagtacagtgcactgcacagtggataagaatgtagactccagagccagagagagttgtgtttgacttgtatctacggagcttgtgatttttgtttccctttagccagtttatcaactatcttctggatttctggttctcaatcctgacaataaatgaaatcatattctgaaagaacgtcatcattcgttgaaatattttcatttctggtaaatacattgtcttgacttaaaaagtgttttttttggtagcggatgactcctagaatagtacctggcatgtgttaggtgctcaataactatttactgatggaatgaacacaggctctagtgtaaacagatgagacttcataatgtcacttaccacatggcactcaggagatatttagcctacctaagcctcgattatcatcaactataaaattgagataataatagtatctaccatttaccgttgttctaagaattaaatgacatagtgcatgcaaaggacttagcatagagcctatcacctagcaagtgctaaaacattagctattatttttaacattaattatttttcaaccctagaatggtacatttttaacaggtagtacattttaacagcaaaattttagcagaatgtatttatcccccactttgcattttttcctaaaaactgtatcatgggataat

SEQ ID NO: 119810 - DNA, 380 bp, Homo sapiens
caaacaaaatatacgaaagagtggttttatgactctggaaataaggcaatgaaggacagtgctccctgagagccaggaaactaacaaggtgaacaccatgtttggcacagctgactgccttgacagggctgtagggcacacaacccactctggggaaagaaccatctgaaatagagaaaatagtgcatggtgctcacacagggctggaaagagtgcctgtttccaccagccagactgaaaaaaaccttgtaatgcataagccatttggctagactactcagaaaggtcttgtgtgaatagtggggaatatttagctgcaggctgagtcctgctctgaatctccctaatgattcacaatagcaaggctccaacgttgccaa

SEQ ID NO: 119811 - DNA, 478 bp, Homo sapiens
atgttgctgtaatgagagttgtgtacttgatattttaacccaaagcagagcccgcattgattgatgatcctttacaaaaagtacataaggggatactcacttttctgcataatcatcttagcattttcaaacgttctagaatttagcctgaagtaggggtaatctaataagtatgataaataccacaaacaaaatataagcaggtggaaagcatctaagatttaaagagcagcttcaaaaaaaaatccctttggaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgccttgggttgcacctcagagactgtctttttcatggagcaatgcagaaactgcaaccagactacaggaaatacaaac

SEQ ID NO: 119812 - DNA, 458 bp, Homo sapiens
aggagggttgccaggcactatgagaatataaaggatgatagagcaatcagaaaactaaaaagtgtggtagtttttgagctaaaattttaaatgcagagacaaatacaaaagaagatttgaaatgcagaaatagatacaaaaggacaaatagcaacagaagcagagagaacattttcagcagggtaagaaatggcaggaaaatgtagctcatgttcaaagagcatttgatggtcctgtttggcagtcacagaatacgtgaaaggtagcagtagtgaaagaaaaattaaggccatgtaatttggaaattcaagtgctctctttttctataggtgtaatttcttcttggcagttagtagtgacagcacattgtttgaagtaggtcttaaatgcagatctttgaaatgattcccacagaaaatgtctaaattgggagttttttctatgcccttcctcctcac

SEQ ID NO: 119813 - DNA, 347 bp, Homo sapiens
catgtttttgagactcatccatattcccccattgagttttacctctagcatgtaccccaatgcaaaaataatcacttctctccagtgtgttagaaatcatcatctgggtgctattactttgcagtaaacatccattccatgagattttggaaatgagaacaaatgcaatgtctacctttggagccccaaagcatgccagtgttgacaccatgtcattgactgggagggggtgtggttggggggtccttcgaggtaggcagtactaggggatgggcagacttcaggttgcatgaaattgaaagggggcagtgcttgggggagggaatccattggaagagctgtttcta

SEQ ID NO: 119814 - DNA, 355 bp, Homo sapiens
ctgagctctactacttactaactatatagtcttggccaagttacctaattactcctaacctcagtttcctcagctgcaaaatggggataggtacagcacctgatttgtgggattatcctgaggatgaacagagttaatatctaaaaaacactcagtaaatagggcttgataacgtaggagccattcactaactggcagcttttactgccaccgttccccaggatgttgtcattatttttgatttggaaaggtcacagaccgctctcggaccaggtggagacaaggtagagccgagtctccctactgtatcctaaataatcttctggaaagacaaggtagagccgaggggtaccga

SEQ ID NO: 119815 - DNA, 305 bp, Homo sapiens
gttatttccaccagagtgagtctctgagggtcgtctctggctccctgcagcaagcctggttcatggttcccttactgcctcctctcagggtctgccctgtcttggatgtacctctggagggcccctggcccagccttcagatcccaggggcaagagacccaagtctggggcctgccagaggccagttcagacacccaggcatggcaggagagaagcaagggggtgaaggatgagttctctttcccaccctgcccttgcctttcaaactcttagggctgaccctccaacttgtccatgctgcactt

SEQ ID NO: 119816 - DNA, 234 bp, Homo sapiens
gcaggggcagaggtggaagaggtagagaaggtggaaggggaggcaggagagggaggcacactcagtgtaatttatattgaaaaaaaatctgggtataagtagatccatgcagttcaaacctgtgttgttcaagggtcaactgtatgtaacagggtagggttggagagtctgtccttgggggaagaggtgggaaggtcgctctgaggaagtaacatttaagtgagacccgaagaa

SEQ ID NO: 119817 - DNA, 448 bp, Homo sapiens
gcctggcaagaaatgaatgacaatggcccctaggtggtgctgaatcatcatggaagtggaggctggacacttggcatttgcggaggtgacttccttctggtttgaatttcaaataagagcaggacagctccttgggatgtctgggaaaaaagaccaggcagaaaagagtcttttcactaggagcgggtgcaaaatactcttgcctgtgaggcctcttcaggtcttcggtttgctttagttggaaacaggaagcagggtcagaccaacttgtattcatttgctgagagctgttggagctgtgactgattctgacagatcaaataccatttataacactcctgtgggggacactttaaccggggatgttagtgctagcccctccagagactaagtatgtttgcgggatgtgaggacccctggaatatacaaatatgcatgctaatgaatt

SEQ ID NO: 119818 - DNA, 450 bp, Homo sapiens
  misc_feature (371)..(371): n is a, c, g, or t
  misc_feature (396)..(396): n is a, c, g, or t
  misc_feature (403)..(403): n is a, c, g, or t
atcctagctcagacagttagatggaccctatccccctgaagagaatcagagggatgggtgggcgtgaacaagtgcacgtgtatgtgatggtaatgagtccagttttggataggctgtgttagacattcagtaagactaccaagtggtgatgtgctatatgcagtaagcagctgtcacctgtgtgcagtacgcagaaattacctagagaaaactggccggggcagtggctcacgcctaggtcttctgaagcgatcctctcgatccacatctctctctctgtccctttctctcccaggttcaagcaattctcctgcctcagcttcccaagtagctgggactacaggcacatgccaccatgcatggctaatttnttttttttttttttttttgggaaanggattcncgctctgtcatctggtttgattgcagtggcgcgatttccccccattg

SEQ ID NO: 119819 - DNA, 722 bp, Homo sapiens
ctgtgctggatgcataggacattgagaaatgactaaacataggaattatcctcaagaagcttacaatcgaatgaagagtttaaactaactgcacaataaactatagtgaaaggtaggtttaagaaggtagaatagacggaaaattacacggttggtctagtataatttaggctcatggtataatgagcaacattttgttgttggatgatacaaagctgtgtgtttggcaaatagctgcaggcattggtgagactttgcttcagttgcccttccattcagtttgctacttaatacaaatcttaaaaatatggaaattccttttttatatttttttgtgataataaattatggttacagttctgtgtttcgttatataactgaggaaagggctttatatgtttcagtggttcgtgttctgaagtagaacttgcactaccaagtgtcaagagaaatatcagagaagcatgtgttgttggacacagagcagaagaccatattttgactcatgagagttttcctttgctctgaattttgcctgctaaagccagtctcatagttttaattacgtgatactgtctgttaagtattacagggccagacacagtggctgacacctataatcccagaactttgggaggccaacacgggaggattgcttgagcctaggagtttgagaccagcctgggcaacatggcaagaccctgtcactacaaattggaaaa

SEQ ID NO: 119820 - DNA, 285 bp, Homo sapiens
ttttttttctcttattgtcctgtagccagctgctgaattcctcaccactcaccttcacctttctctcgttttctgttcagccagctctcttgaccctggtgcttccttgctcgaaatcatgtctttttttttttttgacaatacactgtgtcagaggaatccttgagttttacaactggaagtgactttagaggttagctgattcagcttctctcccttcccaggtgaggaacgggacacccacagctgtgtggagacttatccaccctgcaggtgccagctaaa

SEQ ID NO: 119821 - DNA, 784 bp, Homo sapiens
aacttttctaagccccagtctactcatttataaagtgggattattaataatgtctacttcataaaattatgaagcctgagttaggtcattcagatagtgtttagtctgattcttcgaacctagtaaacagtcagtaaacagaagcaaatgccacatgcctgatttatatccaaggggagaaaggtaaaagtgaaattttcatgatttatggattcaaattatacatttcaaagatgctttataagctattgttttggtaagaagaattgagctgaaacagaattttctgacagcagtgattattaaatggtgaaataggctattgatgtctttagaggatatagatgttcaccttttgcatataagtgcacaaaaattcactaagtagatatgtctgtctacacagagagagagagcgtgagagcattaaagttagtaaacatccccctcgcttttttttttttgagacagggtcttactctgttgcctaggctggagtgcagtggtgcaatcgtggctcactgcagtctcaacatcctgggctcaagcgatcctctcgctcagcctcctgagtagctgaggtgtgcaccaccacacccggctaatttttaaatttttttattgtaaaggtgaggtttcaccatgttgcccaggtctcaaactcctgagctcaagcaatctgctcacttcagcctccaaaaatgctgggattacaggcgtgagccaccacgcctggccagtaaaccccattcatttacatcatcttacttgtccctccaaaatc

SEQ ID NO: 119822 - DNA, 457 bp, Homo sapiens
agcatcccctatttcctagccccctgccctccaaacctaggctctaaattgttggggtggctgatttgagtaataataaagctttggtctcccacttggccagctctctgtgtactaaactctttctctattgcaattccctcgtcttcataaatcggctctatctgggcagcgagcaaggtaacccattgtgtggttacaaaatatgtacagaactgctattattagggagaaaaacttgctgagactatagcagtcccagggtgttggagaggccagaatcccagtaagaaaaagagcagggggaactgagttcaacgttcttccagtttttccttaaagacatttacaaaattctaaagttatataaggaagcaagattagtgtacaagttcctatagagtgaacaaactcgaattctagggaagaactccaggctctcgattgagaaccccta

SEQ ID NO: 119823 - DNA, 407 bp, Homo sapiens
aaaatcagaggcatggccgggcgcggtggctcacgcctgtaatcccagcactttggaaggctgagcggggcggatcatctgaggtcaggagttcaagaccagcctaggcaacatggtgaaaccccgtctctactaaaaatacaaattagccgggtgcagtggtgtctgcctgtaatcccagctactcagggggctgaggtaggagaatcgcttgaacttgggaggcagaggttgcagtgagctgagagcacgccactgcactctagcctgggagacggagcgagactttgtctcaaaaaaaaaaaatcagaggcattatagtgaggacaaaatgctattaccattatcaactgacagtgttttaaagttcttgctaattcaatggtcaaggagaagagttgcagaga

SEQ ID NO: 119824 - DNA, 438 bp, Homo sapiens
tgctagtgagttttaaaatatcaaacatatgtccctgttgtttaaagagttgcactttagagtgaattaatgggaattttcacaacacagtgatcctagagttgtggcagtttttggtgatatcattgaagttgtcaagactcagcaatgaagcaaataaaagggatagtagttgtctaaatgtctctggaatggcaggggagaagttttagcatttgcagtgagaaaagaaaaaagtaaaaaagaatgtatttacatgtattttccagcttcaaaggggcttaatatatgccaataataaaaaattaaggatctaagtgagtgatgtttactccttggacagtgtatgctgcaattcactaatatgtcaaacactgaaattaggatatcagtgtttcatacagatgtgtcccctcatttgagatggctattaaatag

SEQ ID NO: 119825 - DNA, 638 bp, Homo sapiens
gtaggtatgctgcacaaggaaactggggagatagacgtggctgtgtatggctggtgtcacctcagattttacctcttgagaccaaggtgcctggtttctgtccccagtagttttattgtcttggtctgtaccatccacgtccttcccatcccctctttttgtcctctctcctctcaccttaaaggtttttcattttcagtttattgatttagttctaccctgtggtgggattcatgatgtgttactttaatgttcgttgaggcttgctttccctactagactgtaagtgctgtgaaaacagagcatatccgttttgttgaaaaatgtatgctttgggtagcaccatgcctggcacataaaataattcaatgaattttttgagcaatgagtgatgggaggcctggaagagctaatggtgaaaagcatagagctgaattatatacagaggagctttctagtgcaggacagaatagaggtgtagagctttagtccttgctctttctgcagcttgtaagcatcatgactttgggtaagtcagtctcttttttcctcaactggaaaatggggctcatgtgaaatgacttggtttagctcacagggtatggttaggatcaaaggtacaaattaatgtgaagtga

SEQ ID NO: 119826 - DNA, 574 bp, Homo sapiens
cacacagcccagttttggggagaaagtcttggtttgtcaaatgtatcaatagtttgtttcttttcattgagagtagtgatccacagtagaccactttttcgtgtattgtgtctcattttgtagtcaaaataccatggggccgggtgtggtggctcatgcctgtaatcccagcactttgggaggccgaggcaggcggatcacgaggtcaggagattgagaccatcctggctaacacggtgaaacctcatctctactaaaaattcaaaaaattattatctgggcgtggtggcatgcgcctgtagtcccagctactcgggaggctgaggcaggagaatcgcttgaacccgggaggcggagattgcagttagccaagattgcaccactgcactccagcctgggcaacagagcaagactctgacccaaaaaaaaaagcacactaccctaataaacacaattttgggcgcatttcgggccttgaaaaacgtttctttaaaccagttggttttgggcgcgcggggcccccagataggtatgtgtgaccctgtggttgctcgcggcgtttttccctagggaa

SEQ ID NO: 119827 - DNA, 181 bp, Homo sapiens
aaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgt

SEQ ID NO: 119828 - DNA, 389 bp, Homo sapiens
tgcatttttttctgttgaggcagaaaacgacatttgccaaaattaagtgggtctttccttcctagaggctgtaacccagcttttaatgcgcagcatatgatcatcacgtgggttctcctgctggccagaaacccttcctcctgcctcagcgtttcctgcagcacatgccggtgagaatgtctggttagtgctgccagattcaaagacagagtcaagcagtgatcagctgtgttcagattggctgggccaaggacacttggtttttcaggtttctttgaaagcttaggtgtttcgttttgtttttaattgaagaaagaaatcttttctgattcctgttttgatctgtttgttttcatatatatattttgagacagcatatttctcagtgt

SEQ ID NO: 119829 - DNA, 255 bp, Homo sapiens
aatatgtggatcacccgatttgggaggctcactctgcctctgagattaaagagatgagggcactggctcccagcgaaggctctcggccttaatcatgtgtgaaatgttttccttcctcggctgcagagcctcggtggtttgcagcagtggaaccaggcaggcccagttgtgggtaggagaggccgtcacctgttgaggcctcccccccacacccccgcatggcctgccctggctagcccatccccggccgcggta

SEQ ID NO: 119830 - DNA, 683 bp, Homo sapiens
agcggggtcacaagggaaagcatatgtagattgaagctatgcagagtgaagtctcaacagctgaagcttactagggaaccaatggtgccctaaattaagataatttatgaaatattggtctccctctgttgctgcccaagctccaggctgaagtgcagaggcatgatcttggctcactgccgcctcctcttcccaggctcaagcgatcctcccacatttgcctcctgagtagctgagactacagtcttgccttgtcacccaggctggagtgcaatggcacaatctcggctcactgcaatctctgcctcccaggttcaagtgattcttctgcctcagcctcccaagcaactgggactacagcccctgaaaagtagcagcaatgtgccctgcaacagaatctgcacactacagagatactacaaaagctaccatgaagaagctacatagatgatcactgggttgtacctctcaagtactttctcagaagccacatccatgttattgctgagagtacatgctttgctataaaccctaactgggttgaatcctggctgtgccacttagtagctaagagattttgaccaaatcactggcagagacctttgtccccttgtctatgaaataaaataaaaatagctaccgctctgagatttttcaataaaacctgttaaattttacaaggt

SEQ ID NO: 119831 - DNA, 282 bp, Homo sapiens
  misc_feature (103)..(103): n is a, c, g, or t
gcaagtgtgacacagagcacagccacttctgcagggaggagccagaagccacttgggcagccctcctgggagggggctgtgggtgaggctggcccgggaacgngtcctggcttcgctgatctcaaactcctgacctcaagtgatccgcccgccttggcctcccaaagtgctgggattataggcaggagccactgcgcccagctctgattggataaaattccgtgccaggctgtctcaggtgtggcctctcttgcttctagcctaaatgtggtccccttggcc

SEQ ID NO: 119832 - DNA, 394 bp, Homo sapiens
taaatctccttcagacaatgcccgtattacctgagcccagcacaggccgctctcaccacctgtccccttggtacaccattgactagaaaatcatttgttgacattttgctttcatcctaagatttgaagtcctcaaggcagtccctgcgtccttttcatttgggcatcctcagtactcagtatgatgcctgccatgcagcaggtgctgcttctaagcacaatacctagagaagtcccgtcctatagtccctaggagttagactcaaaagcaaaggccttatggtggcctacagggcactatccgatacagccccttctacttccagacctctgcacctactcactctgctctactcacagtggccttgttgcttgtgaacagacccaacacact

SEQ ID NO: 119833 - DNA, 522 bp, Homo sapiens
tggacagattttcatcaaatttaaagattgggtttgagatggtcctacataaaatacagaccatgtggagtatgttaaactcatgttggggtcccaggaggggatacctaaagaggtcatcctcacaagttaaagcaaatgttaaacaggagacccactgaaaacaaatactcaggtttatttcaaaagatctcatatatgacaccaaatctgaagtcacaacttcagattagactaacttgcaaccattgatatgcattctcgtggcttctcccattagttactccagggttaatggtaataagaatttatctatttaaaaaacaataatgatttttccaagcacttgcgggtcaaggactagctaataaatacacatgttcaagttgtgatgttatggatgagaagatcaaagagactgatgggaggacttgttttagactgagtggtcaggaaaggcctctctggagagacggcatgtaacctaaaacatgaaggatgaaagggcacctgccaagcaga

SEQ ID NO: 119834 - DNA, 387 bp, Homo sapiens
aaactcatttcatggactgctctaaagtatattggggccaatgtgattggtttctggaaattcttggagattattgaaaacggtggttaagcagagctaatattccatgttcataccctgatatacttctacattttgcaaagatggtattttgggcagcagcaacctatgctaaagggttattgtcctctggcagtaagttagcaggccttttgtactatacagctggttaatggaatcaataactcgtttgatacttgaattgagtaaaaaaattgtaataacagctttatcgtgatacaattcacataccatacagtttacctatttaaaatgtacaaatcaatggtttttagtgtatttacagaactgtgcagtctattttag

SEQ ID NO: 119835 - DNA, 161 bp, Homo sapiens
tacacccctggccagcaggaagaagttagagctgtctttgccctttctccatcttcattagctaatgccttaagattaaggtgttatgaaacccaaaggggtgccaggcgcggtggcgcatgcctataatcccagcactttgggaggccgaggtgggcaga

SEQ ID NO: 119836 - DNA, 306 bp, Homo sapiens
ttcaaagacagggtatggtttttcatttattcaattatcttttatgtccctcagtagaattttaaaatttacttcttgtagattttgcccatgttttgaattttatctctttggttgttgttgtaaatgagatcattttttcccatatactttgtaactgtttggtgtttcacttaccatcctatcaatgaggatttttgatctgtaaatctccttttgatatataaatctccttcataacttaaaatgtattcactagatgttggtttagttttaaaagtaatacatgatattataagcaatatt

SEQ ID NO: 119837 - DNA, 210 bp, Homo sapiens
cagatctagaaatcaaaacaccaaagggacacaaatagggaagaagagagtatggtcatctcttgtctttcagcaagcaacactgggatccccaaagagactcctctacagggccaagcttgtgtgatttatcacacctgtccctgtactccccaagtgccttgtacataacctcacctgctatacatgctatgttgtattataattatt

SEQ ID NO: 119838 - DNA, 176 bp, Homo sapiens
ccctcttaacatttcaagatctaaaaaagaatataaaatgtaaagccctgtagtaaatgtatttgtgtgagtaatatatcttttgtttcatgttgtttccacttataatttattttcacttacgtatactcatgtctaatgcttttgctctttatacttcaagaggccttttctaa

SEQ ID NO: 119839 - DNA, 484 bp, Homo sapiens
gattctagacgtgttcggggttgtgaaaggggcgaggaggagagagcagctgggccagggctagcgtttgaccacacccactagccactccctcccagctgcccgcagagccacatcgaatcgaaacagcagtggcagcggcttgccctctgagtggagacgtgcaggaggcccagagctctcagtcctctggatgttctttgcctttcctagtaccttcatttgttcgtttactcattcatcaaaccctgctaaggtctcaagttgttcacggcctggctttgcggagctacctctcgccccataacatatttagtgatgcctgaactccattcccctctccttcatctccactttctggagagcatcaagagcaaatgccaccgtgaccgttttgctggtagtttcttgagattcgagcaggacccagtgaatcgaagcggagttgcctgcaagatgaatcccgttgccatggcgactcctg

SEQ ID NO: 119840 - DNA, 775 bp, Homo sapiens
acctcagtagctggaggaatgggcgctccacgctcccagctccgttagttgggagttgaggcgcaggagcagggagggtgcccagggtgccaattcggccctcgaagcgacgtgcggctcagagcccaggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcagggccatttacaagatggtttcgtccatgatgaagatgccggaggacgagtcgaccccggaaaagaggactgagaaaatcttccgccaaatggacacaaacaacgacggcaagctgtccttggaggagttcatccgcggggccaaaagcgaccgtccatcgtgcgtctgctgcagtgcgaccccagcagcgcctccagttctgagaggagccagggttccctttcctccctcccttcaccggcccctc

SEQ ID NO: 119841 - DNA, 126 bp, Homo sapiens
aagtgtagtccgcgtctgcgccggccggccgggccgccgaagccgggggctccgggcggaaacggcaccacccaccaagggatgcgaggcgctcggggcgggctcaacgaggccgggggcgggccc

SEQ ID NO: 119842 - DNA, 475 bp, Homo sapiens
gtggatgtaaagtaatactttgttgtagttttgatttgcatttccctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttcactttcttgataatttccttgaatggacagaggtatttaattttgatgaagtccatttttttcttctgttgctgtgcttttcgtgtcatatctaagaatacattgccaaatccatggtcttgaagctatactccctaggttttcttctaagagttttatggtgtttatgtcatatttaggatattgatccattttgaatttttgtttattgtgtgaggtagggaaaggtt

SEQ ID NO: 119843 - DNA, 710 bp, Homo sapiens
gagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtaacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttg

SEQ ID NO: 119844 - DNA, 139 bp, Homo sapiens
aaactcgtacctaagaatcttattctccctgggtttggagctgttgaagagtattaagcaagtgagtggcatgctcacatgttctgaagagtgtttcctggtagtgatatagaagatggatttgaagggacagtaaagg

SEQ ID NO: 119845 - DNA, 422 bp, Homo sapiens
ggtgtgtagtaagggaaagtacagctgaactggtagggtgaagttcatcagctcaggtgccctcgccaaacctgagcttgtcaagccggctgctggaggcaaaatggaaatatagaacctgtcaactcctctttgagcataaacacaagtgtgagccgatgatctagaatccagatttactcaattaattccgtcaacaagtaagcatctagctcctctatacccagtgaagagtggaggggactgggaagaggccaggagaaacagaagacacggcacctgccctcagggaggagtaggtctatgagcatttataaagcaaccacaaataagcaaacacacacacagagtctaataccaagaccagtagtggggaggcgcagtggttagacacagactaggttcgtactctgatcttacca

SEQ ID NO: 119846 - DNA, 115 bp, Homo sapiens
cccgcccttcttgggtgcctactgtgtgtgagttctgtacagcaacatgatacagagatcacaaaggctgagcccttgcccacagtgtaggagacaggaggaaaaggaatgcaac

SEQ ID NO: 119847 - DNA, 300 bp, Homo sapiens
gaatactgacagtaaaagaagaaaacatttgtagtgcttgccaaagggtaaagggggagtttctcttgctttgtttaggtgtaaaacgttattctctattatcctgcacaccgaagtattgccagcatctttagaagggaggtagacatactgtttgcattttcaaattttaaaattgaggtagtggctcatgcctgtaatcccagcactttgggaggctaaggtgggtggatcacctgagatcaggagttcgagaccagcctgaccaacatggggaaaccccatctctactaaaaatac

SEQ ID NO: 119848 - DNA, 699 bp, Homo sapiens
acttgaaggagaaagtggtcggaggtcgtgcgcttcagagcagcctttgctttcttactgctccagtccacctccagcgcttctttaacggggcagaagaccaccttcttcttgaccatcgttgtctcagaagaatcaagttttactctcttggtatcaggcccatcttctactccttggctaactttagcaactttagttttctcctctacaaactcatgttctcctagattggcaaatgtgtatccatggtagctaaaaacatctcctgcaaagaacttgatgctatttttgtgacagatctggtcaaccttaactatgacagccctggagcagcaagtcaacacacagcatcaaattgagtgaaaaatgactctggtttcttctctatatcctcagtgtccaacttcacatccaccatggggttaagattctgagctcgctccaaagaggcttcagccctatttcggccaacagacccaatacgaatcaagaactgagctccgggttcttctggagatatctgtttgtgatccagcatggtcagtcctttcactcctgccaggatgagattcttggcaatttcagccccgagtcctttcatgcctgcaagaagcacctgggaggcccgcagccatttcggggcctccagtccccaaaggcagatctgctggtcatactgcgcctgcctcctcctgg

SEQ ID NO: 119849 - DNA, 387 bp, Homo sapiens
gtgttctgaagtcctgcttctccccagaatatctgccccctagagctgcagacccttccaggcctagcccttctccctaagcaggagcagccaggcaggaagatggtttccgccttgaggttggaagttagcagtatgtgaccctggagggttgtcacagacgtcattggagaggtgctccggagtgtttattaccatggctgctaggaataattggggtcatcaggaagtgcttcaaggactgtgctctccttgacgttgtcggtactgcctgtgggagccagctccttcatgtactaacttcctttctcagacgggagagctctgctcttgctctaactggagttttgcgcaggctcgtagagaccccatcctaactagtgccca

SEQ ID NO: 119850 - DNA, 823 bp, Homo sapiens
aggcgggcagatcacgaggtcaagagattgagaccatcctggccaacatggtgaaacgctgtctctgctaaaaatacaaaaattagttgggcatggtggtgcgcgcctgtagtcctagctacttgggaggctaaggcaggagaattgcttgaacctgggaagtggaggttgcagtgagctgagatcacgccactgcactccagcctggcaaaagagtgagactctgtctcaaaaaaaatttattattattatttttttattttttttaggatatggggtctcactatgttgcctaggctggattcaaactcctgggctcaagcaatccttctgcctcagtctcctgagtagctgtgactacagatgtgcaccaccatgcccagcttttatattatttttaaaaatgtctatacacgtattctcttcatgaagatgccttttaggaattaaaatttctgatcatatacctgaatgagaccactcttctggcagtctctctgtattagtctgtttccctattaaatatttttcttcattttctcccaagggaggtttctcttgtagccgtgtagtcagtgggatgaaatactatgagataattacttgaaatgattttcatatcccccaatctagagcctagataagcccaataacttagtaatttttttttaaattagaaaattgtaatttttttgtcaaagtaattcttgcacatgttgaaagctgagttgttcagaaggcttctctatgccatcgcaccaccttcattagtggtagctctgtgcctctcagtaatggccttaaaccactctttgttgattca

SEQ ID NO: 119851 - DNA, 879 bp, Homo sapiens
ggggccttgactgtatggatcccagtctggccaagggaggggctgggaacgtgtccttgaggaggcgggaatgtgctctgggggctttagggccaccttcttttttgctgaggtgaaaccatcaagagagagaatcttgctgggtacagtggctcacacctgtaatcacagggctttgggaggccaaggtgggaggatcacttgagcctaggaattcaaggccagcctgggcaacatagcaagaccccatctctacaaaaaaataaaaagatagctgagcatgatggctcgcgcctgtggtcctagctgctcaggaggctgaggtgggaggatcgcttgggcccgggagctcaaggctgcagtgagctatgattgcaccgttgcattgcagccttagtgacagggtgagaccctgtctccaaaaaacaaaagagaatctagggaaactgctcttgtttgggagaacaatactgaaaaatgcctccagtaaaaaaatttggaagatacaggaaaattcaaagaagacattgaaagtgcccctaaaattccacctcccagaattagttctggcattttggtgtccctcctcctggaggttgctctacctgcatttgcaggtggtgttctagccagccctgggtgtgccccgggtggctcacccgcaggagcaggagcaggagccgccagggttaggagtcagcctgggagtgagcttggaacgtgccagtcaggccattccctgggtgtgaccttttatgactgggttttttacatgagtaagcttgcacttaagtgctgttttatcttctcctctttgcatttaatagaatgtttatctgtatttgtcaataaacatcgacttgtgtggattgtactgcc

SEQ ID NO: 119852 - DNA, 262 bp, Homo sapiens
aagtgcaaagatattcaacacagtactatgttattaaaaattacaagtaagccaggagcggtggctcaccttatagtcacttctcactttatagtcccagcactttgggaggctgacgcaggcggattacttgaggccaggagttcgagaccagcctggccaacatgtaaaaatacaaaaaattagccaggcttggtggcacacgcctatggttccagctactcgggaggctgaggcagaagaattgcttgaacccgggagg

SEQ ID NO: 119853 - DNA, 509 bp, Homo sapiens
ttcctaccctccctgcaaccttgactctcaggccctccagactcaaccttccatcaccttcacctgacttcagggtcctcctgcaccccttcctcctcgtagccctccacttgtgcagtcagtggtcaaagcctattgattctactccctcaatcatttatactttgcctcctctcttccattccttgccaccgccatgtccgggccctttaatgtctttagaaatgtgtgccatttatgacattccagtctgagttcatgctagctgtgcagcttccgacaagtttcttatttctccaagcctcagtttacttttctgtgggaaggaaataactaacagagtctcactatttatggcagttttgtctcataaagtcactgtgaacactgaagtagtgaatactgaaacattgttactggaggaaatgcaaggtgacgtctccgtgagcacgttttcttcagcccacctgtacgtacctttggttttctgtttgtttctgttgaaccat

SEQ ID NO: 119854 - DNA, 152 bp, Homo sapiens
tttagtcctttctccgtattctaatacctgagaacacaccgggaatcctagcaccctcccagcttggagggagatgatcagccctcaggctttgggtccagaaccatggcccctctgggagccctgtttctactctccccttggagctctat

SEQ ID NO: 119855 - DNA, 282 bp, Homo sapiens
ggttcaggggctccatgtcaccggcccagctggccccaactccagctctggcttccttggaatatgtcctcgcagccctgcttctaatttattttttttaattaagatgcattggttttttgctgatcaaaaattctgacatatggccgggcgtggtggctcacgcctgtaatcccagcactttgggaggccgagatgggcggatcacgaggtcaggagattgagaccatcctggctaacacggtgaaaccccatctctactaaaaatacaaaaaatcagcc

SEQ ID NO: 119856 - DNA, 751 bp, Homo sapiens
gggaagaaaaagaggtttaattggaattacagttccacatggctggggaggcctcagaatcatggcaggggtgagaggtatttcctacattgtggcaacaagagaaaaaatgaggaagaagcaaaagcagaaacccctgataaacccatcagatctcatgagacttattcactatcacgacagtagcacaggaaagaccggcccccatgattcaattacctccccttgggtccctcccacaacactgagacatgtgtagactcaagctgtatatttctctgtttgcaaacttatgtttattaatttttataaacactccagagcaggggttggcaaattctttctgtaaaggtccagatcataaatacttttggtgttgaggaccatacggtttcagtcacaactactccactctgccactgtagctcaaaagctgacatagacaatacttaaataaatagacatggatgtgtttcaataaaactttatttacagatacctagagcctgttgaccgctgctccgtggcaaaagcattttagctcttcctgctaccaacacatggcggtagcaattgtgactggttatcacctgatttgttggggaatgtttgcactgtttgtgttacactgaagctattttacaaatgttgttatcgtcatgaccaacaataagtggagaagtggagaagtggcgagtgagcttattgaaaatgctggttagaagagacatatggttatgatggaatccaa

SEQ ID NO: 119857 - DNA, 411 bp, Homo sapiens
ggggtcccaaaatcactaagctaagggaagagtcaagctgggaactgcttagggccaacctgcctcccgttctgttcaaagtcatccctctgctcactgagaaaaatgcatatctaattgcctcctttggaaaggctaatcagaaactcaaaagagtgcaattgtttgtctctcatctacccgtgacctggaagccccctccctgtcctgcttttgcctccagttgtcctacctttctgggccaaaccaatgttcattttacatatgttgattgcttctcatgtctctctaaaatgtataaaaccaagctgtgctctgaccaccttgggcatatgtcgtcaggaccgcttgaggcagtgttacaggtgcacatcctcaaccttcgcaaaataaactttctgaattaactga

SEQ ID NO: 119858 - DNA, 187 bp, Homo sapiens
ctatgatttatagacctagtggactttctctgggttctttagtgctttacagccttaaatgttttctaattcagttgtctttactaggtgttctgtttacttcttgtcaatgagaagtaaaacctgagggagaaagatcttgatttttgcttctgttggtagattagaaaaaaagcatgtaatactt

SEQ ID NO: 119859 - DNA, 657 bp, Homo sapiens
cgacagacaaccacatcttcttttgcatcgccagccgagccacatcgctgagacaccatggggaaggtgaaggtcggagtcaacggatttggtcgtattgggcgcctggtcaccagggctgcttttaactctgttaaagtggatattgttgccatcaatgaccccttcattgacctcaactacatggtttacatgttccaatatgattccacccatggcaaattccatggcaccatcaaggctgagaacgggaaatttgtcatcaaatggaaatcccatcaccatctttcaggagcaagatccctctaaaatcaagtggggcgatgctggtgctgagtacgtcgtggagtccactggcgtcttcaccaccatgtagaaggctggggctcatttgcaggggggagccaaaagggtcatcatctctgccccctctgctgatgcccccatgtttgtgatgggcatgaaccatgagaagtatgacaacaacctcaagatcgtcagctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacag

SEQ ID NO: 119860 - DNA, 391 bp, Homo sapiens
aacatctgtaatctcattgcccagagatgagttgagaaatgaaataacattaaattgccactgactgtaaaatgtagtgtattgttattgccacattatcagatctttccttgctcttgaactaagaccctcatatttattgagtgcttgttgtgtgttagccagtgtgtaggatctgaaatacaaaggtgaataaggcaagcatagggtattcctggcttctggaagtgtctagttagttctctaggccaggtgggcatggtggctcatgcctgtaatcccagctacttgggaggctgaggcaggagaatcgcttgaacctgggaggtggaagttgcagtgagccgagattgtgccattgcactgcagcctgggcaacagagcaagtctc

SEQ ID NO: 119861 - DNA, 516 bp, Homo sapiens
ctttttttcccaacctttctttagtgaagttgtattacttaagttaaaaaggaaataatgagcctggtgtggtggctcacgcctgtaattccagcactttgggaagccgaggcaggagcatcacttgaggtcaggagtttgagaccaggctggtcaacatggtgaaactccatctctactaaaaatacaaaaaattagctgggtgtggtggtgacacctataatcccagccattcaggaggctgaggcaggagaatcgcttgaacccgggaggcggaggttgcagtgagctgagattgtgtcactgcactatagcttgggagacagagcaaactccgtctcaaaaataaataaataaataaataaacaaaatttaaaaaggtaataatgtaagaaaataaagagcatggagaaagtagaaaaccagataacctcggtcctattttgttaaattttgggaaatttcagtatctgcattgtacagatgacaggcagaatcttgagaagttaacacttt

SEQ ID NO: 119862 - DNA, 482 bp, Homo sapiens
aactttgagtctaccttaatcccatttattttttagaatactatttttgatttttaaattgattttagattccagtaaaacacctctctttatagttctagtcgggctcagtggtgtgcccctatagtcccagctactcatgaggctggcaggaggatcacttgagctcaagagttagcggctataatgtgctatgattgtgcctgtgaatagtcactgcactccagcctgggcaacatagcataaaaatattgtagttctagcttggggaaatcctttattagaaaaggaaattatagggaaatttcaaaatgtagacttgattaggaaactaagcaaactaatgaattttcattagtctatagattagatctttgaaggggtgagccttaataatggcttgtgttgacaagcgaatagatttttcttttaatacttcttaaatatattaaggattaataaatttagctatgcacataagt

SEQ ID NO: 119863 - DNA, 417 bp, Homo sapiens
gctttaggattaggcctccaatgtatggctttatactaacacaggatcatgtaagtccctaccgttaagactggctgctggctttttctctcaagccaaccagaaggctttccattggacagaaataacctgggttgtaactgtcccctttctactaaaaatgagcttctgggtgcggtggtgttcactgggtctttacaggacaactgctctgatcctgtagggtcagcccttaactattctagactgttgaatgtcaggtctcagcaatcagcaatttggctactgacccaaatgccggagaaacaaggctggggggaaaatatacaggtatcaaaataatgaagccatacttctttcttttttggtggggagggagttttggtaagacaacatgtatattactctctgaaaacc

SEQ ID NO: 119864 - DNA, 302 bp, Homo sapiens
agcttggtactcccttctcttactgtaaattgttctgtatgactattgttgattactagggatgattgtcttctagaatttagttcatctgatggggatgccttattaagtattttttttttaacctgtagtgttaatgtttggggtttgatcatttctgagacgtttatctaaagacatgtagacagagggttcaaagttctttactgtatggaaaagatgtagaggaccaggtcgattattggcagtaaaattggagatttcccttgcaaaagttgaccatgttgtgctgttatcccagg

SEQ ID NO: 119865 - DNA, 733 bp, Homo sapiens
tgggttcaagtgattctcctgcctcagcctcccgagtagctggataggtgccaccaccacacccagctagtttttgtatttttagtagagatgaggtttcaccatcttggccaggctggtctcgaactcttgacctcaggtgatccacccgcctcagcctcccaaagtgctaggattacaggcgtgggccaccgcacctggcctaagagttccttttctatacatccttgccagcatgttattttttgactttttaataatagccattctaactgaggtaagatgatatcttattgtggctttgatttgcactttcctgatgattagtgatgttgaacattttttcatatacctgttggccatttatgtcttcttttggtgaatgtttattcatgtccttcgcccactttttaataggattatttgtttttcactctttagtcatttgagttacttgtatactctggttattagtcccttgttggattaatagtttgcagatattttctcccattcaggaggttatcttttcactctgttgattgtcttctttgctgtgcagaaactttttagtttaatatagtcccatttgtctatttttgtttttgttacctgtgcttttgagatgttagccataaaatctttgtctagaccaatgtcctaaagtgtttccctgtgttttcttctagtagctttatagttttgggtcttatatttaagtctttaatcccac

SEQ ID NO: 119866 - DNA, 452 bp, Homo sapiens
gacattcttatccaatggacatggaaaacatagttctctaatatcttcttgaaaactatattgcaatgaaatgcagccaatgaagagatgaatcaaaatggagaacttgccgagttggatggatcacttgaggtcaggagttgaagaccagcctgggcaacatggtgaagcccagtctctactaaaaatataaaaattagccaagtgtggtggcacacacatgtggtcccagctactcgggaggctgaggcatgagaattgcttggacgcaggaagttggaggttacagtgagccaagaccacaccactgcactccagcttgggcaagagagcgagactctgtcatctctatggcaaattaaactaggaaaattcttaggaaggaaatgggataaattcctggaacacatggcaacctcccaagactgagccagggagaagtcaaatccctg

SEQ ID NO: 119867 - DNA, 404 bp, Homo sapiens
ttgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttgagtta

SEQ ID NO: 119868 - DNA, 317 bp, Homo sapiens
acccccacttactatagttctgtgatcctggacaagtaactgaatctctccgtgccacaagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttgagtta

SEQ ID NO: 119869 - DNA, 584 bp, Homo sapiens
attattaacatgtattgttatcacattgttttaaggaattataatggtacaagtttactttcgcatttcactcttttattctatgtgaggatatctacacaagatatgtttcttaatattaatcaacccttgatggatacacatattattagatagatttagcatttcgggactttgaatgtacctggaaacatcacatccaacaacttaaatgaagatgaaaagagaaccaatatagtatgaagcaggaattttattactttgtgcactgccaaagagcctgtccccactgcgaaattactcatgatacactcaagatgttttactctctagtctattcattataactacaaaattaaataacgctttacaggaacgcttttaatgattgctcctcgttattagagatagcacaggaagaaaaagcctttattttaaaaaatagtctccttaaaaggtatatctgtcacgagttctgtatcctgctagtctctagggaaggcagatggatgtgcccgttcccatgtgcaggggaaatgtaacagacctgaccgagcctctgataaatcttctctatagtccca

SEQ ID NO: 119870 - DNA, 214 bp, Homo sapiens
aaaaaaaatcacactggcagagaaacagaacacacccttgaagactggaaaaccagcaaatataactgctaactagacagcagtgggagagttgcggagcgcctggccactacattaacacaggagagagcagacctagccaggtataaacaaactccaagatcacaccactgcactccagcctgggcaagacagagcaagactctgtcttagg

SEQ ID NO: 119871 - DNA, 235 bp, Homo sapiens
gcagaagcccaggcctcccaaacacccccaagtaagctctcccacacaaaacctggacccctaaacccaggctgaagtattcaaatctcagtttgttggctattgcgggcggggccccatagagaagtcctatgcagtggaatctccatccctcctgctgcccagtcagcccagctgctttattttctcacccacccatttctgcagatttccctctctgcaacccggaggcccg

SEQ ID NO: 119872 - DNA, 508 bp, Homo sapiens
cgagatcatgtcattgcactccagcctgggtgacaagagtgaaactctgtctcaaaaaaaaaaaaagagattgacacccccaattcagtgtcaaaagtcttatcttggaaagggtataatttccaattaagacagagaattttttttttttcactacaacaaaattatgtgacttttctcacccttctctagatatctaattagcctgcaagctaacactctaaagacatgaaacaggctgggcttatgtctgtaatcccagcactttgggaggctgaggtggaaggatcactgaagcccaggaggtcaagaccagcctgggcaacatggtgagaccctgcctctacaaaaaaatttctaaaaattaaccagatatggtggcgtgtgcttgtggtcccacctactcaggatgctgaggcaagaggatcacttgagctcaggagattgaagctgtagtgagctgtgatcacaccacacaccacacactccagcctgggtgacaaaggga

SEQ ID NO: 119873 - DNA, 580 bp, Homo sapiens
aaatatttatgtacttttaaggtttagttttgatttttaaaaagcgggtagaagcttaactattaaaaaaaaaatgcttcagatcaagtggtaacattccaagttcactgcagttagctttattggaaaacatggttttgtcttttaaagaaaatcaaacgcttcctaaaacatttcaagaactggctgatgttacaactttggccagcagaacccatcgaagccaccgaggcgaggggctggtgttagtatccggcatatcgtgttacacaggagcttcgccagcttctcccaatggcgccatctcatgtagctatcctaagacgtattttattttgagccactttctcagagggaattgggtgggtgtggtcgtaagaacacctagaaaataggggtgaaacctttatggggccagggagccatggcagagggtggagtgggggatagaagccttcagactcctccgccccagccactctgcacctggggcctttcagctgttaaaatgaaaagccaattatcttctgtaaatgagggaaaaaaagaaggaataaaagtgtctattatgtatgctgat

SEQ ID NO: 119874 - DNA, 198 bp, Homo sapiens
cacacccttcagcacatgataccatttgacatgcagtcagagccatttaacatgcagtcagaggtattatgaggagggaaggtgttctgaaccccagaaggctgggtgctgtccgtgtggccttgcagagatcacagatacgcttagaaccccagtttgctcagtgttttgtataagcgaaactcctgtcttcagaat

SEQ ID NO: 119875 - DNA, 179 bp, Homo sapiens
aagccgagggctctcgctcttctggtctcctgggtctgccctacctgaagacatgagtggtgagttggctccaagtaaaagcacagagcatgtatccactcgcccattccctgacaaataatgacatatactgcatattttccaagcatggcaaagttgtaaaggttactataatgaaa

SEQ ID NO: 119876 - DNA, 269 bp, Homo sapiens
ggccagatgccactggaacagaggtgccatggttagcaaaactgagtcaaagaactacttatcttgtgtggtatttttatctaaaatccactttgtggaaaacaaagggatgatttctgaagataagccatgctggaaaataaccactcgattgtattttcttcatgtctggaatttttttttgtttcacattgggttatttattactgtctctttttctcaagaagtgattggaatgcttttcttctgttgaaaaacaagagaaagtt

SEQ ID NO: 119877 - DNA, 577 bp, Homo sapiens
gcagttccccaattagatagcatatgttgttccacatactgctacacgtttgtgcccaggttttcctctgcttaaaacacccctctcatctttatccatctggagaactcctgttaatttttcaatactaaacaaaagtgtcaccatttcagtcaagctttcctcgatctctccagatggaactgatcatcttcacacaatttggtgtatttactcatttacatatttgccttcccaactagtcctttaattccttgatggcacagatgtcttattcctttttctatatctagcacttaagcacggtcttgagagagtacatgggtcatgtactggacagatctcccagacaaaaaatcaacaaagaaacatcagacttgggccaggtgcagtggctcacgcctgtaatccagcactttgtgcggcgaggcggatggatcatgaggtcaggagttcaagaccagcctggccaagatggtgaaatctcatttctactcaaaaatacaaaaattagccaggttggtagctcatgcctgtaatcccagctactggggaggctgaggcaggagaagtgctt

SEQ ID NO: 119878 - DNA, 134 bp, Homo sapiens
tactcttacttgtagctctctgtgccctcttaaattgtggcattagtattttaagtgattgtgtttttattcttttataaaatatacctgcacacactcgcccagacatttagtctttgctgtgtttcagttca

SEQ ID NO: 119879 - DNA, 482 bp, Homo sapiens
ctacgtaactatggcagacggaccaggaaggattctagattgctcaaacgttggatcaggatcagacttcttataggatggttgctaaatttcacagaggaaatccatatccagcctgtttacctgctgtcaaagtgagcattcaaagggacaccccagtggctccccacttccaggcctcttggcaagtcatgcctccaagtcattggtggcatcctgcagctctccactgacagcaatgcttctgcagactgcgtctgcatactcttgtagtgctggttcaagactgggccaccaaagactcagctgagaacataacccaagaggtcaccaaagaggtgttgccgcctttatgtggtccccttcgggatggaggatttcttcaatgttattaaatagcattgccggtcagaatattcttgaaccctatggcaaacgtctctccctcgagagtggatttgattcttggacagagccagtgg

SEQ ID NO: 119880 - DNA, 218 bp, Homo sapiens
cttcctcccgcagcccgtctcacttttttaagccttcagagtcaactgcagcaaacacgtcactaactagagcccagcgtctgttctcagctcaggtgtaatttttggaggtgactgacgcagggggaagtgccgtggggagcactcgttgcatttagacagaggcagcgacactttggtgttggggtgggtctgcttgggcctgtggttaggcacga

SEQ ID NO: 119881 - DNA, 368 bp, Homo sapiens
ggaaaaccaaagacttggatatgtagatatctttatacccattactcatacagtcattttataacaaaagtgtgattaataaaacgctgtgtatgtgaaattaagaattgctgagactgggcgcggtggctcatgcctttaatcccagcactttgggaggccgaggcgggcggatcacttgaggttaggagttcgagaccagcctgaccaagatggagaaaccctgtctctactaaaaatacaaaattagccaggcgcagtggcacatgcctgtaatcccagctactcgggagactgaggcaggagaatcgcttgaacctgggaggcagagcctgcagtgagccgagagcacgccattgcactccagc

SEQ ID NO: 119882 - DNA, 461 bp, Homo sapiens
agatttgtctactctctcccattattcaatcatttatttaagttagtatgaactcatggatatttattatatactttagattataatctaatattattttatttgtttttcttaaattggccattggtgctttttcagttgggttcctgtgtccctttgacgtactcccactattgtggggtgtgattttagcacgctgctacttgctggcactactagtacttccgaatcatcttatatagcccctccctggtccctaaattggataatgctttttaactctcatcataaagatcagtattgaaaaggacacactgagtgtctattgcataaagaccttgtattaggaatacgactttttaaaaagcctccttttggatagatcttttgctttagctgagaaaattagacaaatacatacaatagcataatcccatttattaaacataatattagcctaa

SEQ ID NO: 119883 - DNA, 400 bp, Homo sapiens
aagcaatttaacaatgaaccttaaccagaaaagcaagagcaaaacaaacacaaaattagaagaaaacaaataataaaaattagagcataaataaataaaattgaaataaaaatcaatgcaaaagaacaatgaaacaaaaagttgctttttttcaaaagttaaacaaaactgacaagcctttagcaagactgagaaaaaagagacaagatacaaatcagaaatgaaaaagacattacaactgacactgcagaaattcaaaggatcattaggggctactatgagcaactctatgccaataaattggaaaatctagaagaaattgacaattcctagacacatacaacctactgagactggaccaggaagaaatccaaaacctgaacagactaataacaagtaa

SEQ ID NO: 119884 - DNA, 799 bp, Homo sapiens
cagagcctaccctatttattcccagcatggacctaaatccacttcagccaaaaatgaacaaagaaatgatgaagaacagagcctgtttctttctcagtggtgtactcagaaaatggatgcaagagtagaagctgatcctcgaggcttgcaaaagtggggttctttctgaaagtgaagccagcagccaagagccacccttcagaagatagaaggaagagcagctgcatgagtgatggccacagcaatgcatgggtcctgtctgtccacgtagtcctctccatctgcccgtagcttgccaggaaactttctataataataccaatacaaccaaagactattattctgaacagaaaacaagaaatacagctggagctatttcctatctacctgatgaagggcactaccaggcggtcactctggctctgtccaccgatgcctgtgcccactttgtgcgacgtagcttccatggagacaagagcaatggtaatggaagaagaaagtctggatgtactcttgcagaagcagaaagcttcatggaacaatattaatcttctggtcatctctgtgctggtctagttgcccataaagttgtcagattgactttggatttaaagcctgaaaatgagtcccaaggaaatccgttgacatgaggcccaaggaagacagtttttggaaggggcaagcataatgatttggaatgatgcctaataaaataaatggttgaccagaagattaataatgtgttggtttctcaatagaagaggaggaaaacatgtttttaagattcttaccaataagg

SEQ ID NO: 119885 - DNA, 396 bp, Homo sapiens
ttacacatcacatagtgccaatcatttacatgaaaatgctctgtatactatgtattatagtttgtctttgctactgaagataactttttccagcactcttctaacttattgcaacatgttaatcaaatcagagcgagatagtgagaataagtgaaaagagttcttaaaataaaaaaagtctcatcatgtcttctgatctcagcggggaaaaaaagaaaataaaaaatgtcttagtttgaaggagtcaaatgaacttgggtagtggaaatgataaacactaactcattttatgacatccttacaagaactgctttaaatataagtgaagtggttctgtaacactcttggactaatcagaatttgttctgttctgtgaattaaagtccaaatatttgg

SEQ ID NO: 119886 - DNA, 652 bp, Homo sapiens
agcgggaggaggtccccatggcgtcgttgccgctactacctagaattggtgaagaagaggagtttagtgccaaggtgggtgcaagagtgaaacaaaggcaacacatccacatgcactggacagggaaatggggttacttaaaggttgtttcaaaatatggacttaggaaggagaaagaaacaagattaaaaaggaacaagtaactaggagagaaaaatatgaagaaggttatggatatgaagatgcatttttggctgaaaaacaaaagtactcactttcctagcctctcctgtagccaaaggaggtcatctgacacaattttggacaaggagacaaagttcaactggacagcactgctctaggctgttgcagattaatgagactaaggaggcttgataactaaaggcaatgtgtcatcctggattgagtcctggaccacaaaaaaaggacatcagtaggacatttggtgaaatttaaataagagacagagtctcactgtgctgcccaggatgatgttgaacttctggcctcaagcagtcctcctgcctcagccttccaaagagctgggattacaggcataaaccactgtgcctgccctggctgggcaatggattttagaggccaataatgattcaacttttgagataaggtg

SEQ ID NO: 119887 - DNA, 373 bp, Homo sapiens
ccccttctttactcttagctcctcacagtatattacaattgcttccccaaggcaggaactgcaccttttattgccataatattataccaaatgtcatctctgtgcataacacgttatgtatgcaacatgtttgttgaaatagccgaattgtttcactagttatctgatagtttaactactcaggccaatggtcaagtcactcttgtctgggccctagcaactctctgcatgatgcatattggaccttgaagtcctttcaagatgaactacacagactggtgacatattcaaaaatggtgtgtatttgattttattctattttttttctttttgagacatggtctgtgtcgtccaggctgaagtgcagtggtac

SEQ ID NO: 119888 - DNA, 282 bp, Homo sapiens
ggtcttgtacctttggacaataaaagggatggtggtccttgtccagtgatatgataaatgtaccgtttaaaccagacagagctgatttctgggatagctggtccaatatgctgaggggtgcagctgctgatgggccggatttcattggtgaggggagccatggaaacaagcagcgtgtagtttttgtttaaaactctgctgaaagttccagggtccagaccaagaaggctttcacagtataagagatccagaggaaaaccataattgggttggtctggctgt

SEQ ID NO: 119889 - DNA, 755 bp, Homo sapiens
gaaaggagttgttgttttgtaagggattgaggtttgggagattaatcagacaccatcagcagggagagcacctgtgtttttgtgaagaattatgccgaggtaggtaacggatggagaagaaatttgagctttggagggggatacccgatatcctttggagaataaatgctgaaggagcagaagtatgtcttgttgagaagattcaaaggaggggctacaaagaagaaggtcatcaatatattgaataagaagacgatgattccagatggaaaaaatggaaatgtaagagggaattaacaacactggaattagtaaacccatgggtaactataaattatatgcttgaaatgtttatagactttaaattacatgaataacacaagtgcatgccatcaatagctgcaaaaccttgttattgggattaagtagagtttcgaggtcttaaggttctagcagtattagaaagtggtcaaagtgatcaaatctgttaggaagcaatgagtaaaggatgcatgttgtcttctcttgtgaaattactaaaagaataatataatatttaatcaaagttaatgtaacagtgaaataataaatatccaattaatctaaaagaacgcaagaactgtagagaaaaggatatgaaaatagagaccaattcctaacaagacaaagtaaagcataaaaactagacaaacaaacagaatccaaatctctacccagcagttggtgttactcttccatctccttatggcatatgc

SEQ ID NO: 119890 - DNA, 267 bp, Homo sapiens
gctgagaatagactcatgggaaaagaattccaaagtttatgaaacagtcaaattggcatttaagtgaccctgtacataccattgcttatctgcattgctttaagctcatttagttagcaagattatgtattaaaacaaatagtcacagcagacaacaagtattttaccttcaataaatagttactgtcagattatcaatgaagcagaaacttcttgatttttttttctaaaaaaccttgcatttagtgcattaagcagagtagtatg

SEQ ID NO: 119891 - DNA, 329 bp, Homo sapiens
tttcactgacagcacttgttaaaaaaaatcacttcgatatatttttttgagacgggatctcactgtcacccaggctggagtgcagtggtatgatcacagctcacatagctggagtgcagtggtgtgattgcagccttgacttcctgggctcaagtggtcttcctacctcaggctcctgtgtagctgggactacaggaaaataccaccatgctccgatgatttttaaactttttttttttttttaatagagacagggccttgctgtgttgcccaggtttgtcttgaactcctgggcccaagttatctgcctcagcctcccaaagtgctcg

SEQ ID NO: 119892 - DNA, 426 bp, Homo sapiens
ggactttacagatgaggaaactgaggcacagagaggttcacttgcccaagttcactcagctgggaggtagtgggcgggatcccaccctccacagtctgtgctccgagctactgtctcccatctcccaccacctgcactgcccacggcacctgccgggcccaatctgtcaccctctgctctctgccctcggcctctggtccctgttcccctggaacatgccaaataatatttcttttttctgagacggcgttttactctttttgcccaggctggagtgcaatggcgtgatctcggctcaccaaaacccccatctcccaggttcaggcaattctcctgcctcagcctcctgagtagctgggattacaggcatgcgccaccaagcctggctaatttggtattttccagtggggaaagggcaccgcaaaa

SEQ ID NO: 119893 - DNA, 823 bp, Homo sapiens
agaagtaagtcggggcgctgcgggccgggacaggggtgggcgttcgccgggggcgtgctggggccgggcgagggtcaggcagtccaccgcgagcctctgccagggaacagccgtctcctgagtcgaggcctcggggctgcagccgggacggccggaaagccgcctccagctgccagaagggggcggggcttccggtggggcagccatagggacctcgcggcccagggcagcgcggcctccgcgcgccgctggcgttcttccctgcgggacccgggctggctcggcccggctgtcagtgcgcacgcgcggcgacgcggcctgagaacctgggttcgcgcgccctgtccccctcccacgggcccctggccgcgtgccccgcgcccatgttaggggcagagccgcagggcctactcgccgctaaaaagcacggttgactaggacctgcgtgtggggaaaggcttcctaatgacccagcgcctaagtgcccggaaaaaaaagactgatacataataacattaaaaaacggaagctggggccgggcacggtggttcacgcttgtaatctcagcacttcgcgaggccgaggcaggcagatcacttgaggtcaggagttcgagaccagcctgggcaacatggtgaaaccgtgtctctgctaaaaataacaaaaattagtcggtcgtgctgctggtggtgctcctgtaatcccagctactcaggaggctgaggcaggagaatcacttgaactcgggaggtggaggttgcagtgagctgagattgcaccgctgcactccagcctggacgacaagagcgaactccgtctcatt

SEQ ID NO: 119894 - DNA, 1298 bp, Homo sapiens
ctccataagggcaggaacatctgtctttttcaacaatgcatttttggggcataatgctaagtaaatgatcctcaatataaatgtgctgaatgaaagaattaatggatgaatgaataaaagtgaattgtgactacctaggaactatggaaaagatgaaaagagagttcaggcagttggcttaagttgctgaatacctgaaaattctcctgtgataaagacccagccagcatcctcgagtgtggaccacgttaagggaaagcttgaaggaaaagagagactttgcggaccccaattaaatagtttaccctagaagaatagaacctatttggggtggggtgagtggctgcaagagggacgtttccccaggacatcatgcacaaaaggggcttcaaatgtagtcttttgacttatctccaaatgaagatttctatgttggatgcatgtagaaagctttcatattgaagcagagttttcagtgaagttggaaaaagaagaacaaaggtgaagatatccacttagcaactctcatcatttgtgtgtcaccatggcttcagagacagggatacacatttagtatgaaaaggaggcttggaggttagcggagagttggtggtggtatagagtaagaagaccttttcaaagtttgctttcttgaagagcactagtttccctggcatggccaatggggtgtttgctgttcagtagctataacttaaagtgcttaaaaccacaagatttactgctcctaaaggtaccgaatacagctattcagtatgcatgcacatttgtttacagttcttcagtgctgaggttataaaacaatatggaccctcaaatctcatggaaaaaccagtctaataccatgttagagaaaaaagagagtggatgcaaatggttaaattaggtactcttgagggaccaagtgtcctatcacacatgtatgaatctatgctgtcaattactctcattgtttcttcactaaaacctccctttcagaagtttatgaaagaggaatttaagattcaactttggagtaagattacatgactcttaagatccatttcagggccgggtgcggtggctcatgcctgtaatcccagcactttgggtgaccgaggtgggtggatcatgaggtcacacgtttgagactagcctgaccaacatggtgaaacctcatctctaccaaaaatacaaaaattagccggtcgtggtggcacgtgcctatcatttcagctactcaggaggctgaggcaggagaatcgcttgaacctgggaggcggaggttgcagtgagccgag

SEQ ID NO: 119895 - DNA, 939 bp, Homo sapiens
taggttaagtgtttcctccttagagttcttccttgatttatcttccccccagtctaaagtgccagtcacattaatctgttttatttctccatacagcactcatcactgattttttaaaaatctattttgccatctttctctctcactggaatattatgtgctcatgaagaagctccttgtctattttgttcctgatcgtctgcgctgcataacagattacctgtctcatagaaggtgcacaataactattttgttgcgtgaatgaacacgggaggcggagctgcagagagctgagatggcaccactgcactccagcccgggcaacagagcgagaccctgcctcaaaaaaaaaataaaaaataacagactaagataacaagagaaaattctttatgcaaatgtttgccattcaaaaccattctgccttacccttgaaactaagaatggtgaaagtagaaggtggagatctctgaattctattttaatgttagaccactgtataattattaatattattccataatacaagtgcaggcccttgaaagtaggtatcccgtgttttgctttttaaacattctccccttccccaacatgtagcatctgctacaaagcctgtcagagtattgttcattcatcagatattttcagaacatctgccacattccaggcactgttgagcactagggatacagcagaaaacaggtcagacaaggtccttattctcataaatgtattctagtggaaaggatggaaaacaagcaaataaggatttcagagagtgagtaatgcactgaagaaaatacagcagggtaatgatagcagggtatgatgaaaatgaagccatattagatggtctgattggaggagtccccagtagcaggggacatttgaactgagccttgaacgataaagagataaccatgaaaagaactggggaaa

SEQ ID NO: 119896 - DNA, 457 bp, Homo sapiens
tttttttttaaatgagacgtagtttcactcttgttgtccaggctggagtacaatggcatgatctcagctcactgcaacctctgcctcccaggttcaagtgcttcttctgcctcagcctcccgaatagctgggattacaggtgcctgacaccatgccaggctgatttttgtatttttagtagagacagggttttaccatgttggccaggctggtctcaaactcctgacctcaagtgattcgcccatctcagcctcccaaagtgctgggattacaggcgtgagccaccgtgccctgcctagatgacatacttttaaaacttattctcagttatccttaagttcaagtcaatgaaaggaagttggaggttggcagtgttggctgaatgtgaaaaagaaagcttttcctcaagataatgaacttgaaaccgttaggagtttgaactgtcaggctaaatgac

SEQ ID NO: 119897 - DNA, 204 bp, Homo sapiens
cagtcacccctgtgataacttcatctgggagggtgccttggaaagggttgctcttcagacctggtacagtcacccctgtgataacttcatctgggaggatgcctgggaaaggggtcactcttcagacgtggtacagtcacccctgtgataacttcatctgggaggatgccttggaaagggttgctcttcagacctggtacagtc

SEQ ID NO: 119898 - DNA, 510 bp, Homo sapiens
aggaaaatgggaggtgaggttgtgttaccagcgagaagtcagctttgaggagaagtcctccacagaagagagacaagggcaagggcttacttacttgtgggttaccactgctctcacctggaccctggtaggctttggaaaagccaaggtctccccacagttgtaagacatttcatcctcgactccaaggtctccacggagtgagaagcttctggcagctggcctttcaacaagaacaagaacaggaatttttattctgttgcaaacagttaactttttctcttttgatcctttacgcatagatattgaggtaatatactcatcctaataatttgttgatggtgacagtgtgtccccatgcctgaagacataatgaccttttatggttcttaccatttttcttcattcagtattgcttctcttcatctgaatatatttaaccatgtctccaactctttttttcaaaagtgctcatccttcagcttatcttgactctggacagtcttcatc

SEQ ID NO: 119899 - DNA, 113 bp, Homo sapiens
agtgttaagttcagggaaggaattgagttcggagccaaactgcccaggtttgaattcagctctgccacttgctagttgtgtaatactgcttttttgtttggtttggtgtattt

SEQ ID NO: 119900 - DNA, 314 bp, Homo sapiens
tgacctcaggtgatcctcccacttcagccttttaaactgttgggactacaggcatgagccgccgtgcccggccccttttctcagttttggaacccagtttttttttttccacagaaagtgcttgtgttcctccatctctggtgcagcaattcccagtcatttcctgcccagtaaatacctaaccatggccacgtggcttctcagtacccttccctcaactgacccacttcagatccccgagtgccagggtgggactccctcagggctctgacccggcaccaggggcacccctcaggctgttggtggggccgttg

SEQ ID NO: 119901 - DNA, 259 bp, Homo sapiens
tgctccacctggaacccccaatgtgccagattgtcagcctctggtaccatgtgccagattgtcagcctctgttaccatgaactgccttcaccacacccattcttgggataggtctgtggattgttcagatgccctttgatatggtttggctgtgtccccacccaaatctcatcttgaattgtagctcctataatccccacatgtcatgggaaggacctggtgggaggtaattgaatcaagggggtgggtttttcccatg

SEQ ID NO: 119902 - DNA, 572 bp, Homo sapiens
cttccctgggtggccgtaggacaaagggacgggaagtgcgtggtgtttttctctgtcttccctacagcaccaagcacagaattgggtgcctttccagccgtcggtccttccttgctgagatgttagactggaagatgagaaatggcatcattttaaggcattaaccgttccagccaaggaactctcatttcacaagttcagtgaactcttaactttggcctctgctgcaggggacagcagcgtgatgtttcagaacctgactttggagtcaaacaaagcctggatttgaagcccagttctgccacctgctagctgttggcaatttacttaacctctccctgcttcagtttcctcatctgcaaaggtgctgcacttcataggtttgttttgaggattaagtcgtataaagcacggacgaagccttgatgcccggagttactgctcctgttactctcctggtacagcacaggtctccctcaccacagggccaggggcagggccaggcagccttgtattggtttccttaaacggggttgatgccgggacttgggtttggctcaagctcaccctgt

SEQ ID NO: 119903 - DNA, 389 bp, Homo sapiens
tattcctattaaaatagggccaattgttctgatgtcccgtagcaggtttttgccttgatccagacccagttcaggactggacgttgtgttcagttgtcccactcctgaccccgcttgaatctggacagatcttcagtctcccctcatttttcatgatgtcgatgcttctgaaggtgcaggccaggaggttgtagatggtctctctgtttgggtttgcttgtgtttcctcatgttgagattcaggtggtgccttttgggcagggacaagaagtaggtgatgcagcgtcctcagtggtccacgcaggaggtggacatgctaacagcaccactgggtgaagctgtgcgcctcttcctctgtggtggccccaaggtttagtagtaacgtgatt

SEQ ID NO: 119904 - DNA, 575 bp, Homo sapiens
aggcaggagaatcgcttgaaccagggggtggaggttgcaatgagccgagatcgtgccattgcactccagcctgggtggcagaatgagactctgtctcaaaaataataataataataataataattgatggaattaagaaatattgaaaaatatataccattcactgtgagaaaaaagttcaactcctcaaactgggaatctcagtccattttatgtatgaaggtgatggcctgcactaaccttttgaggctgctatcatcctatgcctattttatgggtgaaaaaattgatggacagagaaagggagcattttcagtatatcacctagagaatcagtgacagagtcagtctatgaatcttgtggtggtgggtggccttcactgtagaaaggatagattccatgatcttttgtaccatcaaataaaatacttacaaacaaatgagaattagccatttgtatttgttttgttttaatagtgcaaataagatgtcattctagacctaaaaaaatgtttttctcccttttgtttccaaattttaggataaaaggcaaataaaaatctgttcttagagaa

SEQ ID NO: 119905 - DNA, 391 bp, Homo sapiens
cccatttcacctgcttgtgcctcctttcttgtgtccttctatacatccatccatccatccatccatccacccatccactcatccaccacccacccatcctcctgcctatccatgcgcttgtctttccttccttccggccttccatccattcatccatctgcccatccacccactcatcctctcgcccatgcacctgcgtgtccttccttccacctgtccttttatccatccatccatccatccatcttgctcactcctccactcacacagtcactcgttccctcagactcatttatggcccacctgcgaatgggtgtcctgacttgcaccactgatgaagcccactggggcttctcccacgaggaggtgcgctcttgccctctctgatggg

SEQ ID NO: 119906 - DNA, 394 bp, Homo sapiens
acagaggttcggtagcctgccccaggtcacacagctagtaagggatggagctggggagcaaattcagggcctgtgagtccctcctcttaatgatcatgcttttgattttagggatacttactgttacttattgctggtacattttccagtttgcatttgccttttgttcatggtgtcgttttatacaagagctttaactttttgtatgggagaactaagttttatttattagtgtaatgcctcaaacataacagattctcaaatctatgtgttgaacaaatgagaatgaacccatcagcagtctgttgatggtgatgaccttttatgtagtgtaatatgtatctccttttaaagggattcccagggcttcataaatgagttactctttggtttt

SEQ ID NO: 119907 - DNA, 279 bp, Homo sapiens
tcaaggtgcttgccatctggggcacctcctgttatggctgaattgtgacccctaaaagaagctgtcttggagccttgaccccaatacctccgaatatgacagtttttgaaactcaggcctttaaagaggtgactaaggttaaacagggacattgggtgggccctgatccaatctgaccggtgtccatattataaaaagggaatgtggatgtgcagaccattcccctgcccgggagggaggccggaagtagctccttccctcacagcctccgaggggggc

SEQ ID NO: 119908 - DNA, 366 bp, Homo sapiens
cgtagctgagattgcaggcgtgcaccaccacgcctggctaattttttgtatctttactagagatggggtttcaccatgttggtcaggctggtctcgaactcctgacttcgtgactcaccagcctcagcctcccaaagggctgggatgacaggcgtgagccactgtgcccagccagttctgactttttaacttgtgatttgacttttcctgtctgaagtctttctctgctggacgtgagttgttgaaggtgttgcttttctttgtagacaattagaggcgctcatgcactgggcaacagagcgagactccgtttcataaaaacaaagaaacaaacaaacagaaaaaaccaacaaaacaaacaaacag

SEQ ID NO: 119909 - DNA, 533 bp, Homo sapiens
ctgtaggtgctttgatgtgcgtccactagagctaaacttgatccttttcagcagcgggaccgctcttctgccaccaaaactgacaacctgcgaggcctaacagctgaaagaaataccactcagaataaactgccaagggtagcaggtgtggctttgggagccaaggataaagcttctagtttagcacagtccggttcctatcctcagatctttctcctagcctgctgctccagcccagctcctcatagctgatgtccccactatcccaatcttagtcaggggctcctgtcattaccaccaacagagttagtgattacaaaagataaagagacaaaaaaagatttccaaaagagcctctgccctaggggaacactttacgtatttggaagaaagtgggtttctaaaggttcagagaatatgctgacctcacatcctgaaaaagcttggcaactgaagagggaatgcaaccctcatggcttgatgttgcttaggtcaacaagcaaatatttcctggacacctaccataggctcag

SEQ ID NO: 119910 - DNA, 809 bp, Homo sapiens
gctatgtggcctcccccgccccaccagttagatgggggtctcactctgttgcccaggctggagtgccgtggcccaatctcggctcactgtaacctccacctcccaggctcaagtgatcctcccgtctcagcctcctgagtagctgggactatagtcacatgacccctctaaattaactcctggctaatttttgtattttttgtagaggcaggatttcgtcatgttgcctaggctggcctcaaactcctggactcaagtgatctgcccatcttggcctcgtaaagtgctgggattacaggtgtgagccaccattcctggccttattttgtgtccagcttctcactcagcgccacgtttccaaggctcacctacgttatagcctggatccgggcttcattccgttttatggctgcgtagtattccactgcatgggtggaccatgttttctttatccagtcatcggtaatggacatgtgggctgttgcacagaagggtcctttttattttctccctagctttactgaggcatcactgacaaatagaaattacatatatttaaggttacatgatattttgatatccattatgtgttgtgaaatgattactacaaccaagctaactaacaacatatccaacacctcacctagatacctttctggtgtgtgtggtgagaacacttgagtctaattcctcagcaagtttcaagaaaacagtatgctataataataatattattattttgagacggagtctcgctctgtcacccaggctggagtgcagtggcacaatcttggctcactgcaacttct

SEQ ID NO: 119911 - DNA, 705 bp, Homo sapiens
atcagtgcacggtgccaccatccttccaggccctccagccagaaccccaggagctgaaagccttgactcctctttctctcacccctaaatccagttcaagaaggcaggatttcgtcatgttgcctaggctggcctcaaactcctggactcaagtgatctgcccatcttggcctcgtaaagtgctgggattacaggtgtgagccaccattcctggccttattttgtgtccagcttctcactcagcgccacgtttccaaggctcacctacgttatagcctggatccgggcttcattccgttttatggctgcgtagtattccactgcatgggtggaccatgttttctttatccagtcatcggtaatggacatgtgggctgttgcacagaagggtcctttttattttctccctagctttactgaggcatcactgacaaatagaaattacatatatttaaggttacatgatattttgatatccattatgtgttgtgaaatgattactacaaccaagctaactaacaacatatccaacacctcacctagatacctttctggtgtgtgtggtgagaacacttgagtctaattcctcagcaagtttcaagaaaacagtatgctataataataatattattattttgagacggagtctcgctctgtcacccaggctggagtgcagtggcacaatcttggctcactgcaacttct

SEQ ID NO: 119912 - DNA, 320 bp, Homo sapiens
gcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaactagt

SEQ ID NO: 119913 - DNA, 719 bp, Homo sapiens
catagacgacacaagcaaatggaaacacatcccaagctcatggatgggtagaatcattattgtgaaaatgaccatactgccaaatacaatctacaaattcaatgctatgcccatcaacacccccaccattcttcacagaattagaaaaagcaatcccaaagttcataaggaaccaaaagagagcccgcatagccaaagcaagactaagcaaaaagaagaaatctgaaggcatcacattaactgatttccaactactataaggccattgtcaccaaaacagaatggtactgttataaaaataggcatatacaacaaagggacagcatagataacccagaaataaacccaaatacttacagccaactgatctttgacaaagcaaacaaaaacataaagtgggcaaagggcaccctattcaacaaatggtactgggataattggctagccacacgtaggaaaatgaaactggattctgttctcttaccttatacaaaaatcaactcaagatggatcaaggacttaaacctaagacttgaaactataaacactctagaagaaatcattggaaaaacccttctagagattggcttagggaaggatttcatgaccaagaacccaaaagcaaatgcaataaaaacaaagataaatagctgggacttaattaaactaaagagcttttgcatgccaaaaagaacagtcagcagagtaaccagacaacc

SEQ ID NO: 119914 - DNA, 414 bp, Homo sapiens
tccacactcttcacttagatgaataccatggggggttgcaagtggcatgacagtgacctgctgagacagagctcctgaacccgcgtgctggataaagaggtacagaccttctttttgccaaagagagtgaagtaaagtgccagaaagatcctgcctcaaaagcctgtcttgccaattcatccctaaaactgctgagggggttaatctcaaaagttgtctgatttctctgtgaaatgcctatggaatgaaagctaaaataactgaaggaaagaaaaagaaaaaaaaagctagagaaacagaagaaacagccaaagacaataaaagataaagaagattctgttgttttgcattgtatcaataatgctttcaaaatgcaagaagcacaaggattctgctgaattttttttacaaata

SEQ ID NO: 119915 - DNA, 413 bp, Homo sapiens
aaatagtatattttaatctgctaatggcttagaatctgtaaagtacaataatcgcataagagaaaccgttagtctgtagcctaagtcattatgcctgaacatcaaaataaactgtgtggagctgtttttaatttctcctgctcaacccctggagatttctgtttcagaaaatatttcttagaaacttgagctttaaaatgctcttcaggtgatactgatacatagtcagattagagaccctgtaccttaaaattaaagcactttaaagaaggaacacttagctaaatacagaaagaattaatataattggctggacatggtggctcacgcctgaaatcccagcactttgggaggccgaggtgggcagatcacaaggtcaggagactgagaccatcctggccaacatggtgaaa

SEQ ID NO: 119916 - DNA, 855 bp, Homo sapiens
ccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggatggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcgtgaacaatttgttctaaaagtaacagccctgactcagaagcctgatgtctacatccccgagaccctggagcccgggcgcctgtagtcccagctactcgggaggctgaggcagaagaatcatttgaaccaggaggtggaggttgcagtgagccgagatcgcatcactgcactccagcctgggcgacagagcaagactgtctcaaaaactaaaacaaaaaaacaccaccaccaccaccaatgtctgattaaatctaagccacggttccattttggggcaaggggcagggtgtgggtgtggtggacagagaacgggctccagccaccatcagctgcacgtcctggtagcacctgagccattcccagtctcctgtgctgggagatcatcatctaatcctgatgatgacgccctcctct

SEQ ID NO: 119917 - DNA, 729 bp, Homo sapiens
tctgatcatttttattgctcttttccaaactctacattccccatcctctttgaaactttgaatcctgatgtggttgggtggtgggttctgcttaacttgttaaaagtgaccctaatgagcctgaagtggttggtttcattgcattagggtctttagacagctcagggagaaactgccactctgtaagcatttatcacctctactagggaaaaaaggcccaggcctgattataatggttcagcaagtggaggagaagatattgttagcttcaatgtctttggtattggatttcttttcgttcctgcattaataactcataatttattgatcttttccctaatctttgttagtgatgttgccttaaattataaaggacagtaatacaatattagtaacagttctatcaatatgctaaaagctttacctcctcctactccttcatttttaatcaaaataggaccttccctgaaggattgggttatgagtacaatgaatttatgttggtctagtaggcaatattatgatttaaaagcatttctcaatggccaagtagataaggaattatatgaaattctacaaataccaagaggtatttcagtggtttacaaatattgtctaccttctgtatgcataaaatgtcatagattggtgccagtgaacacacacacgtatctcaggtgaggattggcctcagagaaattactggtacattctagaagacaaaaatta

SEQ ID NO: 119918 - DNA, 544 bp, Homo sapiens
tccaagcagccactgttctggtatctatcatcaaatgctagttttgcctggaagtggctttaatataaaagtaattagatagtatgttatgtctgagaagccccacttctttcctctgtttctgctgccattgccccagtctctgaccctgccactcaatcactctataaacacagcaggtactaggggtggctctgggctcggcactaagacaatgcccccggtaaagccacagtctagcaatgacagtcaaccacgtatcagcaacagccctgccccacacgtgctgactgcgcacaaggccggcgccgtgaacgtgctgtcaacagtgatctcactgaaccctcatggcagctctaggatgcagacagtagtatcacattatccccattttacttttgaggaaactgaagaaggcaaaggcaggcctcgagatctgcagtaacattgccaggaatgtttgagaaagcaaacttctccagagtgaggcagtctgccagagctcggaagccagagtccctgttagcaggggctggggggaccg

SEQ ID NO: 119919 - DNA, 193 bp, Homo sapiens
catgccattctcctgctcagaaacctctaaaagtttaccaatacattaaataaaacccaaatttttggccatgacccataaatctctgcatgtctgatgcttgcatgtctgcgtaaattaacacgatcttgcattcttccattcttttctcttgttttactccagccaaactggtcttcttgcaaaattctca

SEQ ID NO: 119920 - DNA, 607 bp, Homo sapiens
ggcgcctggggcggtggccgccggaccaaagctggcctctcccggctcctcctcctcgctccccaaggcctttcccaccgcgtcattgtctcggtttatctgcagatacgtctacctagcagtcagcccagcagcgtaagtggtgaccagtgtgggcctctttgatcctgagaccgaaggctcggccactggccctctccatttgttccttgttgccctcccttcatgattcaatccattaattaggacttttcctaccagctggcagttcagagctccgcatccccaggcctctgagtcacagttcctgccttcatgaaactaggagttggggccactgcattctactccttcgggactattgtttcatttctcagtccctcaaaccctttattggatgaacatggggttaggacagcggttctccactgcaacagttttgcctcccaggagacatttggcaatgtatgaatcattttcagcctctcatctggggtgagatgtcattggaatctacagatggtggagggcacaggtgagtagaggccgggaatactgcttcacgccttacagtgcgcaggacagcgccgcacaacaaagaattacc

SEQ ID NO: 119921 - DNA, 226 bp, Homo sapiens
ttgctgagctcagtaaatgctatcagtcagatgctcattatagaaattcagaggtttggccgggtgcagtggctcacgcctgtaatcccaccactttgggaggccaaggtgggtggatcacctgaggtcaggagtttgagatcagattggccagcatgccaaaaccctgtctctactaaaaatacaaaaattagccaggtatggtggcgtgcgcctgtgatcccag

SEQ ID NO: 119922 - DNA, 469 bp, Homo sapiens
cactagcaagagaaaaagaccccaaaaggattgtcagcttgaccattcttttctcccaatcactttcccttttctcttgtataggtttgtatcctccctaaatcttatgtaaatagcgctaacgacaaatataatcactaccaagtgttcaacccacagctaacagttttatcatccagtagttaaagccatttcatccctaattgtccagccaaaagaagacagccatgtaaactctcatttgtggaaactactgttgatagtcagctctccacaagttaaaaaaaaaatggcatttattcagcgttcagccctaactgtatgccctttagcaactgcttcagtacccaaacggttatttatctgaaaactgattttagaaaagctcccaataactaaagagcaaaaatatttaattgtacacaagtgagaaaagcaaaatattgcaacaagttttataattttttat

SEQ ID NO: 119923 - DNA, 317 bp, Homo sapiens
ggggagggggcaggtcaagacagagggagcaagagagagacgagtgaggtcccagattctcttaacaatcagatctcacataaacttacagagggagaactcccttattactgtggggtgggaaccacgtcattcatgaggattccacccccatgacccaaacacctcccactagatcccagctgcaacactagagatcacttttcaacatgagatttggagggaacaaatatctaactatatgaaaagccaagggaaaaaaggagctggttcttcaaaaaggtcaataaagttgacaaacctctagcaagactgac

SEQ ID NO: 119924 - DNA, 536 bp, Homo sapiens
caatgaattcctgttgtttaagccattaggtttgctacattttgtgaggacaacttggcaaactaacatacggcacatctctatttagaccagccacatttctttaattttttaattttaatttttttttaacttttaacttccggggtacatgtgcaagatgtgtaggtttgttacataggtaaatgtgtgccatggtggtttactgcgcagatcatcccatcatcccatcaccaagttactaagcccagcatccattagctattcttcctgatgctctccctcccctcaacccccaacaggtacacagtgtgtgttgttcacctatgtgtccatgggttctcatcagtcagctaccacttataagcgagaatatgcggtgtttagttttctgttcctctgttagtttgctgaagagtaatggtttccaactccatccatgctcctgcaaaggacatgatctcattcttttttcttagactagccacatttcaacatcctcatgtggctggtggctgccaacactgactcagaag

SEQ ID NO: 119925 - DNA, 575 bp, Homo sapiens
tgcgggacgctctggtctgcgcgacactctgggctgggggacactctggactggggcaccctcagggttgcgggacgctctggtctgcgggaccctcgggactgggggacactctggactgggggaccctcagggctgcgggacgctctggtctgcgggacactctggactgggggacactctggactgggggaccctcagggttgcgggacgctctgggctgggggaccctcagggctgcgggacgctctggactgctgacccctcacccacacccagccttttctgccccatccgccctctgtgcataacctgggggtacaacaggctcgcgctgtggcttcagttgtgcttccgtgtcccgggggcttccaactgggtcctgcaggagctgagacaatctccctgcttcgctttcatcctccgggcgtgtcctgcttcttcccgagagaagcctctaagatatgacttgtacaggaatcatacgctctctcctctctctgtctcccaggctggagtgcaggcgcgatctgggctcactgcagcctccaccccctggctcaagcctcccaccc

SEQ ID NO: 119926 - DNA, 216 bp, Homo sapiens
cacgttgaacatctccactctgattgctgttccctttggcattacaatgagagaaagagagactgacatactatgaagaaaagatttaaagttgcagtatcgttgcacattccttgtattggctatgaaatattgaactgtcagaatgtgacacttggttttttaagcaacctttcttgtttgaggtgtttgcagttcattcctttctcccccatt

SEQ ID NO: 119927 - DNA, 665 bp, Homo sapiens
ccaccattatctcacaccctaaatacaccctaaatatctattcccatacatattttccagatttctccttgtataaattagaaacctcaagtagcttttttaccatgtagcacatctcctcatgagtaaaactttgtacctcatctttaggggctgctgggactcaagtctagctataggtctagaagcaaagaggtgtggtgggggtgggtcctgagaagactcagcattctctggcttagcagctgcctagaggaaggccattatggtttcctcaggcaatgcagagtcaatcccctcagacaaaggtggaaaggccagtgtaggggggatgctgttactgggggtgggaggccatttctgctggcaaacaagactcatcagaatttaggagctcaacgtccccagcctcatcagggtcttcccacacatccccatccaaacgtatagaattccatctttcccaaccaatgccctcattttaacagcagataccttacaaggctgatatttcacctttgattgtaattcagctaatcacatgatgagagtatgtgtttgattttgtgcaatttcagacctttggcaacagaagagaagattctgacttagggcatatttagaagctcttgggctatttatggcagagctggggccaggaaatc

SEQ ID NO: 119928 - DNA, 265 bp, Homo sapiens
gactgagggggtgggtgcagggtggggaatagtagctctcgagctgtcatgcaaactcagtgagggagacgatgctcacgctcacgttgcacttgccacatgccaggcaccgttctgagccttttgcacatattaactcactgaatcctctcccagccacatgaggtagtactgttattatcctcattttccagatgagaggatgaggttaagtaacttgtccaggggctcagtggtcaagacagaatttccacccagacagcgt

SEQ ID NO: 119929 - DNA, 252 bp, Homo sapiens
ctgtacaggtataatctcagacatattgctagtctggttccagatcactaaaataaagtgaatattgcaataaagtaagtcacaaaaactttttggcttcccagtgcatataaaagttacgtttatactatagtctattaagtgtgcaatagcattatgtctaagaacaacatatataccttaattaaaaaatgctaacaatcatctgagccttcagtaagtgataatctttttggtgttggtgggtctacc

SEQ ID NO: 119930 - DNA, 482 bp, Homo sapiens
attcgcggccgcgtcgacagcttttccatttctgcacacatggccattaccagttcgataatagttgttttgagtctgtagatcatttgtgtaatattgtgtattagtaagatttagacttcctatccatgaatacaggatgccttttcacttatttttaccttctttgctttctttcagtagtctttctttctaatcactctacaagtatttcacctccttggttaggtttattcctaagtatttagttattttagatgttattataagtgggattacatttgtcatcttcttgttggatcattcactgttggtttgtattaacaaaccaatcatttgaatattggccttgtaccctgcaactttgatgtaattattaacactaatagcattcttggagattatttctgattttctatatgtagaatgatagagaagttctgtttcacacctattttctcaagatagtctatattgatact

SEQ ID NO: 119931 - DNA, 423 bp, Homo sapiens
tacttttggtctttgatgatggtgatgtacagatgggtttttggtgtggatgtcttttctgttaacacacagaccctcagctaagagtcctttctgttaacaaacagaccctctgttaacagagaccctcagctgcaggtctgttggagtttgctagaggtccactccagaccctgtttgcctgggtaccagtagcggtggctgcagaacagcagattttcttgaaccacgaatgctgctgtctgatggttcctctggaagttttgtctcagaggagtacctggccatgtgaggtgtcagtctgcccctactgggcggtgcctcccagttaggctgctcaggggtcaggggtcaagaacccacttaaggaggcagtctgcctgttctcagatctccaggtgcgtgctgagagaaccactgctc

SEQ ID NO: 119932 - DNA, 414 bp, Homo sapiens
acatgtacctatgtaataaacctgcacgtactgcacatgtatcccggtacttaaatttaaattttgaaaaaatgagaaatgattttatttctcataaagatagaatgacacaatttatgataaatagcaaaatatcaccaagacacttactaagtgcagtctttcttatgacattaatattacatttttctacttttgtgaatttatgtgactccttgttaaaggaaatttgcatttcatagaatttttaataaactaagatactagaacttatctaatctctttttaacactgaccttgaatagtcctaatttctactatgtgatttgtgctctgtatttatctggagatttaattcaagagacaaagagataagacatagtggtatttaaaaatgcatcagcttccgctaaa

SEQ ID NO: 119933 - DNA, 461 bp, Homo sapiens
aataaagcctagatttgcttttgtggggagacctctttactgattttctgtagttttgaagcatagtctgggaattcctgaatttcagaaattacattggaatgcttatttgaaacacatcttcaaattaataaaattaagatattgatttacatccctgaaaatattttcctatctgttacagatttggggagatgttaggtgtgaggaatagtgttcctcataggatggttgctttcagagggcagtgtttgtggtactcctgtggcagaaaaaaagaattcgtttctcttaccttaccattaggtaaacatagtaatttagggggaaattcttgtaagtattagttcacaaaaataaatgacctaagaaatttatctgccaataaatttttaaaacgttgtgtttaaaaattactctggggcggccgcacacagtggctcatgcttgtaatcccagca

SEQ ID NO: 119934 - DNA, 437 bp, Homo sapiens
tttaagcagggaaatggcatgatttggtgtgtgtttttagaacgatcactgtgaggagattggattgtaggtggccactgcagggggaggcaggagagcagctgaggctgttgccctcttccaggcaggagttagaagtggcttgcctgagggtggtagcacagtagacagggagtagtggtcacattcaggctgtgtttaggaaataggctcttcacaccttcatgatggactgaataaagtctgtgggagaaagagaagaggcaaagatgactcctcagggcttgggcacctgagtggatagcattcatatcgttgagatgggaagagccggtttggggtggaggagaatcatgagatcttgttttgccatcttacatttgagatatgagtatgtcagatagtgtgatctgaagcttggtggggagagaggacag

SEQ ID NO: 119935 - DNA, 524 bp, Homo sapiens
caacctctatgcaaaaccagtccccctgggcccctgaacaggagtcctgagaggatccagatgcagggccatggtcaggcacagtggaagggactcagcgccaaaccactcccaaccctaccctgagaataccagcagctccccagaaagcagatggcacaagtcctttccagaaaaactgaacagtctagggaacagccatccagatccagacatttgggagtccctccaaaaagcctggcttgccatttagctaccatccaccccaccccaaacacagaacttcttggctagccttttagggcctcactcagatatagacagatagccttgggtaaggcatctgaggagggcctccaacataaaagagataaactggagtaacagagagggaaaaaaaaaaaaaaagaggaaccagataatacgtgaaccaaagaaaacttagaccccaaaaaccctaatttccttggaaagataagatgatgcatccaaaaaataagatgctatgaaaaagtcatgataaa

SEQ ID NO: 119936 - DNA, 488 bp, Homo sapiens
tgagatttgggtggggacacagccaaaccacgtcaatcactaaagccagtcttcagtgacctgccatctcgatccttcggacactccatggaggcttctggacgcagcatctgtgctgctcagggccgttcctcttctcattggctgatgtgctctgtggcatctgtcacaggttttaattgaaggtcagcagtggcaggtaagccaccagcatcatcagcttctttcagccttttggaacaagagtgaaattggccaaggtcactgctatgacaaacggttgcttggatggagcccttccgagcataggtatttatagatccaaacatttatggaagccccaccatgaattaatgcacagtggcgttctcccaccaaacctggagaaagtcttccaaacatttttggaaaacattttaaatatttaaaaaattgtttctattctgtttcttagtaacagcagtctaacacaaaactatagcatttct

SEQ ID NO: 119937 - DNA, 438 bp, Homo sapiens
gtggtttttagttctgaatcactaaaataattgtaataaactacagaaataatcttgccataatcacttacctatacacagttgaaaaagatactgtttgtgaaagaagtcacagtcaatgtgtttctgtagtgtcctatttatttacttttaaaatttctgtcttcttgagtttcttgtgctagtttcagtcattttgtttgtttgtttgtttgttttaatcaatagcccagagttagagttttagtatattgggaattcgtgccaaacatttgatggagcgacacaagagcatgagaagctggtataaagagcactaactgtgggaggcaagttccagttctggcatcagctaactttgtaaccctgaacaaatcacagaatgtctgatatagctatgggattggttttcaggtactgagctcaaatgagagtatc

SEQ ID NO: 119938 - DNA, 452 bp, Homo sapiens
ggtgggctgtctcctacccaggtggctggggactgctttataccatcccagtttaggggaaagaatcaaacttggaaaccctgctgccgatgtagcagcaccgacttttgtctcgcccactttgaagaggtcagttgaccctatacagcttctttgatatgtgacagaaaggaggtcatttgctgaaatgaaagacacattacaaaccagattttaagtgtgactctttccttcagctgggtcacagttcttactttgagccagagcaacacactttactggtcagataaaaatactctgccatattttagaataatgacctttcttatgctttggtgtctccaaatggttaaatggagaatatatccaattgacaggaggaattctgttcatcatttttactcttgtgtttatatcttctcataaaaaaaaaacatgtgaaaatggcatca

SEQ ID NO: 119939 - DNA, 264 bp, Homo sapiens
ggttcaggtgggccagttcttgggtctccaggtggcttgcttgggtgcatgcagtggctgcggtcggccaggtggatgggcaggttcttgaacccctgggcactggtcatgttgtgggcaatggcagtagcagtgacgagacaaccctttgtctccagagtggtccacacgggtgttggcagtggctacaacaggctgggtgggccagtctccagaccaccagttggcgcgtgcaggaggttgccagctgtggtggtagcagca

SEQ ID NO: 119940 - DNA, 432 bp, Homo sapiens
  misc_feature (399)..(399): n is a, c, g, or t
agtgctgggattacatgcatcagtcattgcgcccagtcagcaatatattttgattgattttttaaatctcttttgcacagattctttataaaaattttgcaaaaatatacataacatgaaatttgccattttaaccatttttgagtatactattcagtggcattaagcacattcacagcattgtgccaccatccccactattccttctgcgtatttagtattttcttgaatgtaattgatatgtaacaaattacatatatctcagatgtgtaatttgataagttgtaccatatttacacatcttcaaaagtttcctcatgaccatttgttatcctttcttcaaaccactctctgcctccaccctcccgagcagctgggattaaaggcacccaacaacanacccgctaattttcgtttgttagtaagtttttt

SEQ ID NO: 119941 - DNA, 736 bp, Homo sapiens
ggccagagtaagaccctgtctcaagacaaaacagaacacatctcttttttgtttgtttttctccattagattgacttggcatcttagcgtgtcagctgagctactttgcattttagttgtgcttatattgtcagtttcttaagcacggaccctgaccttaaaaattaaatgtttatgctcctcttccagattgggacttgactgagattgatccagggctagttaccatgtatttcctgatggaagaatgttaagtatgaatttgaattttaaatggcttttctgtgggtcgagttaatggagacaacctcattttagaagcaattgcatcttccttataaaataggcagatgtttagaatgaaggagatgtaagcaaggaaagatcacctaggactccaacatagcaagctatagggagcttaatatttcttgtttattggcttgatctaaatagatgcaattatatataagccatgtgttttagtttccatctttttctgttttgttttgttttgagacaaggtctcaatttgtcacccagtttggagtgcagtagtgtgatcttggctcactgcagcctcgacctcctgggctcaagcagtccgtcagcctcagcctctcaagtattaatagctgggactacaggcatgcaccaccataactggctaatttttgtatgtttagtagagatggagtttcatcatgtttcccaggctgtccttgaactcctgagc

SEQ ID NO: 119942 - DNA, 295 bp, Homo sapiens
tgccatctaacctgctgtcatctctggcatgtgcactagtatgggtgacagcatgagaaactgagatagggaacatgagagagtaaagtaggtttaagagggaagatacagagttgggtttggatatgttggtattgatgtacatacctataagatatccagtaagttatggatattatacacatgaagctcttgagagagatcttggctgtatgtgtctgtcatgggcttagagatagaaattaaagccccagataccaattaggaagaatcaagagaagaggactacttgaag

SEQ ID NO: 119943 - DNA, 572 bp, Homo sapiens
cttacgtatctttggaaatgtggctccaaggcctttcccagccaccctgcagtcctctccctatatctcggtagctgtagttaccagctagatccttctcccgtcctggtggaggtggggctccttgggctctgaaacactgccctttctcccctggatccaaccttctgttgcctgtgttgcattgtcccagctcctctgacttttgcccatgtgtaggtaaggatgggggttgtaggagaaacttcggggtagaaaagccacaggacagttgtgagggaggaagagggtgagaggtccatacataagagatcctggctgggtgtggtgactcatgcctgtaatcccaaccttttgggaggacgaagcaggaggatcacttgagcccaggagttcaagaccagcctatgcaaaatatcaaaacccagtttctataaaacaatacaaaaattagcccagtgtggcagtgtggtgcctgtggtccccgctacttggaaggctgagcgagatcacttggaggttcaggctacagtgagctggaataatgccactgcattccagccagcctgggt

SEQ ID NO: 119944 - DNA, 572 bp, Homo sapiens
ggattacaggcatgtgccattatgcctggctaatttttgtatttttagtacagacgggttttcatcatgttggccaggctgatctcgaactcctggcctcaactgatctgtccgcctcaacctcccaaagtgctgggattacagatgtgagccaccacacccagctcatttgcgctatttatagcctttaacagctgagtagagtgtacagaatttgaggtgtatttctctctgcccagtttcttcagaattcataaattatttgtgaattttcttttttttttttttttttttttttttttacatggcgtcttcctctgtcacccaggctggaaggcagtggcatgatcttgggtcactgcaacctccacttcccaggttcaagcgattctcttgccccaacctaccgagcagctgggattacaggcacttgctaccacacctggctgatttttgtatttttagtagatacggggtttcaccatgttggccaggctggtctcagactcctgacttcaagtgatccacctaccttggcctcccaaagtgctaggattacaagtgtgagccac

SEQ ID NO: 119945 - DNA, 635 bp, Homo sapiens
gttctcaacctttatttggtatactcatcacttggagaagttgctaaaatgcaaatttgcagattccagacctacagcctagagattctgattccataggaggggaatgaggcccatgaatctgggaatctgtacattagatatccattaatccatttgaattacaggataacaggaaaaagtacataaaatttatataagttccctttttttatactctttctctctcctctctctctctctttctctctcctctctctctctctttccctctctctttctccctctctctcttctctctctcctctctctctctctcccctacccccaaaatgccaaagcacttatattttaaaagttgtttcaaagttgtttgaggggtccattttcacttgtggcttttagtgaacagaaaaaaatataagaaggctctctattgtgttacagcgaggaaatgcatgcatttacacatttgtctacctggtctcagcatgaaacagagcccagaaaagtcttcaattaagaaggagaaagacaagcaatccagaaaataatttaagagggctttgtctgcttgggagccagctggcaacctgggttccagatcagtgagacaagaaagaagcaaaagggat

SEQ ID NO: 119946 - DNA, 656 bp, Homo sapiens
ttctggagactaatcttgtcaaggcttcttattttatttttttgagacagggtcttgctctgttgccgggcctggagtgtagcggtgccatcatggctcactacagccttgacctcctgggctcaagtgatccttctgcctcagcctcctgagcagctgggactacgggtgcatgccaccatgcctggctaatttttgtattttttgtagggacgaggtttcgccatgtggcccaggctggtcttgaactcctaagctgaagcaatccacccaccctaaggcttcttcttaatgtttctttccctccatgagacacaagattattattatttctttattgcaatttttttcagctgtcctagatgttttgacgtgccctaaagctgggcattaggaaactggtacactactgtactttgagagggtcaacattaatgaagattgcaacaggcttgggagcagggacacgtgccatgccgaggctgacagacagcctgagttgcccctcttctctactcgccttgcccaggctgtgctcatactatttatttaataattcttatcggtgtgcttatgtcagcagaaactttccaccatacacaggcaaaactcatgaattgaactgtttccaatggggcattctcttctggtctacc

SEQ ID NO: 119947 - DNA, 237 bp, Homo sapiens
gcttaatcactcaggcctggaccaaatggaggggcccaccccaagcacaactgccaggagggcagtagctatcactggtcacccctgcggaaacttgctgcccctacaaaggccttgagatgagtggagagagcctcgtctgagggtcaggaacccggctcctttccctagtcctgggggaccttgggcaagtcattaaatctccttttgcctcagtttcctcttatgctagccaga

SEQ ID NO: 119948 - DNA, 615 bp, Homo sapiens
ggaggcagaggttgcagtgagccgaggtcacgccactgcactccagcctgggggacggagcaaggctctgtctcaaaataaaataagcagagaagtaacagggtttacaatgccctaaattctaaattatcctacactttggaggcacagttcccatagaggacaccatccttcatagaggttcagggccagggaagcccctggtcaaggaaatggccttgtagaaaggggagcccctgctgcttagtggctgggctcatccttctttttccttgtggtggctccgagctgctgagccagctccctactaaagctggctccagggaagactgttctgtgctcatgaaattagactgaagtggtccctaggaaatccaaaaataaataaagtgtgtatgtgaggaagatgaacagctttctaacatgtattattctgaaccaacttttaatttggcatgaaattaatctcaggctagagtctctcaaaatattaaaataagtaaacactactgggcaagaataagtatatatagtaagaataattttttttagtttattgtaaaatatccaagtctattttaatttttaatctatcaaaataaaccacttgtaata

SEQ ID NO: 119949 - DNA, 361 bp, Homo sapiens
gtaaaagcattttcttgcaccacttccctgaaccgcagttcctacagagtgatgtgatgatggcccggtgatgcctgcatatgcattgggttgcactacggtggagaaactgcatgctgaatttaggggacccacgtcttttataataagctgcaagcaaacctgcccaggtgggagatgttatctttagtatacgggacaataaaatctgccttttgctctggagggagatactacctctatcttctaaggttactcactataataatcacccttgtaaagattatttagaacaagggcaaccagtgcctctactggcaagtgtgcagaaataggagagaaccatggggaattgtctctc

SEQ ID NO: 119950 - DNA, 413 bp, Homo sapiens
gagaatgtgcacttctagcaagttcccagaagatgctgctgctcttgaaatcacactttgaaaaccactggtgtactggaaaaagcacaggctttgagggccatacagacatgaattcaaatcccaaacctaccacttcctagctgtgtgactttgggtaaatttgtataactcttttgagtcttgggttcttatctgtaaactaggaaaatactactaacctcatggtagggtgatggttgcatagctttcctgttagaagagcccttagagtgggcccactgcatctcccttgcagtgtcctccttggttctgctttcttgtgcaacccaaaacaagtccaccccgccttatcaagcacctactatgtgccaagtgctctgtgaactttatttaatctttaccaccatgta

SEQ ID NO: 119951 - DNA, 504 bp, Homo sapiens
gaggcacagcctcatccctctccacacagttcatttcattcttaactgctcaattgtgttgcattggacatgaatagaaaagtaggccttgatgtcctcaacgtttcttcctgtttgtgtgaacagtctctagcctaaggaggtgctgatggctaggcatcttcacccaacactttagtcctgcgtcccattcatcacatagacgtcctgctggcacaggccctgaaagcttcaggatgagcatcctggtagccacggcccagaggaggcatcgcagtgtgtcagtgggatggtggtggatgtgtgaacgcacctccttgtctctgctgcttcacttaactgtagagaatggcagctgaagagccttatgatggttttgccttcagatgtcatcttcctgcttggctgggactgctggtcaaaaaatgacaggtccagagccctcagagactttcttttactggctgtttaattgcatcagacgagcttctcctctcactgcac

SEQ ID NO: 119952 - DNA, 323 bp, Homo sapiens
aggtgcccctccagacaatcacgccccttcctttccctacaggggaaaggagagtcaccattctcatccctatactcactcataatcatatagttactgacggaaacactgggtagaatcgctggcaccattcacttaactcacttgctgaatttatacacttgaatttaaatgactaaaataaatgcctggagaatgctactccactgtatcaagcaaatgttaacagcaagcagatacaatactagcagaccaaacaacacaaacaaaaaagcattaagaagggacaaaaaaaaaactctctcatgtgcataaaaagtaca

SEQ ID NO: 119953 - DNA, 158 bp, Homo sapiens
actctgtgtctaccaaaacaaaaaaaaatttttttaaacgggatagagtcaactaatgactcagagaaacacttccctcctgaaaaatggaatcctggacacaactatctggcttttacatccttatttatagatttctagctcccaatcaattcctg

SEQ ID NO: 119954 - DNA, 293 bp, Homo sapiens
ctatgttgcccaagccactctcccacctcggcctcccaaagtgctgggattacacacgtgagctgctgcaaatctctttttcaaaatggacttattttggagagtgttcaaagctacagaacagttgcaagaatatcacagtaaacaccttcatgctctgtcctagaccagcacccaacaatagtgtagccgctagctacatgtggctattttcatttaaaagtacatgaggccgggcgcggtggctcgcgcccgtaatcccagcactttgggaggctgaggcaggtggatca

SEQ ID NO: 119955 - DNA, 121 bp, Homo sapiens
gtcactgtcaccttgctcaggtctttgctcaactggaccctgtcatttccacctgccctgaccaacctatttaaaattatcacccagccaggtacggtagttcatgcctgtaatcccagca

SEQ ID NO: 119956 - DNA, 409 bp, Homo sapiens
tcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggac

SEQ ID NO: 119957 - DNA, 313 bp, Homo sapiens
catataaacaaacaaacctttactgaaaactaatgacgaacacaaagggactatttacagaaaacagcgtgcctagccccatctagattataaacataactgcacactggctctaaggaccctgccatcttcccaggccctggcctggctgttctgccactccccacctcatgcctgaaactgacacaaaggaaccaatcctccagccaaagtaagcaattacaacgtgtagctgaaattcagagaggtgatctaaaaagcaattttgtaagatagctccaaattgggaagaaaacaaatttttgtattttat

SEQ ID NO: 119958 - DNA, 1076 bp, Homo sapiens
  misc_feature (20)..(20): n is a, c, g, or t
attaggcgcgttctgcgtcnagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcgaacaaatagtggagaaagatgaaggtccatattatactcacttgggatctggccccacggtcgcctctatccgggaactcatggaggagcggtatggagagaaggggaaagccatccggatcgagaaggtcatctacacggggaaggagggaaagagctcccgcggttgccccattgcaaagtgggtgatccgcaggcacacgctggaggagaagctactctgcctggtgcggcaccgggcaggccaccacgcagaacgcgcgtgatcgtcatcctcatcctggcctgggagggcattccccgtagcctcggagacaccctctaccaggagctcaccgacaccctccggaagtatgggaaccccaccagccggagatgcggcctcaacgatgaccggacctgcgcttgccaaggcaaagaccccaacacctgtggtgcctccttctcctttggttgttcctggagcatgtacttcaacggctgcaagtatgctcggagcaagacacctcgcaagttccgcctcgcaggggacaatcccaaagaggaagaagtgctccggaagagtttccaggacctggccaccgaagtcgctcccctgtacaagcgactggcccctcaggcctatcagaaccaggtgaccaacgaggaaatagcgattgactgccgtctggggctgaaggaaggacggcccttcgcgggggtcacggcctgcatggacttctgtgcccacgcccacaaggaccagcataacctctacaatgggtgcaccgtggt

SEQ ID NO: 119959 - DNA, 377 bp, Homo sapiens
ttatttctttatttattgaaaaatctttctgtaaattagcaaaggcccagtctcaataaaagaccgatttcatatcacccaatagaatgttttacatccacatcaaaggcagcagcttttgggttacttcactaactctggacacccccaaaacataaatccgcacaaataaactccaaagtgagccctctcagaagaaaagcaagatttgaccaagaaatgaatgctgactttctagaatgcagaaatcctcagagttcttaacctggctcccgcggactttcaagacatccacaaatagaatccaggagtccttgcacttggatgggaaatgaagtattaccaatacctgtgactttgttggcactgggaatcac

SEQ ID NO: 119960 - DNA, 618 bp, Homo sapiens
tggcttcacacgggctatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccacc

SEQ ID NO: 119961 - DNA, 445 bp, Homo sapiens
cggtgtctggccgggcctgtcaccgggacgaagctcctaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccacc

SEQ ID NO: 119962 - DNA, 577 bp, Homo sapiens
aacagtcggtaccctgtaacatctatgagtgaatacacagttcgctgcgtgtttcttttccattttattctttgtttttgaggtgtctcactctgttacccaggctggagggcagtggcatgatcatggcttactgcaaccttctcctaccaggctcaagcaatccttccacttcagcctcctaagtagctgggaccacaggcacgcaccaccacactcagctaattgtttatatttttggtagagatggggtctcactatgttgcccaagctggtctcgaactccaaggctcaagcagtcctctcacctctacccccaaagtgctagggtaacaagcatgagcaactgctcccagcctgcatttttttcataataatgtatcatgaacatcagattagtaaatactagtataaaacatcctgttttgtttttctaatttcttgacaaacataattttatataagtaatattatgtcatcctggcagttttttattgtcctaaccttctctctccctaccctaccactggaccatttcccacacacacacatgctagttaacccgtgtttctctcct

SEQ ID NO: 119963 - DNA, 517 bp, Homo sapiens
agtggccgaagtactgtctgagacagtggctctcaacccagggtgattttgccctccaggggatacttggtagttgtctggggacatttttgatggtcatgattgggggtgggcaggagccagggatgctgctgaacatcccgcagtgcacgagacaggcctccaccacacggaattaccttggcctgaggtgttacgagagcacagagagaaaccaggtacagacgcggggcagaggggagagagggagagagtgtgagagctaaggtttcgggagaagactttgtggaaaaagtctttggctgggtcctgcaacatagccaggattcagtgacaggtgaggaccactccagattttgtatgtattgaaggccctgaatacttttttgaaagagaatgacatgagtacacctggtcagccacacgtgagaggggttggaggagggaagtaccagaggcagggagaccaggtagaaagacctcgccatagtcaggctgaaggtggtggaggcccaga

SEQ ID NO: 119964 - DNA, 922 bp, Homo sapiens
  misc_feature (568)..(568): n is a, c, g, or t
aatatgagaattcgaaagcagtggggaagtgatgttggacctatcacagcattgctaacagacagcctattacagtatttaataaaaacagaaacagcatgcctatcataggctaataaatcctacctcctgcacgctttaaaacagtatgaagcagctttaacggagctccagataactaatttcaagcatggctgtctagcgtgcctgtcactcctattgtccttccaaactctttcagacattttgagcagggagtattaaagctatgagttagaaagggttgtgacattaatggtccacaaaggctttaggcacaagaggtaatgatgattaccggtggctatttggaggactgcaccggatcgctgtcattaaaaattaagcgtggcttttgaggaagatgtgacaactaccggaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggnccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaactgctccttcagctgtggtccagactgctggaaacttttctcagtacccctgctccaggtgtaccgttaacctgacttcttccggggaaaagttctccttctaccaacagaagaaacattaaaatcatcaaagtgtcctaatataac

SEQ ID NO: 119965 - DNA, 706 bp, Homo sapiens
ggaacagagacaaggctttgttccagagcattctggtccagaggaatagacagccccaccttcagaggcctgtcctctgtactgcactcacggcatgcgccttgccatctgttcaactaggaaagagtaaccatcaggcaacaatgcctcaactccctgacccaccttcctccccacaaatgtcagtatttcttttatctcctagagactatgaggaaagctatggactctcttgcctaaaaacatacgcatgtgtttttacatacacacaggcacacacacatgcagtgttatacatacaacttcaggaggttaggaaagctctagatcccatcccaataccacttggagatctctgaagcccaggttaagacccaagaccctgttctagactctaagcacacctccgaaagggcaaatcaaactaggttgtgtcctacaagataaagctgaagctccttatcatggcagcgaggccttctgtgatatagattcaacctatatttccagcttccattccaaatactgtccatgaatcctatgggctatgctcactgaactaatgctaaacactccctggatgaggcattcctttcttgcctctatgtcttttcacatgctatttcttctaacagaactgttttaccccactacatcaaatttctatttatccttccaaatcctgcccaaatatcatctcctccag

SEQ ID NO: 119966 - DNA, 729 bp, Homo sapiens
ggcgatcgtggggcccgcgaagtgtggaggggatctgttgcctcagctagtttcaaagactgcgaccctgttttgaattggcttgtttatgttgcgacggtggctggaagccaggccaacccagggtcagctttcccaaatcagtcgccaaggcccacgagaacagtagtttcagaactcccagaaataggttcaaagatgcctgtcctgtaccagtcctgcccagcctcgtttttccttaccaccctgactgcagtcttaactcctgcaaactaatttgatcgctctaagtttaaccgcgcccagaatttcacttttgcttgcttggcctttgctgtgggtcacaacagcccttcttgccttcctcatcttcgtggggcccaggagagattacagaatcatagagtttggatctgaaaggaatcttagaaattccttctcttaccctctcgttttacagtaatgacccagtaagagaaatgacctgttgcatacaaaggctttcacttaccgaacatgtctttactgggtaagaatcagtgtaactcactcaggtgtggtgtttcggttgccttgttaagatcagacacagttggcgggcgcggtggctcacgcctgtaatcccagcactttgggaggccaaggcgggcggatcacgaggtcaagaggtagagaccatcctaacacggtgaaaccccgtctctactaaaaatacaaaaaaatgagctg

SEQ ID NO: 119967 - DNA, 486 bp, Homo sapiens
ggaactgaccaaccaattagtgagtcagccagcagcccctgcttttagttctcttccaaatagcttgtacatttatttctctccaaaatcttattggtgacctcttagcaagtttctctatgtgcctaaattaattctgacttcctataaatattttattcaattagcgagtgaacaaatgaggcgtacatgggaggctcatttatttttcaggccaaaacatgaatctataatatggtgatcccactcattgaggaaatccatctattccttctccatactcacagctagtgcttatctttttaaaaacaccataatcttcagcatgaaaataatctcctaattaacccccagcttccagacttcctctactccagttcattcttctcacagtagccagagtaatttttctacattgaatttttttataaagaaacttccatagtttttactctgttatatttaataactaaaatatatgagtgg

SEQ ID NO: 119968 - DNA, 188 bp, Homo sapiens
aactccagcaaggcagcaagccagggtgatacaggcttcccagttttcctttctccaccgcttggggattattgtccttcataacttgatatccagtatgtaggaaaccaccgtttcatagctgttgttgggtttgtttgtttttttgagatagagtctcactctgtctcccaggctggagtgcaatg

SEQ ID NO: 119969 - DNA, 413 bp, Homo sapiens
cactcgggcccagttctgtataaaattaggtttctggtgagcaggactggtttcaagaagcaggaactgggttagacaagccacagaaaagaagcttctttaaattaatttttgaaagtttagagggagaaaattcagtcaatgggatgtttatctgcaagaatgtctgatatcacctggaatcatgtatctgggagtctggctggattttccacttttttattagaattctcaaatggcttatcggtgaaatttgtaagagagtctcaattttcctgttctgtgtcctgttctgttatgaaaccttaggatgagctcaggcaaaccacagggtagctgagaaaatgggaatcccttcttgcttgtttattttgtcaacattctttatcctctgcatttcaagatgcaggtgt

SEQ ID NO: 119970 - DNA, 277 bp, Homo sapiens
gaacctgggaggcggagattgctgcgagccgagatcatgccactgcactccagcctgggccacagagtgagactctgcctaaaaaaaataaataaaaacaatgtggctgctggctttgacccatgggttatagttgtttgctgttttagtagattcttcaggcagactcatgattccaatatatgctaagttcctccatctctaagactgctttgatactggcaatactttctttttaagaaaattttttttgtagagacagagtcttgctttgttg

SEQ ID NO: 119971 - DNA, 818 bp, Homo sapiens
cttgcccgttgccatgggcgttttctatgttgacacaagcagggacacggaatcccttgactttgagttgcagatcgtgggtgttggcgtctccgctgctttaccaggaaggatggaaggggcttcagcctccattctcactttccttctcaaggagttggctaagcatcaggagttttctcttaggcttctctcaggtcccctttccctgagaggtgaaaagtttttcagaaaggtgagcagctttctctttattcccagggaccacttcacacacccctttttcgcctccagagtagatggaaccgtggaacgagggaatcctgccctctggttgtgtctgtcatctcctactgggaccagagccacaaaagccacaaaagacccaactctctccagcgtgcaggcatcccaactagaggaagcaaggaggcagagaccaagaggacatcaagaggcgtttgaacccgcagagagggcctgggagcacaatgctgagcgtaggtccaaccactgcttctcaatggggtgggagagcggcgtggggagagttgtgggcatttagggcaggacagtgccccccaccccacttgggacggggccgcattgcatcatcactgtaacagcactagctgcccctgcccccacaacccctatgtatgaaatgcaagtagcacctccccatctttgtgacaacccaaaatgccacctcctgtgcccaagcactctctagtgaggtgtttccttaggttaaaaaccactgttagatcatttcctaaaatatatctcaaaagacctcaattagttccttcatatat

SEQ ID NO: 119972 - DNA, 500 bp, Homo sapiens
gaacgaggccaccacgacagaggcttaatgtgagggctggggcacaaggacagttacaatctttcttagggcatggatataacaaagtgtcagtttaagtgataccagctgccagggtcgcctggggtctgtggtctcttaaattccctacaactagggcctgacatggactggggctcctgaggcagcctgaacctgtagaaatgggagatctggggcctttcgtcacacaggggcctttagatgttttttggaggcagctgcttgcgtggatgagaagcagaaaagatcaagagttactcaccaccttgcataaagacacgtgtgcagagctcttcatcagctgtaaagagctgatggttctcaggggaaaaccagtcgctcttggctaatgaggccctagcagatgacaatgtggaaaatgagacaaaggaggccagtctgcccaccgcgaggctggtagacagcatagtgacagtgtggcatctgaccctggccta

SEQ ID NO: 119973 - DNA, 277 bp, Homo sapiens
cagggcttcttccactccgactctgttagacacagtttgttggcaaagtcttgtttctctaatcccaaagttgcctaacaggccccgaaaggaaaacacaggagcagggtggccataggaaagggctcccttccagtgagccagttgctcaagaatcacttttctcactgcttcagaggaatctggctttttgtatcctgctgtcttacccatttggtcagggctcctggataagctacctggggaacagagtggggcctctgcctaaattggcaca

SEQ ID NO: 119974 - DNA, 667 bp, Homo sapiens
caagcagcaaaaccccaatagcaaggagcacgtttaacgctcacatctttgcttctcaaaatagctcaccactaagaagaaccaaggctctttgaaaaaatggtttgttccagggaaggggcagggaaaaaataagaatagcctagaacatcttgtaccagaaagtaaggaatcacttaaagaatcatgagatgcatcaaaaaggacataaaaggcagtctgaagaagctcctactggccaagtctgggacattttaagcatgaaaatcgtaaggtcgtaatgggtaatagctttctgttaatttggtggaactgatttttaaaaagtgaacaaataaatggggacaagagaaactcttctttacagtaaattttaacttgtaaatgtagaagaaatgatggaactgaacattttcatttggcaatcacagtactagttaattctgattacagaattgagacatgttaatattagcgggtgaaagagaaacaacaggatatttacatagtctcaaagtatctcatccgaaaacatttattacttttatagactttattaattttaaagaaaaacaggacaagtttatagtggagaaagctggcagatatcattttactcaagtgatcaaaattaacattaccagtggtgtcaccagttgacataaat

SEQ ID NO: 119975 - DNA, 633 bp, Homo sapiens
tagctttcctgtatattaggggaagcttagaggggaagaggggagaaagacggggcagtggcgagagccgatgggtggtagggagaaatggaagtccagctgtccaaagtgggcactgtcctaggcctaagatgcctccagggagctgttgcccttaaaggggagctgcctttgtttatatgatcgtcctgggaagatttgggtgtgatttctctcctccttctccctaattgccaccccccacctcatttattgagctttcgcctaccacgtactgtactggggtctgttctgagagcctcacaggacacagggagctcccaggctggaaggagaatgccaggcttgatcacccatgccgttgggaagggagtatcctctggtgaggggtacagtcctgaatgaccccagtcagtcctttctatggagtcaccaccttgcatagtgctgggcctgtggtagacatccaataaatacttactgcatgtatgcggtaactagcagttttacttttgcgagtagctgggagtttttcagagtttcatgtggtgaagaaggtggatgatgaagctgggacaggatgttttttggggtcacagattagtgttcttgtatacttgtcaatgggctctt

SEQ ID NO: 119976 - DNA, 393 bp, Homo sapiens
tatgggagaaagttgagggatagcagataatcattatttttagggaagaggaagagtcagggatagctacagattggtattagcaatttgaggagatggaaaaggtttgcaaggggcactggggatgggtccaggagtggattagagatgtagaaactgattgatttctaaacaatatagataacccaattaaagttgttgaataatgtcagctgtagccaatgttggcttggtctctttgacataatccagttttaggtatttgaatactctataaatacaaatacatagactgaagcacaattttaatttttttctatcttttgcctaggtctgtatgattgtataggacttagagctttttgtcctaccaaattattaatttctttattc

SEQ ID NO: 119977 - DNA, 783 bp, Homo sapiens
ctaagtttactgtttagcttactttttttgtagcaagattttgatgaaggacgcaatatgttgatttacagtctggtacaaattttgatgtagaagatgcttccaatatcctggtctcttagttccttgatttcttctccagtgatcttattttctaccctaactcaactacatattcccattgtcatatcctagaatattttgtcttttatctgtaactctgctctcttcccccaatctcatttcaagcatcccactttctaattcctctagtaaatacgtcagttccaacagcccatcaatcccattgggacctacagtttatctatccaagcttttccctgttcctcaccctcacttctatacagctgaagtttcatactgaattataatcactttctcgtatacacgtttaacaatcttgtccctccctggcttcatgcccagtgatctcttgtatctatgaccatgtcctttatcttctcctctgtcactggatgaactgtagccttccaagataaggccactcagttcatttgtacagcagattccatcccctcttgctctcaagaatattactgtggtatctctcttttcttgtctctactggctctttccatgagcaaacatggtattatcccattacaaaaaaaattttttctccgtctctccttccactcaccacctcagtctctgcttctctttcccgcaaaataaccttgaaaaattgctttatgtactcccgttttcttttgaacccctgccagtgaccaccacgttata

SEQ ID NO: 119978 - DNA, 471 bp, Homo sapiens
aacagaatttggaaatcaacattttgcaatctccaatgattgatttagataaggatcataactggatgctatgtcctctaggtgaaagttacacttgcaaagtgtggctgacaccatctgaaccaagtgaacaaatttaacatcatcaatagtgggacaatctgacatcatgtgcctagtaagatgatgcagtgcgttatacatggattatttatgaaatgtcctgctagaagtgtttatcctgaatctaatcgggctccagcttaatttaaagtctgtgaaagttttaaaatatattacccatttccctccaggaagatgacctcaatttatactctcagcagcgtagtagactgccagtttccctgaacaagttaattgagaccacaaggacacaaaaatacacaggcagtatgtgagatattcatcaagacaacaactgatctggattcttctcaagacaatgtcatg

SEQ ID NO: 119979 - DNA, 587 bp, Homo sapiens
  misc_feature (329)..(329): n is a, c, g, or t
gcccttaggggccaagcgccatgatatagatagtggtagtactgggtgaattacgctgctggatgatcgagcatgtaatcataatcttatcgggtagtcttcatccatttcaataaggtagtactttttcgtttcaggcaattgtggtggatcttaatggtcccagcggtctggacgattccaactttctttccaagaaccaaaacctttatacgttgtttctctcctccgtgtctgtcctgatgccttgacaagcgagggcaataatgctccgttgtttctacttctcgtacatggaataacgtgtggtgcttcgtgcgtggtgtccnatgtccacatcccaatcctctgtgggcatagtgcgaggaggacgtgggacgtggcatctgataaacagccggtgtatatccgatgccactatgagggcagcatgggaagtagatgctcctcatagtggcttgtcatgggctgacttcagggacacagccctctacaggagttgcaggagcagaagagaggccaggaagtctctagatgtaggccagggagaagggaggatgtttcaacaaatgggcaggacaccccag

SEQ ID NO: 119980 - DNA, 642 bp, Homo sapiens
taggaattttctagattagtttggggcttccatttaattctaaaatgaaaattttactttcagcttcatgcctaacaagcagagtttgatgtacctagtctaacatttttctgacaatttgcagccatcactgtcaacattgaaaaatctgtgttagatagtgaggcttttaaataatgccatcaatatacctgtctctaaaagtcttctatccattctgccatttctaatctagcctaggcaggaaaagcagacctggataattcatcactgtgtctcaagtgtaagtaaactgctttgaaccacagtttatagggggcgtgggtagcctggaaaggatcactctgaaaggagtagaatactctcttagagaaaaagaaagtgtggtagacagaagggatattcaaagtataatggtggtgactgagttatgtgttagaaacagttttgtctagtccgactagaaggaattaacttggattttcaaattcaacaaatattgactgagcaccttctgtgtgcttcaggcagttagtaaactatgagaaaataaaatgtgtcaggtagtgataaataccacagcaataaataaataaataaatagggaaggaagggagagaaagaaggaaagaaagaaaagaa

SEQ ID NO: 119981 - DNA, 919 bp, Homo sapiens
acatacgggaagagtctctggaccaatagaataggaatctgaacgttgataacagtgatttaaaacaaaagcatttttggggttgtggatatctttgagaatctaatatatgctacagattcttccatagagaatttgcatacttgccaacatgcacaatttttgtgatgttaaattatgttttctcccactattttctcttatttcttcccatttaagcagccagcagtccctgtgtttctttgcctgaggggaggtttgagacttggcagaaagctcaagttttctgcaaggcatctctcttcctgactctcagtccccaaagactaaatctaaggcatttgttatgcttaatgtcttgaacagaaaggaaagagggattcttcagacagtaaaaggagacgttttccccagacttaaaagacattcacatggatcaactggacttccaaacatacacaaaagagaacctgggcctaaacttcacattttatatcaaatctaattccaaatagatcacagacttaaatatgaagcacatacttttaggaaaacaaacataaaagttttaagggaaaaaaaatcagaaaaaaatctttgggatcatagagttcttaaacttgacaccaaaagtatgtctataaaagaaaaaattaggctggacgcagtggctcacacctgtaatcccatcactttgagagactgagacaggtggatcacttgaggtcaggagttcaagaccagcctggccaacatggcaaaaccctgtctccattaaaaaatacacaaattagccagctgcttgggtggctgagacaggagaatcgcttgaacgcaggaggtggagattgcagtgagctgaggtcatgccactgcactctggcctgcctgacagagcgagactgtttcaaaaaaaaaa

SEQ ID NO: 119982 - DNA, 403 bp, Homo sapiens
ggggcggggaggagaccgcccaacagttctttttggaccccccaagggtctccttcttctagtccggggggcacccctttcatcctgcgcccgctacgagaccctatctgtatcccgggagggggagaggagacccccacaagttctttttggacctccaagggctctccttctccgtcttgcacgggagggcacccctttcattccgcatcccgagaccccatcagcaccccaggccaggaggaggagacccccacagtcctcaacccctcagggatacgtcttctgcaccccgggtcggagaaaggctggcttccctccatgtggcagtgggtgggggcacccctcttcattccgcattcccaaggcaccccatctgcaccctggacgggggaccctccgc

SEQ ID NO: 119983 - DNA, 168 bp, Homo sapiens
cttctagacatgctttctttggctcaaacactaatttttaaaaatgtaaaccaacaatttaaaatccagaaatttggattttgctttctcttgaaaatgtgcagagctggtcacaccaagtcaggccctccatggagacaacggaacagtgcagcacagctgcagcca

SEQ ID NO: 119984 - DNA, 854 bp, Homo sapiens
tgcgtctaaagtaagtattgacaacagcttgcatttattaagctcttgcaatgtgtcaggcctggtgctaactcctttacatccattaatttaactctcatcgtatgtttataaagtaggtgctattattctgcccattctaccggtaagaaaattccacaactaaagagaagtaacttgcccaagaccagacagctagtatatactggagtgaaatttgaacccatgttgttttgatttcagagcccagactcttattcactacctgcagtaggatatggcatgaaagtgtattaagctggtgttaatttttcttccccacatttgatcattctttttagactgctgagagtcacgcaggagaacttagcatcactaaaccacacactaaatctatcattcaataagggtgttcttggcactcatgttggctgaatgtagacttgatacttgtgacaagaaaaaggagaaacatatttaatgtctttgatgtgtctacatttttatgtagttataccagacaaacattgtcacttcctaaaagtagaaaaatgaaattatattgtggcttggcaaattggccaaggctcatgtattacatcaacacaccttaatgaatagaagagaagccaaaaggtactgaacacaggggcaaatattttattccctcaataaaggggtatcattttgttcattttagagatgaggaagtcaaggctcagaaaagtggtttgctcaattaccaaagagtcagtaagtggtagagttaggatttccacccacatcttttggttcaaaagtctttactctttctattacatcctaatgcttttcattaaactcaatttcctgga

SEQ ID NO: 119985 - DNA, 308 bp, Homo sapiens
ggttgcatatgtaagcttttatgtgaatttattctctgaggaatgaagggtgatcagataagttctcaggcatctcgtctcactgtatttgtgactccatcattactattaaagttgcttccccctacgccatcctttcaccccaaaccatacccattccttcatcatgcccattgtggtggaacatgatgaaactattgggaaacttaagtgttgagggagctcatgttctaagtcaaaggaaaaaacacataacacaatactttttttcttttcattaaaaaaaagccagtccctaacatagctat

SEQ ID NO: 119986 - DNA, 151 bp, Homo sapiens
ggaagaagtagatgataagcaaataaacaagaaaatgctatctagatgcgtatctagatacacataaggcctgtgggctttcctgatcaagggtcgaggaaggactctggccaggtgaggtggctcatgcctataatcctagcactttttt

SEQ ID NO: 119987 - DNA, 837 bp, Homo sapiens
aagaaatcacaagaaaaaaattaaaatattttaaaataaatgaaaatacaacttatcaaaatttatggaaggcagtgaaagcaatgctcagaggggaatctataggattgaatacatataacaggaaagaataaacatctataagatctgaacttatactttaagaaactagagaaagaggagcaaatgaaatgaaaagcaagcagaagaaaagagataataaatatagtagaatatttattatgtagagtatataatatactctacataatatatattctattctatattataaacatagagtagaaaccaatgaaattgagaacaggaaacccacagagaaaaatcaatgatgttaaaagctagttctttggaaaaaatcaattaaattgataaacttctagccaggttaatcaagaaaaaaagagacaacaagttactcatggtagaaatgaaatgagaggatttaactacagatcccatggacattaaaaggaaaataaagaaatactatgaacaactctatgcccacaaattcaataacctagacaaaatagattaattctctaaaaggtacaatctatcaaaactcacacaaaaagaaatacacaatctacataagcctatacctattaagcaactgaatcaataataaatttccaaaacagaaagcaccaggtccagatggattttcttggtgaattctaccaaacatcaaaggaagaaactatattaattatctacaatctctttcagaagacagaagcagagggaatacttcctaactcattctatgaggccagcattaccttaatactaaaaccagacaaaaacact

SEQ ID NO: 119988 - DNA, 335 bp, Homo sapiens
gatccagttttttctctccattgaatgtgcagttttagttagaattacactaaagggcacttatcatttatcgtatttccaagttcttgtaacagatatgtatagagaaaacgttggctctcaataggatattttactgttagtttgtaatcctagcttatgttattttatcaatactcaaagggattttcatatcctaaattctgggaactcttagtgtgccaggagcttgagtaataagtgtgcctaaaaattatttgtatctcacttctccctcattcattcattcggtaattagtggtgataaagactgatgtgggctgtgccctcaaagt

SEQ ID NO: 119989 - DNA, 278 bp, Homo sapiens
ctattcccagaagaaagaagcaagaatcttatggggattgattaacatcatgtgtgtcaagttcttagcaccatgcctagtacatcataagagctgaaaaatcagccgttgcatattaacaattataaattggaatggctgatagcagatcaataatgtaaactattccaaataaaaagctaatgatgcatacacataaatgagtgtaataaaaattagaaatacgaataagattgttggactgtatcagtgtcaatatcctggttgtgaaattacac

SEQ ID NO: 119990 - DNA, 292 bp, Homo sapiens
tttccagtactatgttgaatagaagtggtgaaagtgggcatccttgtcttgttccagttctcagggggaatgctttcaacttttccctgttcagtataatgttggctatgggtttatcatagatggctttcattacttttaaggtacgtcccttgtatgccagttttgctgagggtttaaatcataaaggatgcttgattttgtcaaatgctttttctgcgtctattgagatgatcatatgatttttgtttttaattgtttatgtggtatatcatatttattgacttgcgta

SEQ ID NO: 119991 - DNA, 438 bp, Homo sapiens
gggactaaaacagtcactcaacaaacatctggccagagcttcctatgaggaggataccaagtcaggagccacgggaagtcactcatctgtggatccaacaagcatgtggagaacgcctactatgtgccaggcactgttttaggtactggggttgcactgctgaacaaaacatctctgggaactcaacttctaacatggggttggaggcagggcacagagacagtccctaagcaaggtaaaccatacatcaggtcagaggtactaaacgctctggtgaagatacggcagaaaatgaactcccagagctcaaaggccacttggtggtgtgcacaggcctctgctccagcaggtgggctgtatgctcaccaagagccagtgggtttgttcccacgccgacttggctgatgtgtacttgttactgtaagtgggtaaatgaaa

SEQ ID NO: 119992 - DNA, 398 bp, Homo sapiens
tttgtcaaaaagaaagttaacagttcagccacaaagcagatattatatatacatgtacacacactgacattttttaaatggccaacacatgataacaaaaagcagaccaactcttagtcaataattttactgattttaaattccctaaagaaaatgcactttgttattgcctgaacctggggtagacctcacctttcacccccagccttaggtacactactgacttttggggttttgcaatgtttatgtcatcacctaggtcaagttacataaggtttggctttgtgataattcactgaatatctcctataccttatgaagtgtttgccatgcttcactgtggcatagtttaaaaagccaatgagtatctacacctcttgatttaaaaaagtggtaaa

SEQ ID NO: 119993 - DNA, 304 bp, Homo sapiens
cacctcccccgactcagcaccccttggaagtgctccttctggggacctgaggagggcataggcagcatggcccacgtacccacctctcaagagaggcctccagcaatgcctccttttagccacaggccctgggaccggtgagccagggcctacagcagcccacatggacacatggacacatggaaacgtggccacactgccacagagtcaagagcccttctccctgctgagcaggctaatgccttaatccctttacacaaagcctgctgattctttcctcggcggggggaaagtggttggggca

SEQ ID NO: 119994 - DNA, 482 bp, Homo sapiens
tgatgctgctgtcgctctagagatccccactagtccaggaagtgcacagagcttgacgagaccatacctacacctgtggtttcaggtactcccggtcggtaccggagcgcgggttcgtagtcagggtcgtagctggatgacatcactgaagaattccttggcaagcagtcagtcagccacctttgggtagtccctactttcacctgggtcgctagggttggttaatttttaataccaactgagtgacccatccccttctccaccttgactgagtcctgaaggccccctcaaaagctaggttttagtgccctatttcatggtacaccaaggagtgctctggcaccatctagagcaagccctagtcatctgcatacctgagcgaagtcttccagcccctgctggaccctgttggaaacaatgtatcctctcttggacacagtccatgccttagacctatactccaaggagcacaacctgaccag

SEQ ID NO: 119995 - DNA, 809 bp, Homo sapiens
ggctaggaagtagaagatcaaagcactggcaggttcactgtctggtgagggcctgttccttatagaaggtgccatctaagtgtcctcacgtggcagacgggatagaatgggtgaaaaaaagggggaagggcatgtaatcccattcatgagggcagagcactcatgactcaatcacctacaaaaggtcacaactcttaatactattggattggggatacagtttcaacatgaattttaaaagggacaaaaacattcaaaccatagcacaggataaagggaaaaaagactatacagacatttcatagtcaaactacagaaaatcaaagataaagaaaaagatctagaaaaaaaccagagaggaaaaatgctacctatagaggaggagagataagaattacatctaggttgggcatggttgctcatgcctgtaaatcccagcactttgggaggctgaggtgggtggatcacctgagatcaggagtttgagaccagcctggccaaacatggtgaaaccctgtctctactaataatacaaaaattaactgggtatggtggcatgcacctgtaatcccagctactctggaggctgaggcaggagaattgcttgaatccaggaggtggaggctgcagtgagccgagatcgtgacattgcatcccagcctgggagacaagagccaagctctctctccaaaaaaaaaaaaattacatctgacttctcagaaattatgcaaatgagaagagaatggtgtgaaatatttaaagcgttgagagaggaaaaaaaacccaccaacctggaattctgtaccctg

SEQ ID NO: 119996 - DNA, 482 bp, Homo sapiens
gtgatcctcctgccttagactcctgagtagctgggactacaggcgtgtgccaccctgccctgcttctaataacctcttaaagattcctcctcttaacactatcacaatggcaattaaatttccccatagttttggagggaacattcaaatagtaacatctagctagaacagcctatctgttggcagaatgaagtagaacagtttagtgggaacaaggatacaagtgtatttttcatggaccaaatacagactctggaaaggatacggttgtggatcatcgggaaaagaacttcacgaaagagatagatgcacagatggatagtgaaggtcaccctggtgaaagccaaggactgaatgcagttcttaaatggccagttgtggaaagaatcatccttataaaagaattgagataggagatctctaatagaggaggagttctctaatagaggaggagttctttgtgaaacccacagaaatccccc

SEQ ID NO: 119997 - DNA, 345 bp, Homo sapiens
aatgaattgcctcttaccttccttaacccttatagcatccagcctacctgttcctgcatcttgttttcttgtcatattaccaagagttgccacatattggctgctgacctcatgccaggtgctttacatacattccctcatttgttactcacatgatatgcagaaccacaacattttacaagggagaaatctcacattcagagagaccacaatgttagtgaatggcagggctgggatctgaccccctgatctgcttgactctaattcttttgagtctactcctttaatgctcatctcaaatgttatcccattcaggatctaaatttgaagatcttcaatgtagaa

SEQ ID NO: 119998 - DNA, 223 bp, Homo sapiens
gtctcattagagacacaattatggggttttaaggctttcagaattgacaaggacaagttttggcagaggttctatgtttgtaaaccatttaggactgcaggaagctctgtcaccccatgtcttggcagtaagccaaatagctgcttctgtttcctcttcctaaagcctcttttatcccatacaagcatgtacctgaaacttcaagaagcccctctctagcctc

SEQ ID NO: 119999 - DNA, 461 bp, Homo sapiens
gatggaaagagcggcgaggcgctctcgcagccgtggcagtctggacgaaaagaaccaggtccctttcctggtctagcctacctccctacctctcttccctcatatccagaagaagcgacggagagatggagtttcgctcttgttgcccaggctggagtgcaatggcgcgatctcggctcaccgcaacctctgcctccagggttcaagcgattctcctgccgcctcagcttcccgagtagctgggattacaggcacgcgccaccaccccagctaattttttttttgtgtgtgtgacggagtctcgctctgtcgcccaggctggagtgcagtggcgcgcgctgcaagctccgcctcccgggttcacgccattctcctgcctcagcctcccgagtagctgggactacaggcgcctgccaccacgcctggctaattttttgtattttttagtagaattggggttt

SEQ ID NO: 120000 - DNA, 462 bp, Homo sapiens
tacaaatatttattgagtaattactgtgtgccagatattctaaatatactaggtcgttggcatttattgataaaatagacaaggtccctactcttgtgaagcttacattctgggggatgagggggagaaggcaacaaacaagttttaaaaatatagatgagctgggtgcagtggcacgtacctatagttttagctactcgggaggctgaggtgagagactgtcttgagcacagcctgggcaatataagtttgtccccatctccaataaaaagtttgggccggggccgggtgcggtggctcacgcctgtaatcccagcactttgggaggccgaggcaggtggatcacgaggtcaggagatcgagaccatcctggctaacacagtgaaaccccatctctaccaaaaatacaaaaaattagccgggcgtggtggcgggcgcctgtagtcctagctgctcgggagg

SEQ ID NO: 120001 - DNA, 591 bp, Homo sapiens
atccccggtgtttatcgattgccacgcccaatccttctcagatacatgggcagtggctgctatgccatgtacctcggagaggaggacactaccttgggggcttctgccaggcttgagacatgctcaggtgtagagcgcggctactcactcaaaagtccaggctcagcaagtcatagaatatctaggcagggcaggacttctaccatggccaaggccacttgagaggtaagaaaggaaactggtgcccagggagggtaagcagcttgcacaaggctacccaaggagatgatggccaagtcagagttgggaccacagagaaaaggatgacacaggctctgtccgtaaggtgtcatggtctggttggaggagagaggcgaggtaatcagctatgaaagctcagggttaccgagtgttccagtagaggtgaaggaagcttggggagcctggaaaggggcaccctaccccgccaggagctgtaggagaaagagggaatgagggaggaggcgtctagctgaaaccatggtgcaggagtggagtcagtgggatatgaaccagcggggtaagcagacttagatcatggtggcatcgaga

SEQ ID NO: 120002 - DNA, 580 bp, Homo sapiens
tctcgatggcattgcatcttcttagcgtagctcgactctgtctgcattgtcataggctgtctgctgatgtgaactctgtccttggataagttctgccaggcttgagacatgctcaggtgtagagcgcggctactcactcaaaagtccaggctcagcaagtcatagaatatctaggcagggcaggacttctaccatggccaaggccacttgagaggtaagaaaggaaactggtgcccagggagggtaagcagcttgcacaaggctacccaaggagatgatggccaagtcagagttgggaccacagagaaaaggatgacacaggctctgtccgtaaggtgtcatggtctggttggaggagagaggcgaggtaatcagctatgaaagctcagggttaccgagtgttccagtagaggtgaaggaagcttggggagcctggaaaggggcaccctaccccgccaggagctgtaggagaaagagggaatgagggaggaggcgtctagctgaaaccatggtgcaggagtggagtcagtgggatatgaaccagcggggtaagcagacttagatcatggtggcatcgaga

SEQ ID NO: 120003 - DNA, 240 bp, Homo sapiens
ctggtctcgaactcctgagctcaggcaatctgtccacctcgacctcccaaactgctaggattacaagcgtgagcacccagcctcatacttatttttaatatttaaaatgattttgcttttcttgtttcttagtgcatgtaaagaagtatctttgcctgctgtataactgtgtgtatctcattttcctcacagtacttattgattccatttacaaagtgactgagggccggcagtctgaaa

SEQ ID NO: 120004 - DNA, 414 bp, Homo sapiens
tggttttgataactcagactaagctcagggttatcctactgtctcaaggcaacagacacatactgaacctcaggagctaagaacagagatgacttcatggcccctgccctcaaggagctccctctctcactggcatggaggagatgcctctgaaaacagccagaaaacaacaggacaggtgtgtacagtgcagcacagggacacaaataaatgaagcagcaacagggtactgctggtgggcaccagtggtaaggagtccacggcgagccagtgcacgctatattcaaagaacagtgagcagacaagaatggccaaagggaactatgttcccccaaagtttaatccctggacttacatgtgatggtgatatatgaaccatttttatttctatcaatagtatgtacccactttcat

SEQ ID NO: 120005 - DNA, 397 bp, Homo sapiens
ggttgctgaccacaggccatgtctagagcacagactatatcgtcacgttactctgttgtcttctcattgttcaattcagcagcattttagaaggcccgctgtgtgctctgcactgtgctaagtactgcgagaaacagaaaagttgaagacgtggttattgtctgaaatggcagctcctgggaaaaagtgccgtagaaagaggagctggctatagaaaatatggtaatttctaacctaaaattaatatgcctgtaatcccagctactcaggaggctgaggcaggagaatcgcttgagccccaggaggcggaggttgtggtaagccaagatcgcaccactgcactccagcctgggcaacaagagcaaaacgccatctcaaaaaaagaaaagaaaagaaa

SEQ ID NO: 120006 - DNA, 298 bp, Homo sapiens
cagtaacagaaaaatttctagaaaatcaccaataatcagcaactaaagcacctttctaaataatccatgggtctaatttcaagagaaattaggaagcatactgaactaaatgaaaataaaaatacaacatactggtctttttggaatgtattactgaagagaaaaattataaattaaatacttatattcatttaagctttcactttaacaaaatatgtgcaaagactgtatatactgaaaactttttttttttttttgagacagagtcttgctctgtcacccaggctggagtgcagtg

SEQ ID NO: 120007 - DNA, 88 bp, Homo sapiens
gacccctgccctgcaaccctgtcccatcttgacctgctggaatccaatgtgtctgatttcttccttttgtgttctgactctgtctcct

SEQ ID NO: 120008 - DNA, 338 bp, Homo sapiens
ttctttgctgggcttagagtcacctagctagtacaaactttgaccacttacgtcaaggaacatattatttgttccaaaaatgtaataggtgttatggtattttcaatctctagtctcttttgtaagaataccttgtagatagcacactgtacccttgcaaattaagggtacattctagattttagacgaggaaatacttatgtggccaaaggtatcagcccgatcatcatattcattcatttaatgaatatctactgaatgttaggtgcagcatgttagtgtcagctgtaggtatttggttcatctgtagattttcacaattcttaccataaaatgtg

SEQ ID NO: 120009 - DNA, 860 bp, Homo sapiens
gcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgcccaggctggtcttcagctcctggcctcaagtgatcttccctcctcaggctctcaaagtattgggattataggcgtgagccaccacgcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaa

SEQ ID NO: 120010 - DNA, 426 bp, Homo sapiens
cccctattagttcatgtccttcagcttgattggaatggctcagcaactccatgtgggcagcactgaggaggtatctgctctgggcgaggcctgcgcccgaggcacagacacagatttctccagctttggagaaccatggtctggaaggacatcaacacccaggcactccctattcttcgatggagagtttctaaacaaaggattttccaatatttataaagaaaagaggccgggcgtggtggctcacaccagtaatcccagcactttgggaggctgaggcgggcggatcacctaaggtcaggagtttgagaccaggctgaccaacatggtgaaaccccgtctctactaaaaatacaaaattagctgggtgtggtggcacatgcctgtaatcccagctactcgggaggctgaggcaggagaatcgct

SEQ ID NO: 120011 - DNA, 276 bp, Homo sapiens
tacctcgctaatgcatcggcacaagggcatgactatccagaggccatcttggacactagcttctaccacatgctgtgctgtctttgggaattgctttcggacaggctggaaatagatgggtcttacaaatgcctggctgaaatgtgaagagggtgcaagaaaacatctggggaacgtgaatgtctgagagaagactcaaggaagaggagtcattgaaaaaaaataaatgactagagacaggaagaaaacttggagaaagtggtgccacagaagcca

SEQ ID NO: 120012 - DNA, 153 bp, Homo sapiens
acaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaa

SEQ ID NO: 120013 - DNA, 359 bp, Homo sapiens
tctaagcacctagatattgtatataaagtgcttgctaggaaggcaatatgaaagattttaagtgaacgttcatggcatagtatttacactatgtgtgctaggtagtcttgtatcatacatatgttaatttttcttcttcctagaagcatccccagttacctatccaaatcaagtacactcagttcagctcagatactttttttgcgattttttttttttttttttttgagatggagtcttgctctgtcgcccaggctgtaatgcaatggcacaatctcaggtcactccaacctccgcctcccaggttcaagtgattctcctgcctcagccttcccagtagctgggattacaggcgcccg

SEQ ID NO: 120014 - DNA, 349 bp, Homo sapiens
gcacgaggtaatgcagtaggacaaaatagttgtcaaatacgttgagtcatttattaaagttatgactcagctttagaaagaaaaattgcagctgagagcattttgggaggacaaggcaggtgaatcacctgaggtcaggagtttgagaccagcctggccaacatggtgaaatcccgtgtctattaaaatacaaaaaattagctgggcatggtgacaaatgcctgtaatcccagctacttgggaggctgaggcaggagaattgcttgtacccaggaggcgggctttgccatgagccatgattgcaccattgcactccagcctgggcaacagagggagactctgtctcaga

SEQ ID NO: 120015 - DNA, 338 bp, Homo sapiens
cacaatgctctcctaattcttcttctgctctgatttttcctaatctgtctcctttactgagacccaaaacaggaactcttgagctgaaaaaatttctccagttaagggcagggataacgtgcctggctcacagctcttgattctcatgttcctattttcccagtcatcaccacatgatgtgtttgggttatggtacaaaggtagcaagcactgcaattggaaagaattctgaaatgaattgggaaaagtgctttctctctttcttatataaggcttgttcaaagcagctttctggaatggttggtgatgcctgtttccctagcggtcatgtggtcctg

SEQ ID NO: 120016 - DNA, 498 bp, Homo sapiens
ttgctttttcttactgttgtggttaacactttactcatatcgtttgtgagcccccaccagtctgcagtgtcttaatcttattttaaaaactgtgatcatgggaggctcaggtgggtcataacgcacatcaggttggtcatttcctgggctacataccttgtacagaataacattatacaaacaaggcttttttagagttctagtacacttatgataactgtaaaataataggaccatagcaaccttttgtcctacctcagtgacttgatgtatatactgggaacagtcctcagtctgaggaaggtcagttgaagtccttactgtaaaattccaaattttaaggcaaatgatatttgagaacagttcctttcatttttgggcatctgagaagaatttctgtgctgagaaatagagaggttaattcagtccgaacagattccatgaagcatttgggaacatggaaagaatattttaaaataatacaacggctttgacttt

SEQ ID NO: 120017 - DNA, 790 bp, Homo sapiens
ggtggggcaagggcggagttagttaggtttccttttcctgagtgtgacgcgccttagtgggcacacgtgctagccgggatggtgggaacggggggaagatgaacccagaaatgctgagtcagggtggccaagatggttgcctgtcgccatcttggggccttcaccagagtccaaacaaaaagctaagctagggcctggttctgctcccagtctagcattggaaccacttctaggaacgtttcttgctgagtcagcttgtcatacagatcctggtctacattttgaaccttacttttgaggtgaaaagctcagctaggtcctggctctggtcccagtctagcattggaaccacttctaggaacgtttcttgctgagtcagcttgtcatacagattctggtctacatttagaaccttgcttttgaggtgaaaagtgaaaggcaatggaagggttccgtagacaaaaagggtcgagaggcagggcaaagaatgcaaaagttcctttattaagctcttggacgaggttcactggtccgcaggggagggccggggaagtcgcactgtgttggaggtgcagcaggcttatatggacactaggtgagttaggggcggattcggggtggggcaagggcggagttagttaggttttattttcctgagtgtgacacgccttagcgggctcacgttcttgccgggatggcgggaacggggggaagatgaacccgctaatgctgagtcagggtggccaagatggttgcctgtcgccatcttggggccttcaccggagtccaa

SEQ ID NO: 120018 - DNA, 504 bp, Homo sapiens
caacccaaatgtccttcaacaagcgaatggatacaaactgtggtccattcgaataagggaatattagtcagcaggaaaaagggatgactactgacacccaccatgacacggatgggactcaaacgcaccatgctgagcagaggaagctggactctgaatgctacaaacagtgtcattctgtttacaggaaactcagaaaaggcaaacttttaggccagggaacagctcagtgttgccaggggctgggggtgtggagatttggctgatgacaaaggggcacatggggaccctctgggggatgaagctgtgtgttctgtttgactgtggtggttacacagcaagcccatgacctgcaccctaaaaagagtcaatcagccgggcacggtggctcacacctgtaatcccagcactttgggaggctgagacaggagaatagcttgaacctgggaggcgaaggtttcaatgagccgaaggttgcagtgagccgagatcacgccattgcac

SEQ ID NO: 120019 - DNA, 609 bp, Homo sapiens
ccctggctgacctagcaggactccggcactgctcggatgtgggactatatatagaggtaacagctttgtgtcactgttaaatattctgaatttgattgtagcaatgcagttatataagagaatgtacttatcttagaagatgtgtgctgaaatacttaggagtgaagaatcatgatggctgcagtttactctcaaatggttcagtaacgatgacagcagcagcgacaacaataataatgcatatgttttcttttggtttttgttttttttgggatggagtctcactctgttacccaggttggagtgcagtggcgcgatctcggctcactgcaacctctgcctcccgggttcaagcgattcttctgcctcagccttctgagtggctgggattataggcatgcgcccgccgttgccttggctagtttttgtatttttggtagagtcagggtttcatcattttggccaggctggtcttgaactcctgaccttaataatgcatgtgttttatgtgtgtatgcattgtcttcttcaaggcatcttttctctccttttctcttcatgccatgctcttttcctaagacctcttacccactgcctcttccctgcttc

SEQ ID NO: 120020 - DNA, 338 bp, Homo sapiens
aaggttagttcccattcccctgctgtggccagggggccccaaacccttctttcactttctcagcttctgtcccctagccaagaaactctctgacccctctcctctccatatcatgtggttgggaggccaggtccttgcttcactgcccagtgtcagggcagggacagtagggaatctgaggccttgctgaagtcacagggctgtcaaggaagggagcatgggggcagcacgtggacttcctgactcccagctcagagccccgtccctcacatggggctgccccatctgggattggcatgacctaggacacagtatggagacccagagcagggtgtggc

SEQ ID NO: 120021 - DNA, 373 bp, Homo sapiens
tagctgggattacaggcacccgccaccacgcccggctaatttttgtactgttagtagagacagggtttcaccatgttggccaggatggtctcgatctcctgaccttgtgaaccacccgcctcagcttcccaaagtgctgggattacaggcgtgagccaccacgcccagtcgatgatgtgtccttttcagttcatcatactgggggacggacatgatgttcatatgtccccttactggtaatgacttgatcactggttaaggtggtgcctgctgagtttctgcagtgtaaagtttctattgttcccattgtgattgataaatagcttgagggagatatttgagactatgtcagtgtcctgtttctccttaaact

SEQ ID NO: 120022 - DNA, 250 bp, Homo sapiens
caacacttaaagacaggaggtaacagaataatgtatccaaaattctgagggcaacagttacttaagacctagaattctaaacagtctacttaacaataagaagcaggagtataaggaatataagagttattcagatacataaaaattcaaagaagtacctccgagcaggttcccaaaagttacttaaagcaatattccaacaaactaaatagaacctgaaaaaagggtgctttgggaaacagaaaacagg

SEQ ID NO: 120023 - DNA, 363 bp, Homo sapiens
gtaacacaggtcataacttctgctgcctgagccctgggaactgttaaaaatacagatggttggtgtttcccatttgtctctttttcttacacttaagttcctttaccatttaagatttataaagtttcaccaacctccgatgagtgattctcagaatcactgaacatataattgaaaacactttataaccccaaagagcaacaggtagagaagttaatataaagcgtgccatgaaacactagagactaacaaacatgaaccactggaatggagttttcttttcagaacagggccagcagggccagggagaaagttagctcctctcctgccatcgaatattaaacacgcgcgcgtgtgcgcgcg

SEQ ID NO: 120024 - DNA, 327 bp, Homo sapiens
agctatttgcaaccataaagagaattcacaagaactctctttgagggttaacttttcctgtttatagtcaggtagtttgggttgtttgcttttatattttaattatttaaagagctatctgaatgaagctacacacttcaaaaacactaaattgcaagtgggaccaaataatggcttccaaggttttacgaatttactaactatggtactacataatacttcttcttgctggcctatcatattctttaaatatttcacttagtcgatgagcttcagatttaagaataagagtggaaaggagagacaagaactaagtttaatgcaaca

SEQ ID NO: 120025 - DNA, 626 bp, Homo sapiens
acttccacattttgtggggacacaattcaacccaaaatgcctccctccctagcagttccagcaaagacagcccagtgcggagcagcacgggctcccaggtactcgccgatggaaggtcctgggatgggaccagcgggactcaggcagtagaccaatgacatctgctgtggcctctaagcccacgagtatatgagtgtattctcctggctacacttccaaggcagtgcaaattgggttaaagctgaaaaggccatccaccctcaagcatgactaaaagattaagagttgtatctcaaaaccaaaagccaagtgtgcgtttgggccacagctccgaccagctcagctgccaagaagttatcagtgcagatgaactgcctaataacgggaagtgcctcttaatggcccttcaaatcatttcattaaaagttgccgtgatgtctccagctgaatccgagtcgtgctgggaaggccattaggttaatcaaaatacaaggacagctcaccatctactcttaattaacaaattaggtcctactgccaactcagcaaaacagagagctggccagcgacccttggggcagtcggaatgatcagaacacccttccatcactgactgccaatcaatc

SEQ ID NO: 120026 - DNA, 360 bp, Homo sapiens
ttccaaggccatgccaaattggtttaaacttaaaaggccattcaaccttaaagcggccacaactccgaccagctcagctgccaagaagttatcagtgcagatgaactgcctaataacgggaagtgcctcttaatggcccttcaaatcatttcattaaaagttgccgtgatgtctccagctgaatccgagtcgtgctgggaaggccattaggttaatcaaaatacaaggacagctcaccatctactcttaattaacaaattaggtcctactgccaactcagcaaaacagagagctggccagcgacccttggggcagtcggaatgatcagaacacccttccatcactgactgccaatcaatc

SEQ ID NO: 120027 - DNA, 206 bp, Homo sapiens
gatttccaccctctgcctgcttacctcttacccctagacctccccacaagctctcctttgaagtggcctcctgtctccccttggtcttctcaaagctggtccaggcattccactgtcacagactctagtggtttctggagataatgacatcaccagatccagctcattctggcgggtggatcaagcactgtttctggctatgctcc

SEQ ID NO: 120028 - DNA, 230 bp, Homo sapiens
ggatgaaaaagaaacatttgaccttgaacaaagccggagctgctctgaatcatctctgagcccaaccagcctggcgtgtgctgtgctttcctcctttaggtgggtgtctggctgcaggcccaaagcaaacatgatcctctcttcaaaggatgggggaccccacttacgaagagcctctttatccctgaatgctccttagaggatggttcaaagatgctggaaggaggtct

SEQ ID NO: 120029 - DNA, 153 bp, Homo sapiens
acggctccatgcctacatgcacaactgccagacacatgcagcaacgttcaacagcccagatgaggaggtaatgcaggcgctcatccaaaggggtacagataagcaaaatcagtgacacctgaaggagaaaagatggcttgcagaaaaacatgt

SEQ ID NO: 120030 - DNA, 468 bp, Homo sapiens
gcttgggccataaaacaaacagtaacaaattcaaaagaattaaaatcatacagagtatgttatctgaccataatgcattgaaactagaattcactaaaagaaagagaagtcaatgaaactaaaagctagttctttgaaaagatcaataaaattgataaacctctagcaaaacagagcaacaaaaaaaagagggcataaattatcaatattactaatgaaagaggggaagttatcactacagaacacatgaacattaaaagaaacaccatagaaatattatgaacaattctaatctatacatataacaactcagataaaactgaccaattcctcaaaagctacaaattgccagaactcgcccagggtgaaacagataaccagaataaccctataattactaaagagattgaatttgtagtttaaaaaaaaaccttctgtgaaaggaatctgcaagcccaattctacaag

SEQ ID NO: 120031 - DNA, 747 bp, Homo sapiens
aaaactctaaaattgccatgtgcatatgtatgtatatacacacacatatatataaatagacacacatacacacacataaatatttcatcaaacaactgtatgtattctctgctttggatttctttaaaatagcactacaatcttgttaaaataagtagaaaatactctaaaatgttaaaataaaagggtgaaaggaaatttataagaacttggagaaatctaaacacatttgaaaattctcatttcaggtattagacaatgttgctgtgtctcactgataagaccaaataagatatgacatgatataaaagtttgggatcaggaacagtttaaaaaagactccgtatgaattgaaaatattaaaagtatatatttttatttaaatatatgtatatattatatgtagctaatgcttacatatggaaaatattttcatgattttttgacataatccagttaaatttcttattttataaaggaaactgttgcagcccagagtctcatctgctcaaaaatagacactcagttagtggcacagttagagttgctgattccaggagcagctctctttagaccaatctcactatagaacagtgtatctttataatagcatggcaatatttgtgccattttatcatttctttttgatgtatgatttttcaatataataaaacctattgatttagagacccttgtatgtattgccaaaataatattcagaaagtgagtgctttctatttatataag

SEQ ID NO: 120032 - DNA, 386 bp, Homo sapiens
attttaccatcatgcttgtagttttaataaacaaaaatcaaatgcatataggcttcacacactttgtgtaattgcttgtttaacatccccaaattccataaatgcaaaaactagatctgtctggctttccattaagtccccagcacctagcaaggtgcttaacaaatagcagatggatgttggaaggaataaaggaacaaagaaaagaatagaagaagttagtgacttgattctatacagagtggaccttgacacatactgcaagtgaatgttaaactaaaagtataatttctttatcagtgaatatatttccatgaattttaagtattttgctgatgatttattaaatatgtatttcactactttcttttcttttaatcagtcct

SEQ ID NO: 120033 - DNA, 356 bp, Homo sapiens
  misc_feature (18)..(18): n is a, c, g, or t
  misc_feature (21)..(21): n is a, c, g, or t
  misc_feature (26)..(26): n is a, c, g, or t
  misc_feature (41)..(41): n is a, c, g, or t
  misc_feature (64)..(64): n is a, c, g, or t
ggcaagaggaaggctganaangatgngatggtgagtgccanattcttcctggccctgagcccanccccagtgtgacactcaacttttaggcatgggagagcaagattgacggcttcaagtgcttcaccaagaagatggacaacagggcactcagctcaacttcacagccaatgagtggtggcaggctttgagaaagagcatcagaagcctgacagttcttcagcctcagccaggccttggagctggaccaggccatccacttcagtatagatgccttccactctgtcagtgagctctttgccagtcagtccaggaaggacctggacccagccatggacctgttagtgctgtctcat

SEQ ID NO: 120034 - DNA, 540 bp, Homo sapiens
aggctggtcttaactcctgggctcaagcaattatctgaccttagcctccctaggtgctgggagtgcggggattactggtgtgagccaccatgcctgtttaaagtttcctattcttgttactttcctcttgacatttgtttttagaactctgatgttggatgtgaatgtttgatgctttctggcatttgcttctgtaatggttcagtgagttttattttccgatctctttatgttttccctctctctctgaaacagtaaggctttttccgtctctttattcttttataatttgagtgtttactctgggtcaggtactgtgcttaactattgtatatgtattaactcaggataatccctacgagaatcctggaaggtaagtggcagtatctttgactgtgtaaacaaggaaactgaggctttgcctacttgagcaaggttttatggtttgcccccaaagctggtgcctcctataaaaataatagctaccactaatgacagtggttctcaaagtgtgggagactccaagggcctctgaagtca

SEQ ID NO: 120035 - DNA, 768 bp, Homo sapiens
caggaatcctcctcaaattctttccaggtcaagctgaagtataaacaaagtagagttaccattacaaaattttaatggggggaggtggtaacaagatttaacacctccaaccccttgtttatcttcacgtttgaaatggagatgtcaaaagttcttcttttttttttttgagatggagtctcactctggcacccacgttggagtgcagtggcacaatcttggctcactgcaacctcactcccaggttcaagtgattctcctgcctcagcctagctgggattacaggcgccccaccaccacacctggctaatttttgtatttttagtagagatgcgttttcatcatgttcgccaggctagtcttgaactcctgacctcaagtgatccgcccgccttggcctcccaaagtgctgagattacaggtgtgaaccactgcacctggccaaaaactgttctttttaaaaattgagatataggctgggcatggtagctcatgcgtataatcccagcactttgggaggccaaagcagaaggatcacttgagcccaggagttcgagaacagcctgggcaacatagtgagaactcgtctctacaaaaaaatacaaaaattagctgggtatggtggctcacacctgtagtcccagatactcaggaggctgaggtgggaggattgcttgagcctgggaggtcaaggctgcagtgagctgtgattgtacgactgcactccagcccgggtgacagagtgagaccctgcttcaaaagaaaaat

SEQ ID NO: 120036 - DNA, 335 bp, Homo sapiens
ataccaggaaagggaacagcatatgcaaagcctaagaagcaggaaaaagagggacatgttcaaggaatcagagaaaaccataggacttggagcaaaataacaaaaagatatagaggaaaagatgagcctggagaagcagatggaagggggattatgcagagcctcataagacaaggtaaagctcttgcattttttcctaagtgtgattagaaaccactgaaaggatttaggcctaattttaaatccagtttgcagtgttaaaaattatttggcagtagtgtggagaatggattggaaaggggcccaagtggacagattaggatgctgtcacagta

SEQ ID NO: 120037 - DNA, 332 bp, Homo sapiens
aactagttgtgccacaggtaaggcagtgctccataaaacaaaataaaacaaagcatagtgatgggagtgtgtcaaaggaatacaggagccaagggaaagagctcccagtggccaaagctggaacaatttgagcaataaaattaatatggtagtattggattataacccaaagtataaaataaatatccatgagtgcatagtgatataaaaaaaatgacagaataaaccaatcaacatgggaaaggagacaaatccccctcacagaggaattccaaacaatgtagctattctgctatcaagaagctggagcctagctccttgctccttaagtg

SEQ ID NO: 120038 - DNA, 561 bp, Homo sapiens
tcgcgctcgttacccgacggatatgcgtatctgcatttcttccatgagataaacttgagccccactaattacttgtttattttatttttctaatttctttttcttttcttccttttttctttttctttttctttcttttttttttttttttttttgagtttgagtttcgctcttatcgcccaggctggagagcaatggcatgatttcagctcactgcaacccttacctcctgggttcaagtggttctcctgcctcagactactgagtagctggtattacaggtacccaccaccacgtccagctaatttttgtgtttttagtagagacaacgtttcaccatgttggtcagcctggtctcgaactcctgacctcaggtgatccacccgccttggcctcccgaagtgctgggattacaggcatgagccaccacgcccagcctgttttctaatttctagtcagatgtcttggcaaagcatgatttgtctcatgggaatacccatttcctcccatagcatacctgatcattgtctgcccacagtaagtgcatgctatgagcttctt

SEQ ID NO: 120039 - DNA, 595 bp, Homo sapiens
cattccaggcagagggacctgcaagcacagaggactggacaaaggctggaataaattcaatgtagtattcaaggaatagaaaggtctttgtggaatactgtatcttttcatggtgggggttgcagttgtgtttaaaaaaaatcaataatctcaaatacttaagccctcctacttcattatactttttaaagaagcagtgtatcttagcagttagaaaacttggattctggaggcagtttacttaatcctacaaggggataatttggccctagatcagaccacctgggttcaatcctggatttttctacctactagctaagtgacgttgagcaacttacagaatcttactgtgccttgtttgccataaaaagaagataataataatcctattgcacagaaatcatttgatgataaactgggataatgaacataaagttttgaccagcatagggaaagtatccaaaatatgttggctattataattcgttccttgtttcctctagaagtttattttcttgatcattgttgccatccttttatcgcaccagccactcattgaacagaattctaaacataaagtagaaaatagtttccc

SEQ ID NO: 120040 - DNA, 1054 bp, Homo sapiens
aaagaattgggtgctttttattttctgtttttgttactttaactgcctggagtcaatgggtagaactaaagtaacttaggagaaccttcataaggaatctgtagcgccaagaggttatccagaggagccagtgtctaagccagcatagtagagggtgaaggcccctgagatatccagttcaactgcatcattttgtaagggatagaattgtagcttagagagaaggaacttatctacggcctcacagctcctttttggcaaaactggggcagaactggggctcctttttggcagattttgtttgcttcattttactggtacagttttatttttgtttggattcaagcaacaaaagcccacaaaaccagcttaaggaaaagaaatgttttgaaactgccagatcagctccaggacttgggttaccaggaatcatggggaactagaactagggtctggaaagtcattaaaaatcagtactgctgtgttctgtttcactttcaacagaggtgaaaaaaaacaaacaaacaaagatacaagaaacgaataacacaacacaggacatgaacacacaaccaccgcttacgaacaaacaaaaaggggggggggggccccctaaatattctgccccactcgcggaggggacagagatttagtaggctagcacaacagctgctctgttgtatagatagaaaggaggggccacgcctatatgtagggaggaggttaatataatgacagagcaggcacgcgcgtgcggcttttaataataacccatgctggtcctagcggaaggaaacagtagtggtcggcggtggctcatgtctagaggagagacgcacactacatctcgggggggggagggaaccacacatgttggagccgcaaaccaccacctaggaaggagtagttagagcagcctgggcggacgtaatattactaactagtcgaggcttattaacggggtgtatacacaagcccacggaatctatactgcggggcaacagaaagagttgtgtcccatgcagattggttgatggtagacaaacacagctag

SEQ ID NO: 120041 - DNA, 153 bp, Homo sapiens
ggtcagagacgacgtgtgggatcctgggatggaattctattccatcatctcagtagaaatgacgtgattatcctggaggagtagaagctgatttgttttaactgtctgagattacatgagaacaagaatcacggtaagccacagggttaaaat

SEQ ID NO: 120042 - DNA, 185 bp, Homo sapiens
cgtgttgggcctaccgcgtgttgggccaacgcacctggaacccttattatcaaatcctttttctccagtggttagagcatggaagttttctgctgtctttggaactttgtctgcaaacagctcaaaggagacgtggctcaagggctgtccatggcctagaacatggtggggttgacggtggctgg

SEQ ID NO: 120043 - DNA, 327 bp, Homo sapiens
gaggacaacccccttgttgttctcatcataatgagtgagttctcatgagatttgtttttttaaaagtgtgtagcacttcccccttcactctttctctcctgctttaccatggtaaaatgtatttgcttcccctttgccgtcttccatgattgtaagtttcctgaggcttcttggctatgccttctttatagcctgtggaactataagtcaattagaccgcttttcttcataaattacccagtctcaggtagtcctttatagcaatgcgagaacagactaatacacaggtgatcaggcctactgtggtatactttaaaaaatacatag

SEQ ID NO: 120044 - DNA, 695 bp, Homo sapiens
agttgtgagccactgggccttacccagttctattgtttttaattgttactctttgactacatcatcaccactaaactattttaagaaacaaaacaatactatcacctaacttactatttcatttctattatctaccaggatcatatattcccttattttttatttaaacttctgtcttttcatggagattgaggaaacaaaagactatcctcctgccctcactgtgggttaactacaagtacatgtatctcatttttcccaatctatatttgattctatttttcctctaactttgaaactttaaaactaaagtttcagtttattttattttattttattttattattattatactttaagttttagggtacatgtgcacaatatgcaggttagttacatatgtatacatgtgccatgctggtgtgctgcacccattaactcgtcatttagcattaggtatatctcctaaagctatccctcccccctccccccaccccaccacagtccctagagtgtgatgttccccttcctgtgtccatgtgttctcattgttcagttcctacctatgagtgagaaaatgcagtgtctggttttttgttcttgcgatagtttactgagaatgaagatttcccatttcatccatgtccctacaaaggacatgaactcatcattttttatggctgcatagtattcca

SEQ ID NO: 120045 - DNA, 291 bp, Homo sapiens
cccagctactcaggaggctgaggcagaagaatcacttgaacccaggaggtgaaggttgcagtgagccaagattgcgccactgcactccagcctggcgacagagtgagactccgtctcaaaaaaaaagaaaaaatagattgtctagggtcgagtgagagaagggagtgtagaagtttgtctgatcttaagtttgtagcatcatgagattgttcaggctcaacctgatgggatgggagactaaagggcatctgggcttagatttgtgagaactaagtttgttcaccactggga

SEQ ID NO: 120046 - DNA, 901 bp, Homo sapiens
tggtcaggtgttggaatcggtgggtggattgccagtacatttgcaccgtgtcctagagagcctctatgcatttcaactctgattctccttcaccatctacgcgcagcccacaaccgcaggaccccacccctggctctgaatctcccatgtcctggcgccaagcaggtgagtcagcctaggaggaggaagggcttccggaagccaagcccatgctggggtggtgagaaacaactttcctatgcaaggaggtgcctgagcaccccctgatgatcaagctggagccccctcacctccccgaagtgtgctggaggaaaggccagaaagaggcagcagtcttcacccactgaggctgagtttctcactcatgccaagttttacataagctggggaccatgtgcttcaaggctagaggtcttggtgggcccagggccttggaggggcctggatgaccaaggggtccgtggcttaggccctggctctgcatggggaatcttgggaaggttggaagcccacagcccctactgagaaaggagccacgggccagatcttttgcacaaatcctgcctgtgctccttgactgtctctccccaccggggtcacggtgaccaagcaggcaggagactccatccgttcacaggactagcatcctgggagggccctggcctgagcgagctgctgcaggggaccctcatgctggatggttggccactcagcacccttttctctgtggagcagggatgacatttgagagccaccaaagatgggcaggaaaaacaaaggccaccacagaggaagctgaaggcagaaagagatgcagagaaagtgggagaaactcggctgtgctttgtgggggccctgcagggacatcagctcctgaaggggtgaaagaaagggtcccctg

SEQ ID NO: 120047 - DNA, 431 bp, Homo sapiens
ttctctgctgacttaggagttggggctgaatgaagagaagaagtcaattacaccaagatctaagaacattccagaaagagggatacgcacatgcaaaggtccactactctgaggggtgggaggtgagcttggtttgttggggacaaagaaggggcactggtttgaggcatgaaaccaacctgacagtttttttttagctctctgtgagggccgccaccttgtggtccatgtctttctgtcctcccacagtgcctgcaaagagcctcgcatgctctgtgtactcagcgaacacactgatggacaggtagtcacctgtgaaaatggtgacacacacgccccacctcttggggcattcagagaagtggagaactgacttcgtggttggagaccactgaagacagaactggaatcagtggaagagagatccctgt

SEQ ID NO: 120048 - DNA, 448 bp, Homo sapiens
tgccatgaccttgacccacacacacccagcattcttaactcctaggaaccccattatatgaaaatccaaaggtatgaaataaattgggagggtagttacttgttacaaagtgattccttactttacagaaggatttgcttcagatttctcttaagtactcagtttccctagtgtatttaaatgttgttctgtgaaaattaagcatttgtaaaagaacttcaggagcccttctcttgtgtaaagggagatatccgtgtattcataggcaaaggtgcagaaccccaaagcccggttgatgttgctggagaaacaggcaggcagggcttggggtggacatcataggcagcccacctgaaagcagtaaccagcgattccccttcccctctccccatccacatccctgagctgggagagctccgcggagcttgataagtatatacccgagccc

SEQ ID NO: 120049 - DNA, 281 bp, Homo sapiens
tttaatgtgatgaaatagtgtttttaccttcatctggcagtctatttccactttttcccattctttttacttttttaaagccactcaaatttagcaatgagggattatatatctcttgttctttttagatagatttactttaccatacataaaaatttctcacaaaggcaaatagcttacctcgttctttgtaaataacaccataattccatttgcttaagcctatgagtacaccttaatatttctcttccacccccacatgtttaatctatcacctgatc

SEQ ID NO: 120050 - DNA, 431 bp, Homo sapiens
tggtacagggtgtggtagtgcgtgcctgtaatcccagctacttgggaggctgaggcaggagaatcgcttgaacctgggagacagagattgcagtgagccgagatagtgccattgcactccagcctgggtgacagggtgagactctgtctcaaacaaacaaacaaacaaaaaaagccaagtttctcttcagaggtagaaaggtactcctctaatagatcattactaagcgttaagcgtttccataaattataaatgagttgcaaaacttccgatacaagctcctgtccaaacctaagagttgcaggtaaagtctggttaaaggtatccagggaagacttatagagcagagcaaacaacctacattgtaactgaaaattatgtaccgcctttttatcccccctaaagagacagggtctcactctgttgccgag

SEQ ID NO: 120051 - DNA, 313 bp, Homo sapiens
tgcgcggatcctggggcataccataaactcttcatggattatttctctggagaggggtgggagcaagtaagctggtagatgggaggccagcagggcctgggtatgaatgtcaagtacctcaaagcagcgtagatgtgaaggaagggtgagctgcacagaggaggaaggaggggtgtcaatgagctcatagaaaccgccacagaaaggccaagcaaagagtgagaagaagcagccaaatcacaggtcagaacaagctgtgggtaaccacagcccccagctattgcccttgaaacctgctagactggtctccaca

SEQ ID NO: 120052 - DNA, 704 bp, Homo sapiens
ggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatgg

SEQ ID NO: 120053 - DNA, 236 bp, Homo sapiens
tgtccatcaaaacccccagtatgatggccactatggaactggacttctatttcaggactggcatttcctgaagcgttatggcagggtctctcaaagtgaggtgcctgggatagtaaagagattacgttataagagacacaaacgtgacagggaactactgtgtcactgatggttccagcaccttgctgtccagtctgtttgatgaggtcaaggaaagattctctctgtagctgtca

SEQ ID NO: 120054 - DNA, 712 bp, Homo sapiens
aacacccctttgtagtattattattggccccacttgacagataaactgaggcacagagcaattaaagcacttgcccaaggtcatacagttataagacagagagacaggattcagaccaggatgtaagtctgccaaggcccaaatattaaccacaaatgcctgcttcagcaggttcatgggaagatttaaggtatgatgaaaggggttctaaacagtgatgtttgttatcattttgaaaggagaccagagaagcatttcctgcatccattttcctatcatcgttaattgcctactcacacacagtttaaggttatcagtatatagtaaaatttaaaatctgtaataggataatgtttcttattttgccttttaaacactgatttttctcatttaaaaattagtatttgttataaaaattcaaatcttacagaaataacagatatacagtgaatatcccatgaaatcttaattatcctcctacccccaaatcattatttactgttgggtagaaattcctccagctcttttcttttttttaatctgagacggagttttgctcttgttgcccaggctggagcgtaatggcacgttctcagctcactgcaacctcgatttcccaggagaattgcttgaacctgggagatggagccttgtggtgagccgaattggcaccattggactcaatcgtgccattttttgaaatgcttgtccc

SEQ ID NO: 120055 - DNA, 337 bp, Homo sapiens
accctctactttgccccttccgttgtggatgctatggagatggtctccctgcagtaccagagattgcccttgtgggtttcagcctcctaatcttggcatctctctgttgtcgctctcagcaaccatctcttctctgctacatccaccccttttcactatcagtgagaatgacaaaatccccaggtctttcttccctgctgttggcaatcaaattaggagccacagtttccctagttactctgagaaagagtaagtgctaacagctgtgtgtgggccagacaccaactaataatccgtagattccttcgagaatgccctcttctccttagattggcca

SEQ ID NO: 120056 - DNA, 391 bp, Homo sapiens
atggagtaaccggaactctgtactgtcttcacaatttttctgtaaatctgaaactactctaaaattaaaagttcacttaaaaacaacaatgaaaaaaatgtcagagaaacactaacattatcaagtagatcacaagcttcaaattatttaccaagatttccaaatgagtttaaactctccaagggaaaatatctctgagacaacatctttttatcaggtcccctggacaaataccaaagatattatctatgattaaaataaatagtaattttcctccacattcatcattaatcaatcatttaggtcattgcactgaaagtcaatagcaagaatttaaaaaatctcaagcatctacaactgctcttccctgcccacactattaaatgataaa

SEQ ID NO: 120057 - DNA, 712 bp, Homo sapiens
aaattaggtaattgtgtttgtatattatttgtatgtatagaattccccctcataatctattgtactgtaataaatctgctaaaaggttaccttagaaacattacctggttggattatggatgtgtttgtgagcctaatctcagtaatgaaaaatgcctttagtggctcatgcctgtaattccaacactttgggaggccgaggtgggaggatccctttagcctaggagtttgagaccagcctgggcaacataatcagctggtgtgggacatcctgggatagataaccatttccttccaaagtcaagatagctgcccagtgaagatcaaacaaacaaacaaaaaaaggaaaaaagaaaaatgcatttatggggatgaggactttgagaaagctccgactctagaaagctgaaacaccaagtaaatgcccttttctagtccttaatgtgacgctaaaagattgattaaatatcataggacattgaatatactgttgtaatgctcttaggactttttttgaagatcatttggggaacttcagttacagaaatttatcacttgattttggcataatttaatcattgtggattatttctgataatttacaaggagtatctcttcattatcacataggtgggagagctgatgtgtcttttaaatgattgtttgcaatgcttccaaatacctacaactctttatttttatatatatatat

SEQ ID NO: 120058 - DNA, 449 bp, Homo sapiens
ttttctgtatgtataatggtaaactgccagaatactgatcaggccagaatgatgtttgaatctttctctgtaacccaccaacccacacgcatcctcccattttgttttggggaaggaagaaatgtatccacgcccctgtctgtcccttcaccagttgcatcagtgaggtggagactgtcccccctgggcagtctgctcgctgggtggacgcactgcctgtccagctattctgcactggctcgtctctaattaaagtacttgctatgaacgatttttaagtactggagcttaatgaagttagaaaaaggatttggatgcagtttgtgaagacttcaaattgtttgagttttttctctagggagaattgtaaagtctggaggcattctgaattacttacaatgtattccattttgttcttttcaaaaattctctcatagtggtgaatagct

SEQ ID NO: 120059 - DNA, 603 bp, Homo sapiens
ctccagccctgtctcctaagcttcaaactgctggatctaactgcctactaaacatctctgcatggctgactcggtgtccaaaatattaactcctccttcctatacctcaattccaactgctgttcctcccagtgttcaccatctcaggaaatgacatcaccacccagcccattactcaagtctgaaacctgggagtcatccttgattccttcttctccctcagcaactcctttcacatttaaacaatcacaagatcctattccactcctaaatatttctcaaatgcttagtgacatagatgtcccttctctatatgcccactagtccaagctacccttattctttgcctaactactacagtagctccctaaatcccttacaaccattcttgccccatccttccatcaatcgaatcaaatccaattataccaatctctggctttaaaacgttcaaaggctttatagcccagagtgtccaaaggaaagtattgggactaattgcatcagaacaagaggagcttgttaaagtatgggctcttgagctgcaccaaaccgaaagaatcaaaagctctaggaacaggctcaaggcactgaatttttaat

SEQ ID NO: 120060 - DNA, 442 bp, Homo sapiens
ttgagggcatcctggacaaagcagtatgtaccgtgggagacagaaaagtagtaagacacatggttccccaagctcctttatgcctaaaaagttctgactttgcagttgagtattaagctcaacaactcgaggtgaaagtcaccttcactgaggggagaaggtgagtcttcctagctgactatggagatgtggggcctgatctaaataaaaagggtcattctcttctgtggagaactacacctctcctttgattctattttgattatagctataaatagtccttagggcccagtgaactaactagccctccacaaaaacagaaatggagatataaagaatttgtgctcttcccatcttctaagtatgcttgtgttcttgggatatcactccactaggggcatttcacaaggatgtaaagacccagactagtctaatatgagac

SEQ ID NO: 120061 - DNA, 478 bp, Homo sapiens
tcactgttgacatctcttctgcacagtggcattgctgggaggtgcttactgtgcctattcaaggggctggcagccgcagcctcactgcagatcagggacttggcttcccagttgaccacaggtccaagaacctgcagggtccagcctcccccccatccccagtcttccccaccctggcccggccctccaggtgcagaaacatgcaggcccctctccaggactgtgggaggagcgtgtccctcagactggcctgtgtcctggctcctcttaccacctcttccacaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatga

SEQ ID NO: 120062 - DNA, 501 bp, Homo sapiens
aaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtaaagagagacagagagagacagagcaagagagagagagggcatctgaatagtctgagg

SEQ ID NO: 120063 - DNA, 569 bp, Homo sapiens
tgccgcttccctcccttaatgtgtccccttttgggctgggtggcacagctggtctgcacctgcagggctgaaggacatccctgggatacagggtgtcattcctcctgcttgatctgcctcccaaaacccagccctgagcaggcagcaagtgccctttcagcctccgctgcaccagcctgagccggaatcccagctctcattagctgtgtgattgggcaagttgactgagctctctatgccttggtttctgcatctattaactgggattaattatatcgacacctctttgggttgctatgagacttgaagagagtttgggtgaagcactctataaatgctaggtaagtgagtgttattaatttcccaaacgtgagaaaatgaccaacatctgttctggcacccctccatctctatgccctccccaccagccctatcaaatgcagtttcctgtaaataatcctcacatggggatggagcagggccggggagggagtacatccctggtccacaaggctgctgtgacatgacaaataagctgcaggctgacaatgtctccaagacatattgga

SEQ ID NO: 120064 - DNA, 289 bp, Homo sapiens
agaagggagggttcagtagtcatacttaagtgaactagaaaaaataccgaaatgtttttatttcaatagacttacatcttgtaaggcctagttctcaaagacctcacgaaagaatgacataaagagtttagtctgaacaatctggttagagaggggaaattcctgtaatcagaaagagcactcacaattctacgtaaaccaacgagaaattttaagggaattgggattgttttgtaacatgttgctgagctcagaggctgtgaatggggacagatcaagccagttctag

SEQ ID NO: 120065 - DNA, 395 bp, Homo sapiens
tgcacttgtgttctggaccatccttctcataaatgtgcctattcaattccgtctgcagaagcagggaagcaccctgttttgagacctgtcctgtggaaaggaagaatggtgtagtggaaggtgcagtggtctgggatggagacctcaggactactcctggtattgcacaggtctatggctctttacctcagttcgcccatccttaggatgaagataattctacctgccctgtcccttcccacggtcattaaaggattatatgagatttggagtcctaatggcctttgatggagaagtaccaatgtaagggctcatttttccccgtcttccaatggccctccccgattcctacatgggcatgagcgtctggtgcttcggaggcaagtaggcatttt

SEQ ID NO: 120066 - DNA, 376 bp, Homo sapiens
atccaacgttcaatggaaacgcctatcggacaatgagtgaatggctgtgccttccatataaaagcacgataatgatgtgttctgagtggaggcatgcctccgtgattttactcctctctcagctcggctgggactcagattctttcagatttacgtctctctggattaaaaaaaaaaaagctgggacccagattctcagagttaagtatagtctttctgcaagaggctctttgtccacatcaacagtgagataatttgctgtctcagaactgctagaccagctgaactttccttgtttgctttcttgttagagtacccatgaaaaggcagattggagataaaattgattcaagagaggccatggataagagatgtt

SEQ ID NO: 120067 - DNA, 365 bp, Homo sapiens
tacaggggaatgctggacaaaaagctgagtttatagacatgggttaattagcaaagagactggatggctggtagatgaatatgaaagtatgagtctgttgggctggctgtggtggctcacaactataatcctagcactctgggaggccgaggctggcagatcacttgaggtcaggagttcgagaccagcctagccaacgtggtgaaaccccgtctccactaacaatacaaaataaattagtcagacatggtggcacacgcctgtagtcccagctactcaggagactgaggcagaattgcttgaatccgggaggcggaggttgcagtgaatcaagatcgcaccactgtactccagcctgggcgaca

SEQ ID NO: 120068 - DNA, 222 bp, Homo sapiens
gcttagagaaacctaaagtaacaatctactccattgttagtctacaagttacttaaatacttcgccaagaaattgtgataatcatcatcagaaatctagagttctggagagctggctgactcagtcttaaggaaattactttcatccctaaaaaccgtaacagtatttaatatgttgtggatagccttaacgtttggcatgaatcatgagcctccttaactg

SEQ ID NO: 120069 - DNA, 398 bp, Homo sapiens
ttaatctctgtttcctcatctgtaaaataagcataatgatagccctatcttacagagatttagtgaaaatgaaataacaaatattcttgttttctattgaggcataaaaattaccagccaggtggggtggttcacgcctgtaatcccagcactttgggaggccaaggcgggaggatcacgaggtcaggagatcgagaccatcttggctaacaccatgaaaccccgtctctactaaaaatacaaaaaaattagccgggtgtggtggcgggcgcctgtagtcccagctactggggaggctgaggcaggagaattgtgtgaacctcggaggtagagcttgcagtgagctgagattgcgccactgcactccagcctgggcgacagagcgagactccatctca

SEQ ID NO: 120070 - DNA, 359 bp, Homo sapiens
cattggttacagtttggtgctactatgataatgcttgtacatttcttttagtgcaatgtccacatactgatgttgagtgaaattgctttgacactgtatcaatcctgttaaaaagcataatttcccataaagtggtttttttttttgttttgttttgtttttttgagacggagcctacgtcagtcgcccagcctggagtgcagtggtgcaatctcggctcactgcaagctccgcctcccgggttcactccattctcctgcctcagcctcatgaatagctgggactacaggcgcccaccaccacgcccggctaatttgtttgtatttttagtagagacggggtttcaccatgttagccag

SEQ ID NO: 120071 - DNA, 831 bp, Homo sapiens
ggtaattcagagaattcttccaggtcttatccaagactgccagagtggtacctctatgagtctgcaaaactgacagcattatggggcttcaggtccgatcccttcaaataccctgaaagcctcctcaaggacaaccagaaataagatcagactataaagactacagtaaatacctagcttttcattgcttagacactgacaaatatctataagcatcaagaccatccaggaaagcataacctcaccaaatgaactaaataatgaaccagggaccaattctagagaaagagacatatgtgacctttcagagagataattcataatagttgttttgaggaaaatcaaagaaatccaagatagtctagaaaaggaattaagaattctatccaataaatttaacaaagagattgaaattatgaaaaagaatcaagcagaaattcttgagtcgagaaatgcaattgccatcatgaagaatgcatcagagccttttaatagaattgatcaatttaatagaagaaagaattggtgagcttgaagacaggctgcttgaaaatacacagtcagaggacacaaaaaaaaaagagtaaaaaagaatgaagcatgcataccaatctagaaaatagcctcaaaagggcaaatctaagagttattaaccttaaagaaaaggtagagaaagagataggggtttattcaaagggataatatcagaaaacttctcaaatctacagaaagatagcaacattcaagtacaaagttatagacaccaagcagatttaacacaaaggaaactatctcaaagcatttaataatcaaactcccaaatgtcaagga

SEQ ID NO: 120072 - DNA, 704 bp, Homo sapiens
caaaacttatgagataatattttgttttctttaaatgcacttgaacttagtctctagacctcctgcaactcttcttgtctctttggcttctctctgcctcacctctctagataaccacctatttctctaatgtttcttagccaaaagatgctagctaactcagacattttctagttccctctttcaaggttctgaggatacatagccctgaaacatccaggactaaaatgatcaatggcagagatttctattgtgttttattttccattaagaagaaggaaaaaacaactttttttgacttcttgaaatttgtaggcagggcacagtggtttatgcctgtaatcccagcactttgggaggcagaggaggatccctgtagaccaggagttcaggaccagcctgggcaacacagggaagaccctatctctacgaaaaattttttaaaaataagccaggagaccaggcaaggtggcttatgcctgtaatcccagcactttgggaggctgaggcaggaggatcacttaagcctaggagttcaagaccagcctgggcaacatggtgtaaaaccccatctctacaaaaaatacaaaaattagctgggtatggtaatgtgtgcctgtagtcccagctacttgggaggctgaggtaggtgaattgcttgagctgaggaggcagaaattgcagtgagccgagactgtgccact

SEQ ID NO: 120073 - DNA, 119 bp, Homo sapiens
ctatatatttatggagtacatgtgatgttttgatataggcatacaatgtgtaatgatgaaataatgataattggggtatccatcagctcaagcatagacaaaatttacttcatgaacaa

SEQ ID NO: 120074 - DNA, 236 bp, Homo sapiens
gtgcttgcatttatatatgagtgttttttggtgggggataccaatgaaactcatttccaatggaatcctgttgccatgcttgaggatgtgactcgggaggaagttggcagttttctagttttctacttctgctcctattcagcaatgcctctaaccacatccaccctgggacaaatctatcttctctgattcagacaaaatgcccacatacaaatctttcctggagtaggaagtgg

SEQ ID NO: 120075 - DNA, 279 bp, Homo sapiens
ctgggatacagatgtgcaccaccacatccagctaatttttttgtatttttagtagagatgggtttcaccatgttggccaggctggtcttgaactcctgacctccagcgacccatctgcctcggcctgctgaagtgctgcgattttttttttggagatggtcaccgtgcccagccgaggccctactttttaaccacgtgtgctatgtataactgtactaccctggtatagtatacactatgctttattatagctatactctagtatatgtatagtctctt

SEQ ID NO: 120076 - DNA, 465 bp, Homo sapiens
gttggtcaggctggtctcgaactcctgacctcaggtgatccaccagcctcggcctcccaaaatgctgggattacaggcgtgagccaccgtgcccggccgatcctctgacatttgtatacaagtttttgtgtggatgtacgtttttatttttcatggtgtatacctagaagtggaattgctaggttaggtggtaactctattgaacattttgaggaactgcagaactgttttctgaagtagtgataccattttacatttttaccagcagtgtgtgaatgttctagtttctccacattgtgactaacacttgtttccgaactgagacgcttctgagagtgaaagggtgcaccattaagaaatatgccaataagactgacattaactggaacatattcttaccctacctagataccaaaaaaattagaagattcaattcctgatttcagggaactttctggccacatg

SEQ ID NO: 120077 - DNA, 489 bp, Homo sapiens
gagagaactggagagaaaatgatgtgaatagacaagccaccattttacaggtgtctgctctgcgccagacactacacatcctcctctcctctaattctcatgaccctgtgcggcaggtggccgtgacccaatttaaagaggaaatacacttctgagagatgaactgagtttctgaagatcacataggtggtaagtcagatttgaacctggatcttcctgagtccagaatctgtgcttttaactcttaggctgcagggccctgctgcgtggaggcagcctagcggggactccgagctgacaggtcaggtgatggagttacgcacgagcctgtttacctccctgttgtcatcctagcacctacacagaactcttaagtgaacattcctcctaatccttgccaggctgaagggatgatcctcattctaccacggtacagagccgggatactaaagggaaagtcaagtaataattgaggtccccccaaaagag

SEQ ID NO: 120078 - DNA, 395 bp, Homo sapiens
ctgcctctctctctctctgtttctctgtatttacttatcatcagtaactgaggtgttggctatgaaccaattgcaaagtgctttgtgaggtgttagtgggattatttctctttctcagaggcttgcagtaccctatctactcccccctcatataagccccacccagcctcagtccctgccttggcccagtgcctggagagtcctccttccctagctaagcgctgccctcacataccacctcctccagaatggcaacagccctgtttgtgtgctgttactgcctaccaggcactggtgtaagagcatcagcctctttcatccccatggcaaccctgtgaggtgactcctattagtgctcttgttgaggatgaactaataaatgaactaataaataa

SEQ ID NO: 120079 - DNA, 421 bp, Homo sapiens
atgtgtacgagataagtgcaagggtgagacaaggagaaggaaggagagagaaatctggaggaggagtccaaggtttagagcctgaacatcctgaagagtgacactgccttgaactgatgtggagaacaccttccatgtagcaggtgtgtgggacggaggtcagggctctggtcgggtccttcaaggttagttcatgggaagcgtgaggggatgagtaggggaggctgcgattatggatgtgaatccagagtctccagcaaagggatgttatttaacgccaggagactgcagagagtaccaggaagtgagtggctccgatcctgagaaggtggggaaccagcctagggcctcacctgctcactcaactacccctgtgtactttgtccctgcgttctcctcagcccaggaaaagaatcccctc

SEQ ID NO: 120080 - DNA, 323 bp, Homo sapiens
gctttcatgatgagaagcgcttcacttgagctacaataaaaccaaaactatcctgatgatagcaaaagagtactatttatgtgcagtgcaatttgctaaacccctgacaagaattatttcactgaattatatcaacagtatatgaaatggatactacttactattcccatttctcagatgacaaaacgaagaggtagaaagtttaataacttgcctatagtacatggttattaagtagtagagcctgtatctgaaaccccatctgccttacccgagtcctactctgaacgattacattgcgtgtgaaaagaaggggctactga

SEQ ID NO: 120081 - DNA, 311 bp, Homo sapiens
gtctagtctccactattatcatatttcatattttatttctcctactcattctcaaaaccaaaccctctaaagcatatttgtctggccagccttatgatgacaagtcttcaaatgcatgataccatgttgaatttaattttatgcctgaaacactaaaggctggcacggctccattatctttttgtcaaaccctcacattttaatctgccatccagtcagtggactggaaacagagaaaaatcacttcagattatgaaaaattttgaccctgcaccaccagaatttgtttaaatcaaattgtcatctaaatg

SEQ ID NO: 120082 - DNA, 423 bp, Homo sapiens
cggaggtgtaaggtcacacccatagcaatggctcctctcgtaccaaaagcgcctggtaaagcacactttctggacaccggatgtgttcccagggatgccagagagctccctgtagccggtggcatccaggtggacagacttacacagcagcacgctgtccctcgctacatcggtcagaatttagggacacaagctgcccagtgcacctccatccatcacctctcttccccctcttcttgcttccttcattattcaacctcgaaataaaaaagaaaacaagatgcttggtcaagccaatctcaactaccgagactttctacctcacactaccgtgtacatggcaggaaatctcaacagaacaggggcgagaaaagactcctcggacagacttcagtggaccaggatctgagcaggatttgctcg

SEQ ID NO: 120083 - DNA, 171 bp, Homo sapiens
gtactgcatagtttgtatgagcacaatttattcaaccgcctttcagacagaccagttacagagctggtcctaggatcgctgcaacagtccgagggcatagcttccctaacttcattttcaccaatttcaaatcaactttagtttacatttcctggcagaatgcttcacata

SEQ ID NO: 120084 - DNA, 425 bp, Homo sapiens
gcaggagaatcgcttgaacccaggaggcggaagttgcagtgagccaagatcgcgccactgcactccagcctggcgacagagcaagactccatctcaaaaaacaaacaaacaaacaaaaaagaaaatacttatattcaaaattagtcctacttttcacacttagctacctgagtctatatatgccaatatttccactaaatttcacggtcatttctctcaaagaggctagtttagtagagcagaaagtttaagtaaatgtacttaaacagtataggaacaaagaggaaatggttgatttgacttgttgggagacaggacaagttaagtttaatacaggaaatgacacttgaactaatcttgttagatgagtagggctcaacagaacaggacaaagaacgatgttcaagaggaaaggtataggatga

SEQ ID NO: 120085 - DNA, 379 bp, Homo sapiens
ccacccttaggtacttaccaaaaagaaattaaaacatttgtccatatagagaaccatatatgaatattcagagcagctctattcacaatagccccaatctttaaacaacccaaatatttatcaaatgaggaatagatattatgagatattgctcaataatgaaaaggaacaaactactgataaatgcaaccttgatgaatcttcaaaaacataatcataagtccaagaagccagacacaaaagagtacattctacattattccatttatatgaaactctagaaaaagaaatctcatctgtagtgccaaaaactaaatctgtgattatccggggccagaaacacgttaggcatgggcagcggggcatgcacaggaggagg

SEQ ID NO: 120086 - DNA, 301 bp, Homo sapiens
  misc_feature (14)..(14): n is a, c, g, or t
actagtccacggtngcggaacacacaattctacccaatagacaaacacagtgtgttccagccatcataacacatactctgtccaccacaaaatatttagctctgattatacatgtgcttgttttctttttgtctagcttctcaggcatgggaattctatttcatcatccattcctttgtttccagtctaatcgggagcttgattcataatgggagtcatacatgtttgatttaattaacatatttcgtcaaatctaagatgctagtagttttaagagccaaccgtggactagtgggaacca

SEQ ID NO: 120087 - DNA, 196 bp, Homo sapiens
gatccctaacagctctgctcacttaagcttttactcccaatgcctccagcatcttcccccatggctccaccttaccctgtctcctcctatcccatccttctcatgtaggtgactcctactcattcttcacgacgcagttcagatgttgcctcctccatgaagctttctctgatatgcgtaacctccccatcctttg

SEQ ID NO: 120088 - DNA, 478 bp, Homo sapiens
atgcatgtagcagggacagtaagttggtggcatgtttttctattaagatgatgtattagtctgttgtcacactgctataaaggactccccaagactgggtagtttataaaggaaagaggtttaattgactcacagtttggcatggctggggaggcctcaggaaacttacagtcatggcggaaggggaagcaaacacgtccctcttcacatggcagcaggaagcagaagtgctgagccaaaaggggaaaagccccttacaaaaccatcagaacttgggaaaactcactcactatcacgagaacatcagcatggaggtaacttcccccatgattcaatcacctcccactcagcccctcccatgacacatggggattatgggaacaacaagatgagatttgggtggggacacagccaaaccatatcagattattttttgcatcaatatcatatactatattttgattctttattttgtcag

SEQ ID NO: 120089 - DNA, 349 bp, Homo sapiens
ggctcaggaacctgcagtggctccccagtgccctggtccagtggtcttaacctcattttatagatgagaactttgatgcttagagcagatgtgttgctggctcatagcggcatttgaacgcggggctgctgatttctgggcctgtattatttctaagacacctcactgccttctgcactagcaggaaggggtgaaccccatggcttcagaactggaacaggaaagtggaccaacatggagcccgccccagccacagccctagggaagcgtccaagctggctctttgtgtataaatcatggtctgtttactgaacagggagtgtgtctttcctcctggggagctgcccca

SEQ ID NO: 120090 - DNA, 755 bp, Homo sapiens
taaaaaagaagttgaatgaatgccgattgaatgaatgaaatattatagaagatacctggaaaagtcagaagacacatacacccacacccatacacacatacaccgtactcctcaaggagttgaccatctagacatttagccatgtacctttaggcaagttactgaacctctctgtgcctcagtttcctcatctgtaaaatgggcagactaaaaataatgagcacatacactgcagagaattaaatgagttaagaattaattgatgtttgggacagtgtctggtacttctgtgcactcagtgtgtatcagctattattgggatgatggttgtcatgggggcagagtagaagcctctaggtagtgctgggagagacagcatgcagtgtgagtcgagaatggccctgggggatgctatgggcatacaaggagggcatcaccagctgatgggtggctggtgtgggctgtatcaggtctccaaggaggagggatgatgcgggtgaaccatggggccagggacaacatgaggtgacaagaaggagactggccttgacagaaaggtccaggttgtagcctccaggagagtggccaccccggggacaggcggagaattgagatggctgcttctccatgagttgtctggggtggtaacagccaggaaaccatttgaaaacctcgctggggttcagggtggcatgcagggaagaggcggcagagaagaccagatgaatgtctctgagctgaagaggcacagaatg

SEQ ID NO: 120091 - DNA, 949 bp, Homo sapiens
tgcaccactgcactccagcctgggtgacagagtgagacaatacctgaaaaacaaaaaacaaaaacaaaaaaagggaattcgcagaaatctaatgacaatgacagaccctccccatgttttatttctaatgataatcttgtgagggaaacttaacattaccaacctaaagaagacccttgaagcgcagtggggaaagcacgggtgtctccatcacactggtctcctgggtatccacgtagagaggatgagcctcgaccacccccacacacgcacacaccatgcacttggatccacgtgacatggactgtggatgtaagaacgtgaaaggtaaaacaaaattctagaagaaagcacgggagaaaatcttcatgagtaggcatcgatttcttccacgggagccaaaagccactaatcacaaacaattgagaaattagacctcactgaaattaataacatctgtttattaatggacacgctgatggagacagtgaaaactcctcatagatgaggaaaagacaacacaatttaaagctggacaagagccgggaacagacgcctccttacacaggacatcccaggactaatcaatgtggggaaaggtgctcacgtcattgcattagcatcacaacttcaagaaaatgctcgttaaaaccagagtgacttgcaccagcacccgccccagaacggccgaatgcccatcagtgctggcaagtctgaagcagtctggcctcacaccctgcgtgtaggagtatgcagctctttggcaatctcttctgttttgctttgtttgtttttaaccatcgaactgcagaagataatattttctgaggctcagcctgtacataccctctgacccagcagcctgcagccctcgttctacccaggagagctgagtgcatctgtccacaccgacagacgtgtccatagccactttggtcataatctccca

SEQ ID NO: 120092 - DNA, 548 bp, Homo sapiens
ctctcagattttattatgtaaaagtgactttatttcatcttaatttttaattaatttttaagttttagtgtcaaggcaatgctggctctataaaataaatcagggaatatactgtagtttgaccacttaaatttaatgtaattagcaatatagttaggttttactctaccatcttgtcatctgttctttttaaattttttttcctgttttcctacctcgtcttggattaatcttatttttttagtatttaattttatcgtcactataggattatttgctatatctctttgttttgctgttttaggggttaaggtttgcaatgtgctttacactattcaagtcattttagaacacttcaggtataatgtaaacatattacaattgggtactcttttttttttttaaagagactgggtcatgctctgtttcccaggctggattccagtggtgtcatcatagcttattgcagcctcgaactcctaggctcaagtgatcctcctgcctcagccttccaagtaactaggactacagttgtgtgccaccacccc

SEQ ID NO: 120093 - DNA, 111 bp, Homo sapiens
tctcctctacccacacatggcagaaatagaaaggagaaacaagatgcagaggggctgtgaactctacttaaagacagagtgagggcacagactggggtatgggcacaggtg

SEQ ID NO: 120094 - DNA, 494 bp, Homo sapiens
aagtgtgtatttttgtatatagatatactttaatttctgtatatttggtatatagaaagggaaatgagttgttatggctagtattgatcatcagtgtgggggttatagatcctaaatctagatttgtagttcctgtctttgaatatctttggttagggagagaagggagaggagaataattagtgcattcatgaagtacagttgggagactttaatatgatactaaaagaattccaactcttctaagaagaggtagggtctgggaaacattggcttaaatggtagagaacctttgtgctctttgagaataaatgaacaaaattgcattagcacagggaaatgaggttggagactgaaaaataacaatattcaccaaaaccctaatggtggagaagtgatacattagtaaagactgaaattggtagctgggttatgttaaaacacatttcctatctctgattacaaattgtatctcaactgctggcaactctttg

SEQ ID NO: 120095 - DNA, 419 bp, Homo sapiens
tagcgtgaatggccaaagtcgcaagactcataggtggtgggacagaaattcaaattcaggcagagtcacttcagaaaccaccatgctattctgccttgcaactgaaaaaacatacgtcaatgtgctttgcagactgctagctgtgcatgtgtcagctcccatcatggtaaatatttttattggacaccatattaacccatcagcacccattttctagtcactgggatacaggatggctgcattttagtggatagtgggtgcctaggaagtcaaatgagtgggctgtgtttggaggggcaaagaccaaagacaactaagggactcagggccttagaggtggccttctagagtcatgggcagaaggctcttagggagttctctccagatgatctgcgagtaagggaagaaggcagcactgg

SEQ ID NO: 120096 - DNA, 204 bp, Homo sapiens
acattacaggcaagagccactactctcagcccataagcattgtttctatcagttactaatggtttcccaaccattaaatccgttacacatttctattttcccctcccacccccgtgctttcctttttagagagacaggatcttgctctgtcacacaggctagagttcagtggtgtgatcatcgctgactgctgccttgatctcc

SEQ ID NO: 120097 - DNA, 213 bp, Homo sapiens
ttcgtctggcctcaggtcaaatgcctcccaggatgaggctgcataactccattgttataccgcacacacattcccagaaagtgtcttccgcggagaccagttctgtgtaattcgtacctctctttgtcctttgggcttataatgagtaagcaactttgtttcacttgagggtcgtgtgatgtaagggaaagaccaccagcttagtcctgagtt

SEQ ID NO: 120098 - DNA, 613 bp, Homo sapiens
tgcttttccctgcagaaggtttaagaactatggcagacttctatcactttccttttccctctgccatgaggattacatatttcaaatagaggctacatcttctgcccagatcccagaatggagaggacaacacagagcagaaccaccaatgaccacagccgacataaaatgtgcataagaaataaacccttcttactgtaagccactaagagttttgggttatttgttactacagtgtaactcagagaaagctaattaaaatataaacacatatgtcagcaatattatttctttcatcacagaagagccttgctgtatccatagagttgagagcaggtctccttgttacactgtgggtacactagattccagaaccactacctactgtgtctctgtatcagctcctgccttcaagcggctcaagaaatgactttggggacccaagcctggggccagtctgtccaggatgactaaagagggagttagatggagaaggcagggtctggagcagtacctggcacatgcagtactcaaggatttgatagataaatgagtaatttgcttgcattcttgtgccagggtttttaagagtcagtccaaaataaggattatg

SEQ ID NO: 120099 - DNA, 202 bp, Homo sapiens
aatttgtaattaactaaagatttaccaatagggctttccatataatttttttaaatttaataagtgggggaaaaagctgccttagcaatacatcaaattacttctctgccatgccaagctactatataacgttatacaaagaatatacttctaaatgttgtgacatctctaaatgattaagctcactatcatattaaagcct

SEQ ID NO: 120100 - DNA, 387 bp, Homo sapiens
tgagcagcccctctatgacaaggactctatttcctgagggaagtgggaggagagaagactggggcagaagaggaagtaagaaggtacctttttgggaacttttcatggctacccaggccttcctcagcctctatcctattctatcaccccaagagggcctcctcttagaaggaaagatttcccaccctgtccccaagaagttccctgtgagaccctggaaggctggtagtggtgagcccacaggccctggagtggaagggaaatcaggagcctcataagactacaattaaaatgtccatctgctcaggcgcagtggctcacacctataatcccagcattctgggaggccaaggtgggaggatcacttgagcccaggcaatatagtga

SEQ ID NO: 120101 - DNA, 211 bp, Homo sapiens
agtctaaagatcttaaaaaccctcggtatccagcaacccataaggattttgctgagaatttgatgtattgttttcagcccaattctaatcactgagattgttttcatgctgtaacttgcataactaaatttttttttttttttttgggagacagagtctcattctgtcgcccaggcgggagtgcagtcttggggaggccgaagcaggcaga

SEQ ID NO: 120102 - DNA, 415 bp, Homo sapiens
ttagacataactagcaactcaacaccagtgtggcatttcctgcatctcacctctcccctcccactacagcataatccctcctcagtctggttctctttcttttggccaggttctacctcccttgcttccctaagcaggtctttccccggagtcagtcatcctgttggtcctgcaataagtggcttccaaaaaatggaataaataatcaaattcttctactctgacacccatcttctatttctttctgaaaatgaacttggattagttgaattgcttttcacaattcaattcagtttcaagggctctacagcctcttcacaatttcttgcaaatttatttccatctacttgtctataaaaggtatttgtttcagagacattgttctcctttctccatcacactcacatcttggcca

SEQ ID NO: 120103 - DNA, 268 bp, Homo sapiens
tcttttccttcagaaaacctttataaacatgctgatgtaacaaaaccaaagtgattggtaaagaagatttaataatgtatttaagccttgagaaatttctttgttgtttgtcaaatcaacaacaaaaaaatctgtgtttttaattgaatgtaatgttaaagaaaattcttgagtaaatgccaatttatgttttcctagaaaaccttttcttaacagcctcatctcaattcaacacatcttgccactgatatactgtataatataacaa

SEQ ID NO: 120104 - DNA, 557 bp, Homo sapiens
caaaattagaaagtattattaactgaatgataatgaaaacacaatatatcagaatttgtggaatgtcactaaactactacataaggggaaatttgtagcattaatgcctatgttagaaaaaaagaatggtctaaaattgatgacatcaacttccactttcagaaactagaaaaagaagagcaaattaatcacagtaaacagaagaaaggatgtgaaaaagggcaaagcagggatcaatgaaacagaaaatcaaggaaaccaaaagctggtcaaaaaacaacaacaacaacaaaaaaaacttaggagaaatttaaaaagccacaattatgaaattatgagatttcaacacctctgtctcaataactggtaatacagatagacagaaaatcagcaaggatatagtagactctcacagcactgtcaaccaatataacctaattgatatttatagaacactccaccaataagagcagaatacacattattttcaagtggatatgaaacatttaccactttgaaatggtcaattaaattgattaacatctaaccagctagaa

SEQ ID NO: 120105 - DNA, 564 bp, Homo sapiens
ttcctccactgggcagattaggggcctggcattacagagtcgttggtaactgctcatggttgtgccattggtaagggacagagacagaattcaagcccacattctcaccactgcctggggttgcccattttgttgtagttggtcattaacagcaaccacatggttcttggtaggtctcttggacacttgtccgtcatctgaaggaatgtggttgaggcagatgttgtgccgtgagggcaggggttgtgctgattctttctgtgctgttaagtggcagttgtgctatatgctacgataataaaatttctgtgcaactaactgcaggagaagagcagtgtgctgaataaggaggtgtgactcagttgaccttataaaagagatatgctagcctgcttctcattagctctcacgttttcttagaagtggtaagtttaacttcaatcttttcccttactgatatttgcagttcttccagcagaaacgcttttaaaggtgaatgtgttgccgctgcttccaaagccagccagcgctggctggaggccccctcctctacgagtcgggcat

SEQ ID NO: 120106 - DNA, 818 bp, Homo sapiens
tgggattacaggcatgagccaccgcgcctggccgagacaatttttaaaaagacatttctcaagagagttataagccaaaatttccctagccccctccaactcattctgtccttctcccagtgcatgtcaggacagggaagaaggctttaaatcagattttaagaaagaggatacattggtttacaacctttgcctatcgtccagagagtttctgatcttttctttttttttgagacggagtcttgctctgtcgcccaggctggagtgtagtggcacgatcttggctcactgcaagctctgcctcccaggttcacgccattctcctgccccagcctcccgagcagttgggactacaggcacctgccaccacgcctggcaaattttttgtatttttagtaaagacggggtttcattgtgttagccaggatggtttcgatctcctgaccttgtgatccgcccacctcggcctcccagagtgctgggattacaggtgtgagccactacacccggccctgatcttttctttgacggtggcagtatctcattttttgataatacacatgggtaatggcaagctcttgggaccccatgccaagcatcaagatcccatttacctggtgataggaaagacagacattcctcaccctttctacccacacccttgttcacagggatgactgtaactaaggtctgcaggtatttatgcttaggagaagaaatcgtagttcaattcaccaggaatatgagaaacaaaagaaagccactatgtgctatgtaaatgtctggccatccaaagccaccttatgcagaggaacact

SEQ ID NO: 120107 - DNA, 330 bp, Homo sapiens
attaagtttccctggtagttttcctgaaagctttgagtcttgaaaaacaatcaaaatgcattttcaaacatctggcttccccaggtaattacctgccaagatgaatgagctacacacccttcaaagggcttcaaatgaaaggtaaggctgctacagacagaagagaaagacaggctggacatgctgactcatgcctgtaatcctggcactttgggaggccgaggcaggaggactgcttgagcccaggagttcgagaccagcctgggcaacacggcaaaaacctgtctctacaaaggaaaaaaaaacgaaaaaattagctcattgtggtgg

SEQ ID NO: 120108 - DNA, 396 bp, Homo sapiens
caaacaggtttctaagtgcatgacaattcttgcctgctagtttctatcagatacacagtgtttaggtttcagacggacagctgaattcagtaggaagagtattattacggatgtctgccgtgggaaggcagagactgggaactcataccccaagtatatgccacagtatatttaagtttctgtatccataaaatgggagaggaagaaatatttaatattatcaaattgctatagggattaagagggaaaaatgtaaatatgtataccagacactagtatcaaataaatgctctggatgttatttcctcagagaataaaatacatttaagagattcatattcaactgtcactttagcttgtttacactttgctgacaaagttacaactttgccctat

SEQ ID NO: 120109 - DNA, 708 bp, Homo sapiens
gtgctatcaagccatgaaaatatacatggaaagcgcaacacggctgaatagaaacagctccgttctgcagctcccagttgatcaatgcagaagttcgtaggtcttgagatcaagagcaaccccatgtggatccatggtagatcacaagatctggaagtttgtgcctaatgttgttatcagatgagccttttggggatgtcctgaagggttccttgaggtgtgaccttagattgtctatttgtattcttcatccaaatacaagaagcaccaagaacacctgggaaattcaccgcaaaaacatctttgcatgggcacattgtcatcaggttatccaaagttaagacagggaaagaatcttaagagctgtgagacagaagtaccaggtaacctctaaaggaaaacctaaggtcagttttttttaagaaaagtaactttattgtggtataaagactacaaaatcaaggtgtcaaaaattaaattagatgcaaggtataaaaaattgctgttctgtaggtccaaatgaactttatgaaattcccatcttttaaaatcataaatggctgaaatttgtcaattttgtatggaactcactattatatatgggaatataatcagtgacttatactcagaggaaatcctttgacactgtatcaaagatctggtcatgaaatgcatatttagacattgcaagttataataaaatgttga

SEQ ID NO: 120110 - DNA, 351 bp, Homo sapiens
tgttacatgagcacagttcttactgacgtcaatgcaagctgtgcatgcataactgagggcagattttggcctgggctatagacatgtgagagctggcacaccatactcacatcagaactctgtcccacccggccttctgataacacggcctcctcattcgtcactctctctgcacacactgggagctgggccttaacccaaaacacaaattagaagcatcatctaatacagaaatctaagccggatgcaaatttaatgtagatgtggcacaagcaacctgagtggggaaccatctaactgtaaatttcagcaacagattatgggtcagctccccttgaagcaaactcagtg

SEQ ID NO: 120111 - DNA, 587 bp, Homo sapiens
tactgggctttcattttctcttgcttttaaactgtgaagtttgccttgaaatattaaataacgatgtagcaaagagcttctaccttgcttaatattgggaaattttgatttaaccaagatttggttcaagaatataaaaggaaatcactaaaaataaataaaaaaaattgttcctgggaatagagcctgtatgaatactttccctttagtaatagaactttgttgcttagggtgttttccctataggaactggtgaatccaaattgttttgttggcgaatatgtcaagtgtagaagggaaaacagttgctgtagtaaaaaggaaaatctttttttatgacaataaaccatgaaaggaggacagggacagccagattaaccagtccttcagattcataaacaaaaggaagagataactatttttattggcacagattctgtggaaaactagtaaaaccaaatctccccactttgagatgggttttctttgaggctgtttcttcttttactgaatgacataccattctttgcactgtttagaatgacctacttctctatggaagggtcatgtgaaagttctgcccttcc

SEQ ID NO: 120112 - DNA, 374 bp, Homo sapiens
tggtattggctgatagcctctgggttggtgctgtgactggacatgcaggaaggattagaaatcaagagtggcccagatagtgctgtggatgcccttagtaacacaagggtcacaaaagaatgaggagacttaggagagcctgagggcctggaggacctttggaggggacatttggcaaccacaagaaggtcggttctggagcttgggagaaaggccgtggtggaaaggtcggtctgggaaccacccatgttagggtgaaagttgatgccagatgggtgtcattgcccagggagaggcaagtgcattaagagggcacggtcctattggcggaaacctacagtataccccaaaacagatgaatgccatgtaggcct

SEQ ID NO: 120113 - DNA, 234 bp, Homo sapiens
tttctttcattactgatttacattttcataccattgtggtcagaaaagatactcaatatgattccaatcttcttaaatttgtgaagacttattttgtcacctaacatgctctgttctggagaatgttctgtgtgcttgagaagaatgtattctgctggtgttggacagcatattctgtatattttgtttttattagaaccaatttctctataaaacctagtaagtaaactccta

SEQ ID NO: 120114 - DNA, 131 bp, Homo sapiens
catttttgacagtggtaatgtaagtgttagaaacagaaattctgaacaaaggaattactctttaaaaatcagtatttaatctatggaaaacttgtaatatccaaattccttagtgtgtctagttctgcaag

SEQ ID NO: 120115 - DNA, 312 bp, Homo sapiens
gggaatgtgcaacaaattctagtcatggctcttttaacttagtgatcttggttaagccaccatatctttctgggtcacagtactttcggcagttaagaattagacttgagccagatccaagattctttgaactctgacattttatcattccttttaatgaaggaactgaaaaacatttcggggcagtggggaagtggaagcattattttcagaagaacactgaagttagtattttttcaattaacaaaaagttcttcctaacttactgtttctttacttagccaccaaacattaatcactgtcttggttcta

SEQ ID NO: 120116 - DNA, 378 bp, Homo sapiens
ccgaggacaagagccccacaggagctctttgtcccgcaggagagcagcggacccacgtcagagaagatgcttgtatcttttcacggctcttctctgagaaatgaagccacaccatgatacagtctgcaagaggaagccgggaatgagagatggcaacaatccctgtcactggaacggtgacctcgctggacaagccacccttttggaacccctccccttatgcctgtggcggtggcatggtgctatatccggcctgggctccggcctctgctctctcctccctcttgctctgtcctccctctgctctgttctccctcttgctccttctgctctgtcctccctcttgctctgcctcccctgtcctagatgcctctcgct

SEQ ID NO: 120117 - DNA, 583 bp, Homo sapiens
tgggtcatccccggtctttggcagtagaaactattcgtcttgtcttggtttccattcaggagctttccttcccaaaccttgtcccctgctttaggagtaatttttttagggctttaggtttttctcatgtcccagtgactaagcttgcttttgggtggttctctgtgctgcatgtagtccttctgggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttcctttctcccg

SEQ ID NO: 120118 - DNA, 394 bp, Homo sapiens
tgttagtctccatttgagctgaatgtggagcacacgcttgccatacacagaatccctcatttctcaaaatgtactgctcttttctcagtcaatcatcattgaaaaacaatacttcagcaacgtctgattaggttgtcttcttaatggtaaatgtcaatttaagtctgctgaacctagaaatgcttcttttatagttcttttagataaggaggtgatttattttggcggggagtaggaaaggtgtttttcaaagaagacattttgaagcatctcgaacatcactaagactggctaggagcttggacacaattttactgcaagagtactgctagggaaataaaggttgctatgaagtaaaattattttttaatccactattgtgcacatttaattt

SEQ ID NO: 120119 - DNA, 770 bp, Homo sapiens
tttctcacatttttgggattttgttggtgatttcgctgttgagaatggtcccagcatcatgcagcagtgccgtctcgtgttcctcagtgccaggaggctgggatgagcctcacagagaaaccatgtgtgagagcagttctctcaggcaggagtgatagctccgtgtccatgagttcagtgtgggtgaatcacagtaaatatgaactaaggaaatacgcataaaggacaggtgcagcggctcatgcctgtcacccagcactttggaaggctgaggcaggaggatggcttgagcctgggagtttgagaccagcatgggcaacaaagtgaaaccccgtctctacaaaaataccaaaaaataaaaaataaaaaaaaaaataactctgtgtggtgatgcacgcctgtagtcccagctactcgggagactgaggccagaggattgattgagcttgggaagtcaaggctgcagtgagccatgatcacgccactgcactctagcctgggtgacagagcaagacctggtctcaaaaaaaaaaaaaaatgtccaggcgtggtggctcatgcctgtaatcccagcattttgggaggctgaggcaggtggatcacttgaggtcaggagttcgagaccagcctggccaacatggtgaaaccctgcctctattaaaaatacaaaattagccaggcgtggtggtgtgtacttgtaatcacaattactcagaagcctgaggctggagactcacttgaacccgggaggcagaggttgcagtgagcca

SEQ ID NO: 120120 - DNA, 492 bp, Homo sapiens
atgtgcccacgcagctacccttccccttaatgattttgcacaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaagtaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgagccaaggccccatacaacgtgatggtggtgtcagggacgctacctggattttattgaaccaagatac

SEQ ID NO: 120121 - DNA, 407 bp, Homo sapiens
gctgccccatgggtagagtatacttttcattttcagttatcaccctgcctccagattaacattctcatgtcatgtaaaggtgagcacttaatagatgaagaattagtgcaccagaaggtggtcctgaaagtactaagccttatcatcatagaccaggcttgtgtgttgcttatggaatcaccactaaaataaacacttgagttgaggccacccaaacttacggagagaaagggaatgatagtcatttagtgtttattttctaaatggcactttaaaaccgatacatatccctagagctttgaaagtattaactgaatagcttttttgctttcaaataagtgaatacattaaacaatgaaatgatgtcataaagcatctaaaataatgatgctagatcatatccattt

SEQ ID NO: 120122 - DNA, 430 bp, Homo sapiens
gacaaaggaatggtatagaactcagtttcaagagatgtttcagcacgccaggcatatataagtaaccatacctgtcccaaataagcagctgaggcacagcagataggcaagactgccaaccaaaacttattagaaaaacaccaggctttcattatttaattcttcccccagtttctaggggaaaggctttctatataagcctccaatgcagtacaatactaattcacagagtagaggacccaaacagctgaagcaaaggaaggtacttttgttttcaatagataacaaggatctttaaaaaaaaaaaaaaaaaaaaagagaggggttaaaaaccgggggttggttaaaaatgtgcgattttcaaaatttcccaggggttaggtttcccaagaagatttcgtgaccaattataattgaggtgagggattaa

SEQ ID NO: 120123 - DNA, 269 bp, Homo sapiens
acagggtcccttccctcctccagatgtccaagaaggctgagtgggaaaatggacttcgcctcccacctggcagcaataagataccctaagcccttctcctgctggatggggtcagaggaaaccaggtgaaacagagttaaaaataagacccagagctcctagcataatcctcaaaatgttgagatttcaattaaaaatcatgtgtgtgaagaaccaaggaaaacttgaatgaaaaaaccaatcaataagcaccaacactgagataacaa

SEQ ID NO: 120124 - DNA, 419 bp, Homo sapiens
tccactttgtctggtgaacatttgcagaagatacactctgcaaggattatagggtgtaagggttaaggaaggcttcataacattggattggaccttcaccaatagcctgtagaccagcaaacatgaacaacaaatatgggcttagcccctgaaatctgtgtccctctgagaaagttttatgataaaggaatggcctgtcactgtgacatcatagatggggaggaaaaaggagaagggcttcctctccacggatctccataaatgatcctttatgctatttgcagtttgcagaaaatgattgccagagactaatgtctgggcagcagacagggtcattgctgccatcttgaagtctaccttgctgagtctaccctgctgacctcaagccccatcaaggactggttgaccctggcctagac

SEQ ID NO: 120125 - DNA, 361 bp, Homo sapiens
atgccactgtacatttgtgtgggttagaaaaagcaaaagtgtgttcataacctcttatgagaagagactataaattactttgcactgaggatctgaaggtaatctcattttacccacattccagtgtaggagacagacatggaatcttaaattttaaaaagatgtatataccatgcaccatatgagaatgatgcaccaagtgctgtggagcccagaaaggtacatgatttttttctgctaggagaggtaaagcagggaagcattacagaggaaggatgacatttgttccatccttggtcttagtttccaatggcacgtgatccacaatgcacgtgatcgggatccttagagtcgcccgcga

SEQ ID NO: 120126 - DNA, 262 bp, Homo sapiens
  misc_feature (28)..(28): n is a, c, g, or t
actctcggaggcgtgaatggcatcgganggcgttgaatggcatcggaggcgttgcaatggcccggaggcgttgaatggcccggaggcgttgactggccccaggctgcccactgtctgctcaggcttccaaagctacaacctgccagcctatgctccatacctgccctgcgaggtgaggagctccgggagggggaggctcagcacagatatgagccataaccacctcctgaggggatggggggtggccatgtacagagctcag

SEQ ID NO: 120127 - DNA, 603 bp, Homo sapiens
agaataagacagaagtgacaagaatctgatgtctgagagtaagttatacattacattgcagcttcaatatttctctcttggatcaccagctctgagggaaaccagctaacgtgttgtgggaacactcaagcagccctatcaagaggctgttgttgagagaaatgtaggtcttctaccaatgacaaagattctttggttggccaaattttagtcaggcttctgagccttctcctaggtccatctgtgcacttccttgtaaaatctagttttagcaaagaacctgctaagtctagtttagcaagaactgccgcccatcttcgatatctgatcaggttcctcctcctccaccatcccccaggtgatggctgatgggcctgtcttcagcaagaatcctgttgggtcagtttggacagaacccctttaccccaacgtttcctcttagtcattttccattcactgctccccactctgttccttggctcagaattcccactcgcccatgctgtattcagaatggagcccaatctctctccccctctgcaagatcccattgcagtggtccctgtgactatctcaatggtcctgaataaagttttctttact

SEQ ID NO: 120128 - DNA, 201 bp, Homo sapiens
aagtagctgagaatacaggcatgagccaccacgcccaggtaatttttgcattttttgtagagatggggttttgccatagtttttattgagacttcatcacataagcattactgattgatcagtttcccacatggttaatttcagtctccagcttggctgataacccatgacttaaggctcccacactaaatcacataattg

SEQ ID NO: 120129 - DNA, 252 bp, Homo sapiens
cctgttatacttattaatctgatgatctctgagaagttgtaatgtctcttactttttagtatggttttgatcaaaatgcaaatctgacctacttcccctgcccagcttccaaccctgctgtggctccccagtgccctcaggaggacacccatggctcagccaagaatgctgtgctttaagaacaaaaaagctctactggggtgcctgctggctgctcagcccttctcatgacactctctaagccccactact

SEQ ID NO: 120130 - DNA, 401 bp, Homo sapiens
agagtactgagcactcagagggtggtgaggatggaccaaacaccaagcactcagagggtagtgaggatggaccaagtaccgagcactcagagggcagtgagatggaccaagtacctagcactcagagggcagtgagaacagatggagtactcagtactgagcactcagagggcagtgaggacagatggaacactgagtagtgagcacgcatagggcagtgaggatggactgagcaccaatcactcagaggacagtgaggacagactgagcattgagcactcatatggcagtgaggatggaccaagcaccaagtactgaccacttagagggcagtgaggatagactgagcacccagcactcagagggcagtgagaatggaccaagtaccgagcactcagagg

SEQ ID NO: 120131 - DNA, 336 bp, Homo sapiens
gtggcacactcctgtgatcccagctactcacaaggctgaggtagaaggattagctgagcccaggaggttgaggctggagtgagctgtgatggcaccactgcactccagcctgggtgacagagcaagaccttgtctcaaaaaaaaagagaaaattaaagacaaatgtccaaacatttaaatcatacaaggtctttaattatggcagggaatatataggatgacataatcatttagaatgcttatactataatgcgtcatacttgcattttattgccattggattattctggggtgtgtgtgtgtgtgtgtgtgtgtgtgtgtgtgtgtgtgtgtgtg

SEQ ID NO: 120132 - DNA, 216 bp, Homo sapiens
tgaaatcacgcatatgaaagcactttgaaactacaagccacacagctgtaccatggtagattattggacaagccaaatattattgctctcatttacaaacaaggaaactgaggctggaagcagacccgggaccagggcccaagtctttaggttctttggccagaggtctgtcctctccatgacgatgcttcactaactaggagcaggtaggaagta

SEQ ID NO: 120133 - DNA, 562 bp, Homo sapiens
tgaatccttgctctgtgacttgggacagctgagttgccttctctgtgcctcagtttgcttgtctgtaaaatgggattgctatagtactatctcacagtgttagagggagggctaaatgacatcgagtgcctggcacagggagtgatcattctggctcttccaagggtagaagagggaggttttgcccagaggcaaaggcacaaagaccattgactattatggggccagatgggccctccacttgagacccacccttttccccatgcccaggtcacctggctgccatctctgaatcaggcggaagaggtggaggtgaaactaacattggttactgtatgtcccataccgtgctaggcccatctcctttttacagatgaggaaattgaagctcagtggtgtgaaggagtttgcccaggagtgcacggctccatggtggagcaggaatgtgtcctcatgcttttatacaggggtctttcccaccccactcaactcctgaagccccctaagaaacagatgtagggccattcccaggctgcgggtgctgggtccaaggtggggacag

SEQ ID NO: 120134 - DNA, 508 bp, Homo sapiens
ctgggtccccacacacccatttcacagatgaagaatgtgacaccttgcccgaagtcacacagtagttcatgacagccagacagaggcttgtccaactccaaagccatcctctactccacagcaccaagctttttgtttttgtttttgtttgtttgtttgtttgtttgtttgttttgagacggagtctcgctctgttgcccaggttggagtacagtggcgcgatctcagctcactgcagcctccacctcccaggttcaagcgattctctgcctcagcctcccgagttgctgggattacaggtgtgcaccaccatgcccagctaatttttgtatttttagtagagatggggtttcaccatgttggtcaggctggtctcgcactcctgaccttgtgatccacccacctcggcttcccaaagtgctgggattacaggcatgagccatggcacctggccatgcccccccgctttttttttttgagatggagtcttgctctgtcacccgggctg

SEQ ID NO: 120135 - DNA, 290 bp, Homo sapiens
ggcttcgactaacattttggggtggaatggattttggggagtagggcatggatacatctctatcaggcaagtacagcagaggaagagaaaggcaagaacatcagggagtttgcaggatatgattctcgtgatggattatggagtcttaactagccaaccgtggactagtcacggttggctactagtccacggttggctactagtccacggttggctactagtccacggttggccactagtccacggttggctactagtccacggttggctagtacgctggaatggaattg

SEQ ID NO: 120136 - DNA, 370 bp, Homo sapiens
cagaattccacctccccacccccagccaaacctaagctattagcaaattccctccttttctaaaattttccttcgtaatttacagtaaggtcagtctcacaaaacaccagcgtttaaatgaagcttctgctatcttggcactgaagaaatgtactcaaggcaggtggggtagacaaggaacatgaactaggttatgaatccctgctttgctgtgtcagaaaccaagccataggaaatagaagcgtgtatagattaaataataccgtgctgtgccaccagaagcacactgctgccaagagaagagaaagcacctataagataaaggaaaaagagaaaaagggagggtaaaagggagtttcattcataactc

SEQ ID NO: 120137 - DNA, 215 bp, Homo sapiens
ccctcgctcacggagcctcctaactggagagaaccacttccaaactgttcagccatctcagtttctcctacattcaacctggtcctggtgtgcccagcttagcctacaaaaataagcagaactgggctaaattatcttggatttggaggtgtcctcccttaggggaggtggggaggtgtctgagccacctagaatgagggtgagcatggggataa

SEQ ID NO: 120138 - DNA, 322 bp, Homo sapiens
tcttacctgcctggcaaaaccaaaacctcagatgcatgtttccgttcatctttgctgtgactcttacgtagctttgtgcagatggagcaaagtgtgaagacagaaatccatgccccagcaggtgtgcatcctccaagctcagccaggccttccagtgtccagtattttcccttggtctcctgttccctataataacactaaatgggccaggtgcggtggctcacacctgtaatccgagcactttgggaggccaagatgggtggatcacctgacgtcaggagtttaagaccagcctggccaacatgatgaaacactgtctcta

SEQ ID NO: 120139 - DNA, 897 bp, Homo sapiens
cacatctgagcttcatcaaaaactaaagctaaagtcctagctttggaacatcacggaggtccctcagctctggaacatcaaggagacccctctttctggaaatctgggctttgtcagatgttggaactgggtcccagccctagaacatcaaagaggtccctctttctggacatctgcgcttcttcgaaagctagagctgaagtcctggctgaagagggacatcaaggaggtccctcttcctgtacacttgatctttatcaaatgatagagttgttatcttggctttggaacatcaaagaggcacttctttctggacacttgagctttgttaagtgctacagctgggtcttggctctagaacatcaaggacgtccttcattctgaacatccgagctttatcggaggctggagctggagtcctggctctaaaacatcaaggtagtccctctttctggacatctgagcttcactggaggctggaactggagtcctggctctagaacatcaaggaggtccctctttctggacctctgagcttcttcagacactggatctggaatcctggctctagaacatcaaggtctctctttctggacatctcagcatcatcggatgctggatctggagtcctggctctagaaaatcaaggaggtccctctttctggatatctgagcatcagacactggatctggagtcccggctctagaatatcaaggaggtccctgtttctgaatatctgagcatcagatgctggatctggagtcttggctctagaacattaagcaggttcctctttctagacctctgagcatcacctgatgctagatctggagtcctggctctagaacatcaaggaggtccctctttctgaacatctgggtttcattggaggctgg

SEQ ID NO: 120140 - DNA, 549 bp, Homo sapiens
cacgagagtctcaccatgtcacttctctgctcaacacccttcaaagcagtactgcttccagagccagcaagaggaatccctgccccaggcccctcatgacatggatatgacactgacgcttcctttgctggagaacccatgacagcctaggtcatgcaggctctggtaccaagggctgcggggtgcaacccacagcttcaaacttctgctctacacttctgtcactacagccatcgggcctcagtcacaggcttcttgctctaagtgtttgaaacaaagagcaactgcgtctgcgcgccattggtggagatggactttgtacaagcgccggagtgaaatgaaaaatgaatggggagcatcataacttcgggtttccagtctgccacataagaagcttggaagtcaccgctccatcctaattacaaaaaacagaagtaactgaaagaaaaaatacatatacttgttagattatttctttcaagtagcgtacatgcaatagattattaatattttaaaaacattcaagaataattaaatggattcttacat

SEQ ID NO: 120141 - DNA, 381 bp, Homo sapiens
agtttttggaggacattaaaagagctactccaggaaacacacaaaaattaagtaggtcaaacagccttattgcttacatggagaaagttttagtggtctagatagaagatcaaaccagctgcaacatttctacaagccaaagcctaatccagagcaaggcactaactcccttcatttctataaagtgtgaggaagctgcagaaggaaagttagaagctagcaaaggctggttcacgaagtttaaggaaagaagctgtccccataacataaaagtgcgagatgaagcaccaaattctgatttagaggctgcagcaagttatccaaagatctaagctaagagcactgatgaaacaagctatactaaatgacatattttcagta

SEQ ID NO: 120142 - DNA, 821 bp, Homo sapiens
agaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctc

SEQ ID NO: 120143 - DNA, 632 bp, Homo sapiens
gttaggagataaatttcaagacatgtgtgtgagagagagagagagcaagagagcgagctgtgagctgtgctgccgccgccgctgccctttgatcccgacattagtgttaggggctcggagacacagagcgcggccatagacaccgccgcaccggcactcatttatttatacctcccatcacacacgcgagcataggacacacacacactcacacctattagatccgtttccattgaagaatattacgctcggggacaagccaggtgcacgaccaaaaatttaaaaaaaaaaaaattttggggcgcgcgcaccctgggcccccagagaaaagtttccagaaaccatgcgcggtgggggcgcgcgcggggccacagaagggtaaagtggaaccgggggcaaagagggggtccccaggggaaaccgcggacgacagacaaaggagggctgggttatttctcaccaattaaaaaaaagccgccggggggggagaaacgcacagaggggtttctgaaacaaaattccccaaaagggggggtgcccggagaggggacataaacggggactcttcaacacgaggggagctcaccaagggagagccggaagtacaaattttgccccgacagcgggggggc

SEQ ID NO: 120144 - DNA, 894 bp, Homo sapiens
tgagaaaaactttttccccctagatttggtgactagcgggataaatttgaagaactccatcccacccccgcacgcgcgccccccattctttccagacagagcggttgtaaatccgaggctgagtccgccctgggagccttggggcactttcctctttgctctgtgtgtgtgtgtgcgtgcgtgtgtgtgtgtgtagctctcgctctttccctcagtctgtgcctcttgtgtgtgtgtgtgtgtgacagagagagagcgagagagagagcgcgagaggagagagagcgagaaagagagagagagagagcaagagagcgagctgtgagctgtgctgccgccgccgctgccctttgatcccgacattagtgttaggggctcggagacacagagcgcggccatagacaccgccgcaccggcactcatttatttatacctcccatcacacacgcgagcataggacacacacacactcacacctattagatccgtttccattgaagaatattacgctcggggacaagccaggtgcacgaccaaaaatttaaaaaaaaaaaaattttggggcgcgcgcaccctgggcccccagagaaaagtttccagaaaccatgcgcggtgggggcgcgcgcggggccacagaagggtaaagtggaaccgggggcaaagagggggtccccaggggaaaccgcggacgacagacaaaggagggctgggttatttctcaccaattaaaaaaaagccgccggggggggagaaacgcacagaggggtttctgaaacaaaattccccaaaagggggggtgcccggagaggggacataaacggggactcttcaacacgaggggagctcaccaagggagagccggaagtacaaattttgccccgacagcgggggggc

SEQ ID NO: 120145 - DNA, 906 bp, Homo sapiens
agaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccgctgccctttgatcccgacattagtgttaggggctcggagacacagagcgcggccatagacaccgccgcaccggcactcatttatttatacctcccatcacacacgcgagcataggacacacacacactcacacctattagatccgtttccattgaagaatattacgctcggggacaagccaggtgcacgaccaaaaatttaaaaaaaaaaaaattttggggcgcgcgcaccctgggcccccagagaaaagtttccagaaaccatgcgcggtgggggcgcgcgcggggccacagaagggtaaagtggaaccgggggcaaagagggggtccccaggggaaaccgcggacgacagacaaaggagggctgggttatttctcaccaattaaaaaaaagccgccggggggggagaaacgcacagaggggtttctgaaacaaaattccccaaaagggggggtgcccggagaggggacataaacggggactcttcaacacgaggggagctcaccaagggagagccggaagtacaaattttgccccgacagcgggggggc

SEQ ID NO: 120146 - DNA, 671 bp, Homo sapiens
atgttgaagagaaaaagcaatcaatagaaacagagtcggaaatgacacttatgaaagaattagtggacaagaccactaaagcaattgggataattatattttatgtgttaagaaagtagaggagaaattgagcatgaaaagtagagacatggaagttgttgaaaaagacccaaattaaacttctagagatggaaaatacaatatctgagatgaaaatacattggataggatttatttacacactgcaaaaaaataaattagtgaatttgaaaacaaagcaatagaaattatctataaaaagtacacggagggaaaaacactggaaaaagaaggaaagaacagagcatcagtgagctgtgggacagcgtcagatggcttaatatgagtgtaatggagtccacagaatggtggtgggaaaggaaaaatatttgaagaaacactggctaaaatattttcaaatttgatttaaaaaattccacttattcaagaagctcaacaaactataaatacaagaaatatgaagaaaaccacaccaatgtacacaagaataaaattgcttaaagccagtgataaagagaaaatcttaaattagccagagagaaaagaacagtatagttggccctctgtattcatgggttctgcatccatggattcagccaactgcagatcaa

SEQ ID NO: 120147 - DNA, 228 bp, Homo sapiens
tctgtgtcagtgctgagtgtctgtcccactcttcatggggtggctgccgtggcctctgtgtcagtgctgagtgtctgtcccactcctcgtggggtggctgccgtggcctccgtgtcagtgctgagtgtccgtcccactcttcatggggtggctgctgtggcctctgtgtcagtgctgagtgtctgtcccactcctcgtggggtggctgccgtggcctctagcgccagt

SEQ ID NO: 120148 - DNA, 563 bp, Homo sapiens
agcggaattaaatgagatagtatgtaagtttctcacattgtaggctcatgttatcttccttatattcagccctgcgtagtctgtttctcactatcacacatttgctctttaattacatatttgtgtatacgtttctgtaatttcaaagaagtgagtcaaatttaaccctatcatagacatgactatagtaatcattttggtatgttttataaggtgggtgagggaggttgttttgccctgaaaacatctacaaatgctagcatataaaattgagcaaaagatgtgggatagagattgaattcatattctttgtgaagactattaggatttgttcttgtgatgatcagattgtcagttcagtttactgtatttcacacacagtagccccagttagggttccagaaatgcttataaatttgtctcctgtggtattatcttaatgtggtgttggattcttcatcgctgaagtcagctattcaggtaaaactttatttggtaagatcagatacctaagcaatatatagtcactaagtcacttcatatataaaacttggggccggata

SEQ ID NO: 120149 - DNA, 199 bp, Homo sapiens
cccccctccctcgggccgcgttacccagggcaaccgcagtgcggccgcacctgagctgtgcgcctgcgtcccgcgggcccgaccctcccttcccctcggccttcgcccctgccccgccacagccgggcggaagggggcgtagccccgcctcgccaagtgaatatcggcccgccgcccccgcccagcccggcagacacag

SEQ ID NO: 120150 - DNA, 317 bp, Homo sapiens
taatttccccccccccccccagcacaaccagaatacagaaagagaaatagtttttccatttacatgtgttagtaactggtagaaaatgattccaacaaatttctaaataattattagaatttaagtgtaattaactcaatgaataggtttctgggatgaccaactaggtggatgacagtgccttttactcagatggggaaaagtgaagatcacacttgtggtaggaatgggaaatcaaaagtttgatttagaacacgtttaagaaaagatgtccacattagctatatgacagtggaactcatagcaagatttgggta

SEQ ID NO: 120151 - DNA, 330 bp, Homo sapiens
tggttgaaaatatgtaatagccatatgttcacagaatcatctgaataatttatttctgtattctagatgatctattgttataaatggaaaggtagtttataaatgtttatgtatattatctatgttaggattacaactatttaaaatatatgcatagtaaacatactggaaagaaaccaaaatgataactatgattttgtaaatatagtggtaggataagtaatttttgtctaataattataaatgtgttccttaagttgtttttggttttttgggggttgttttgttttgttttgttttgttttgtttttaatctcgagacggagtctt

SEQ ID NO: 120152 - DNA, 177 bp, Homo sapiens
gagacagaaccaccaagtaggagatctttgatactttattcttctaatgggataatgccaactttctccataatttatggctaattaagcttgttctatcagctttgatccttctaaaatagacatcttatttctcagacttgcgttactacttttcttccctagtttctcaccatt

SEQ ID NO: 120153 - DNA, 750 bp, Homo sapiens
gaactaactctggtattagaccaagccagctggaagtagattgtatctttcagtccccagatgctgtgttctcattttctgcaaagagctcatggtctaataggcagcaagctctaccctcccacaaataagagctttatccacgaagtgggaaaatggacgggtagttgttaatgtaattattttcacctgtctcccatgattgagtttttgaatgttactgtttgttcttttggtttttctttttattacggaagaacatgacattgtggaaggagagtgagttttagggaataggaggaattagaaatacagaaggacctacaagttaaatgtcttgtttctcaccctagaagttctaatttattttataagtttgagccagcgatgaactttattttattaattttgtattaataccaggtcttaacagatgattttaagagcctagaaataagataatgatactaggtgttaattcttctaaccaccatttattgagtgtttacgacagaccaagcatatgcatatatatctatatatattatcacctgtaatccttgcagccaccttgttaggtaggatttcttacctctgctttaaagatgaggtaactggggcttagggagtgacttacctaccccacgttgcactaagtggtggcagagccaaattcaaacctattttgcataattctaaagtcttcctgcttagccactgccactctcctgcttccctattatggtccta

SEQ ID NO: 120154 - DNA, 855 bp, Homo sapiens
catataaacaatattttatacatctttcctctctttgtgtttttcacttgtatcctagaaatcagtctgtagcagtgtattactccattgtgtggatgtaatattttttcaactagtctctaattacatgattatttggattgttttcagttttctgttattctgagtttgtgtttgaaatacagtatttcaaacacaagggaaaaaggaaaaaaacttttgttgttacaaatagtgcttcagcgaataaccttgtgaatatattttgtttttctgtttttgttttgttagagtatctttggaatagattactattagtggggtggctggattaaggaggaaatccatatataattttgttagatattatcaagttactctgtactggggttgtaccattttgcagtcccagcagaagtgtatgagagtgcctgtttttccatagcctcaccaacataatatgttgctgtcaaactgatttttgccaatctattagagaaggaatggtatcaaaatagtttttaactttcaagttaatattaaaatttttttaattaaaaaagtaggtatatgcttattaaaaaaattaaaaataagtgcaaaaagtgaaaatactctcaattttcttccattctcatttgcttggtataacatgtatatttcatgtgacacagatagtacatgcatatacatacacacacatacttgtttttaagagtgagaatgggccaggtgggtggctcatgcctgtaatcccagcaccttggcagcccgaggtgagcatattgtttgagcccagaagttcaagaccaacctgggcaacatggcaaaaccctatctctacaaaaaaacaaa

SEQ ID NO: 120155 - DNA, 941 bp, Homo sapiens
aggaagacaaaaagacagaaaaagaaagaaagaaagaaaatggcatgcaagcagcagagtaaaaacctttaagaaaatgaaagaaatatgttatctcccatgaaacaactatgagtcaagaatatgctcattttgaagtttgggagagtacactggactattttaggaagaaaatgatagttttaaattagaattttattactgggctgggtggggtggctcacacctgtaatcccagcattttgggaagccaaggcaggcggatcgcttgagcccaggatggcgaaaccccatctttattaaaaatacaaaaaagtagccagatatggtggcacatgcccatagtctcagttactcaggagggtgaggtgggaggggcaagcccagggaggtcgaggctgcagtgagccataatcgcaccactgtactccagcctgggcaatgggaataagaacctattttaaaaaaattattaatgtgtaaccccatataaacaggttaaaaagaaaaactacactatcatcaacagattaagaaaaaatatttaataaaattcagcccttatttgtgatttaaagaaaatactcagcaatctaggaatagaagcgaatggtcttaacatgacaagatacacttatcacaaatctatgggccaggcatggttggtcacacctgtaatcccagcacttcgcgaggctgagacaggcagaccacttgaggtcaggagttcgagaccagcctggccaacatggtgaaatcctgtttctacttaaaataaaaaaatcagcctggcgtggtggtgcgctcctgtaaccacagctactcggcaggctgagacaggagaatcgcttgaacccaggaggtggaggttgcaatgagctgagatcatgccactgcactccagcctgggtgacagagcaaggctctgtctcaaaaaaaaa

SEQ ID NO: 120156 - DNA, 413 bp, Homo sapiens
gcatctttaaacaccccacgatggttaattttgtgtgtcaactgactaggctatggtctcagttgtttggtcagacactagtctagatgttgctgtgaaggtattttgtagatgtggttaacattcataatcagttgactgtaagtaaagtaaagtggatgaccctccgtaatgcaggcgagcctcatccaatccagttgaaggctttcagagtaacaactgagggttcctgcggaagaagaaattctgcctctaggctgcaacatagaaatcttgcctgtgttgaaattctgttggcctgctctaaaattttaggcagaagcctgcaacatgattctcatttgaagttccagtttgctagcatgctgtatggatttcagacttgccagcctccacaattgcatgagccaatt

SEQ ID NO: 120157 - DNA, 206 bp, Homo sapiens
gcaggaggccataatccttagccaactaatgtaggaacagaaaaccaaataccatatattctcactttaagtaggagataaataatgagaaaatatcgacacaaagggagaaacaacagacactggggcctacttgaggatggaggcgggaaacagaagtgaggacctaaaaaggacagattagaagcaatagtaatgaataaaaa

SEQ ID NO: 120158 - DNA, 765 bp, Homo sapiens
gaagtttattacagcagtcgtttggtgcgcggaatccaggtggcgtgtgcggtgcatattgtgacaaatccatgtatccatcttgcggatactctgggacggttgcattcaatgcttgtgtgatccgtatatcacatatcgatataagtgcccagttcgtgggaaccagcaatgctattgttacataatccaggatggatatcatggaggggctatatactgaaatctaatcaaggtaggcacacgcgatttgctgagctcgccctctttgatatatacatctcgaacttggaatttgcctttatttcaagttgtatttgtgggtattcagaattattgtacctgtgtataactcagtggttcaaaagtcattagtctttaataaattagaatttattttaaaaattcaagatctgaaaacatcatttcattgactctcaagtaatgttaatgccaagttttgaaaagcaatttttctttttggaggcagtaattttgagtaattggattccatgaaaaaaatggattcaggagctaattgtgtaccaggtttactggcatttgtgcaaaacaacatttagcaactgtcagtgacaatactcatctaatttctctttatcaccagctggtcaatcacgtatcttcatcaatacaagtattttaatttcctctttcaggtatcctctttgtgtgttttcttccttctcactctcccttctctccttattttaagctactttagaaaatagtaatactttactgatg

SEQ ID NO: 120159 - DNA, 268 bp, Homo sapiens
taatgtgataaataacttttacatttagcctggcacacgtatgcatgttgcatcaccaagtccatatttagttgtcactgttttaaaatgtagctgggcatggtggctcacgcctgtaatcccagcactttgggaggccgaggtgagtggatcacaaggtcaagagatggagaccatcctggccaacatggtgaaacccatcctggccaacatggtgaaaccccatctctactaaaaatacaaaaattagctgggcatggtggcatgc

SEQ ID NO: 120160 - DNA, 504 bp, Homo sapiens
  misc_feature (429)..(429): n is a, c, g, or t
atccttgcattcctgtactcccggaaatattcattagctcagactcatatctgccccccaggatagaattcctgtagctgtgacctttggagcaggtgagtacctgccgcctatgagctgtgtgaccttgggcaagtcactcaacctctctgtgtcttagcttcctcatctaaacaacagagataataatatccacctcagtgagctgttaagcagattaaataagtttctgatgtgaagtactggtaagcgctgcataagggtttgctgttattatttcagttgctgttgttacaggcattcactccatgttgctaactgctaaggggtttccctcctttccatgggaaaggtgatgtccattctgacctctcctgggcctccctaatcctgtgggtgggacattcagggcaggcccaggcatcaggntttctggtgcagccaaggttggacactactgttttgggtgctattcttggggcatctgctctgcaaggaacccac

SEQ ID NO: 120161 - DNA, 457 bp, Homo sapiens
tgggtcttcctgggtgtgaccacatccacagcctcccctagagctgagtctgagggcacttgcacctgggcagccagtcgcgtacacacacaggcgccccaccatggggctctgctgcattccagggagcacattcgccgcgtgcacagagaagcacattttcacgcatgtgacaacacacacatcagcatgtggacccgtactgctgcccacaccaacaccagccgtgtacccccactgctgtccacacccacaccagccatgtacctgcattgctgtgcccgacaccagccgtgtacctacactgcagtgcctgacaccagctgtgtaactgcactgctgcccacagcagcaccagccatgtacccacattgctgtgcccagcaacgtaagctgtgtacccgcactgctgcccacaccagccgtgtacccccactgctgtccacacccacaccag

SEQ ID NO: 120162 - DNA, 1495 bp, Homo sapiens
agaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacggaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaagaaatagatgtttgcctatgaacttcagagcagaggacttagctagcggtattctccgagaacgagtgaaagtgggtgcaagcttggctgatgttgatccaatgaacattgataaatcagtaagttttgtaa

SEQ ID NO: 120163 - DNA, 1537 bp, Homo sapiens
agaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacggaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagctagaacctctaaattgcttcctttggagaaaatcagtatagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaagaaatagatgtttgcctatgaacttcagagcagaggacttagctagcggtattctccgagaacgagtgaaagtgggtgcaagcttggctgatgttgatccaatgaacattgataaatcagtaagttttgtaa

SEQ ID NO: 120164 - DNA, 804 bp, Homo sapiens
gtttacactgcacagtctcctcacttcctttagacctcccggtgagcaagcttgtattgtcttttgtgaattctggcatctgcctcccctctttttcttcctgaggttctgcccaggaaataccacatactggtcattctaggcccattcactgtctaatcaggctttgagcttgctagtgctatcagtgttttacagctgagaaggctggctcgctgaggttggccattgcctgaaggtctcccaggttgggagggtcaggttggggggttgtcacatacccctttccaccatgtcacaatgtttccttctaacacatgcatgcacatcataaaaggctcgagacccagtatatctggtctccctgcctgcattaatagcaccgctgccaacctccctcccacttccctccacttagttttatcatctaagaggccaaaagaacaaaatgtcccccctccaccacaccatatttcaaagggctataaataggactgttagtggtggcattctgggtcacatttgccagggacagactttatatgatgtcagccgtgtccttgggtgcaaggtttccatggctaatagttttctttctcccttctcttccttcccattttcgttccttctttttctccctccctttcttctttcgtttcttcatcctaaaaatcttgttcgaaagtacatagttatgcagccttcattagctgaggttgcttagaagacaaacaggtccatgtttcacaattcctcccagatctgagaaaggaacgtgactctgagcggacagaacaatatatg

SEQ ID NO: 120165 - DNA, 693 bp, Homo sapiens
gcacccatccttccctctctacgtaagctcccaccacaggcccttccggtgtttgtcttccagtctcagccagccttcttggctttcttggacctaccacgccttcagtccctgaaggctcctgttcctcctgccttcaatactccccacctacaccaccctccctgcccagcagctctgttggggtttcccaggtcatgcctcccatggctaccaccaactcagcccagaccatgccaaatacccctcttagacatttgcctggcacaagggaccttaccatcgaagtccttggcgcagttgtccttgtacatatatctgcgtcattctttgatcaaggtatctatctagactgaagtcttcctaaggaagccatctcgcttattcttgcttgcctttgtatctccatcatgtaccaccatggggtttaaatactcattgcagaaataaattattgagtacattagattcactgggcatacaccagtttatccctggtccttcagtcctcatattaggatggtaccatagtgagtacagtcctgaatgatatatggtataaatctatacataaagaaacaattctctctatcctcattctgctccccaccaaaaccaaaaggatcttcagaaacttaacacttatcaaatataaaaccaacgtatataaacagaatacttatctttttaatt

SEQ ID NO: 120166 - DNA, 257 bp, Homo sapiens
gttctaggagctatttagatttgcaggtatcattgggtgcagtggctcacacctgtaatcccaacactttggaaggctgagttgggaggattgcttgaggccaggagtttgagacaaatttgggcaacaaaaagtgagaccttgtctctacaaaaaaaatgccctctcatttcattgagagggcatggcaggagcatccaattcaggggtgtgatggataaagagatgttatatataacctaatatataacatgtaa

SEQ ID NO: 120167 - DNA, 694 bp, Homo sapiens
gactctgaagggatgtggaactgtgtcacacgaggtaaggattgaccagggcagtgaaaggaagagctggaaaggacatgtttgttaggctggcgtgtgggaaagggttggtattgttctctgagacataagggacagaacttagagcaaagagtagaagcaagaggaagctctattttaaatgattctaaggaagaagtgtctaatgcttaaagatgaaacagattgctttaaaaggaggcaatttctcctgtcactggaggtattcaagaagcttcaacatcacgcacagcttactcgtacacacagtaagggatgaatgaatgtgtgagcgagtgaatggctgagggtgtgagtatgtaagtgtgagtgaatggagactgaatgaatgagtgagtgtgtgagtggagaatgaacgaatgagtgaatgtgtaggagtgtgtgtgtagagaatgaatgagcgaatgtatggatgagtaagtgtatgagcgagtgaatgaatgaatgagaggggtaagtatctaggttcagaacacttgtgagtactggttactctacctgtgtaagttgcaccgcttgagcataggattgctgagacccagaagaaaagtcagcattgctctcacactacagacaaatagaggtggctcaagaacttcagatgacacttctgaaatgctgcattacgctcttc

SEQ ID NO: 120168 - DNA, 306 bp, Homo sapiens
gaatttctgtaatgagattataatgcaaaggtttgtttagtcacaatattttttaaaattttaattatgattttcgggcgatgaccccaatctttccatcttttacattcaactgccttttaaatgctggcttccttcaatttctcttattatgttcatcctctttttaaagtttttgagcataactaaaactaccctacctttgagaaccctctgtcttcacctagtagaataaatgaaatgtggatacaaaggctgagcatataaattacctttaaaaaagaaaatgccttctacataaagctt

SEQ ID NO: 120169 - DNA, 223 bp, Homo sapiens
tcgccatgttggccaggctagtctcaaactcctgacctcaggtgatccacctgccttgatctcccaaaatgctgggattacaggtgtgagccaccgcacctggcccactgaagtgttaaaatgaccctttgctctcagtttaacactcctacccatctttctgctctctggttttagcctacagctatattggtttgtccttttaaagatttccccgacttcc

SEQ ID NO: 120170 - DNA, 241 bp, Homo sapiens
gtcttccgcaaaaccagccactgataccaaaaatgttgcagaccactgcgttaaagtcagggcatcggcagttctggttcctcctagaggctctgaaggaaggctctattccttgtctttttccgtttctagtggctgcctatagtccttagtctgtggttccttcctcagtcttcagagtgcaccaccccaatctctgcctacattttcctctcctcatctgcagcagtagctctccctg

SEQ ID NO: 120171 - DNA, 386 bp, Homo sapiens
gaggggcacatgcaggtgccattgctgacgtaaacgaagcaggcagggtgtgagaggtggggactggggcaaagtggaaacatgccccctccttttttgtgtgtggctagtgcactatgttgcccaggctggtcttgaactcctggcctcaactgatcctcccacctcagcctcttgaagtgctggggttacaggcataagccgccatacccagctgttcagcccttttaaaatttcctactgaaggctgagccatctgtccctcctgcctatctgcccggctcaagttagcttaagtaagctttaaagcacgtcgaaatccctggatcccttgctatcctcaaacctcaaggtagtatcagctcctgcacctgcccccaaagcag

SEQ ID NO: 120172 - DNA, 525 bp, Homo sapiens
catggtggcatgtgcctgtagtcccagctactcaggaggctgaggcaggagaattgcttgaaccagggaggcagaggttgcagtgacctgagatcgcaccactgcactccagcctgggcgacagatcgagacttcatctcaaaaacaaaacaaaacagaaagccattatgtatttaaagttcacccaactttgtggcagttggccacactaagaacttgaattcattctgaatcgaacaccaatgcaggatgagacattaaacttaaagaaagcactgactggagttcagctgtccattaagtaaatgaatattccaaaattctgtaatatgttacactaaaatcctgttttactatctcaactgtgcttaggcagcattttaacgtttaagtcacagctgaaaataaaaagaaaacaagatttcattttctttggggttaaaacaagaaaataaataaacaaaaccaaactattgacatctatatctatatctagtcagatactcacacaaagtataccctagg

SEQ ID NO: 120173 - DNA, 419 bp, Homo sapiens
tgctcgcgccctgtactgtagcacgtggggaggcaaggcaagaggattgcttgaagtcaggtgttcaagactggcctgggcaatatagcgagaacctgtccttacaggggcagtggggtggggcagcaggaaacaacacccaccaccaccaaacattcagaaaacagaggaatagagatactacagtcagacagccaagtccctccatgtgtagcccagaggaagtgccccttcctggatgctctcaccttgcactttgttgctggcccgctggcgaagccctggtccatgcgtggattgccagctggcaatccacgcatgggacatgagcaggcacccacagcacccccggatgtacagacacctgtgcacaaatgtggcacacacaggacatcacagtaaccccttgccccagtgtc

SEQ ID NO: 120174 - DNA, 936 bp, Homo sapiens
tgaggcaaatacacgtaactcatgaacgtaatgtaatcttgcaaaattatgtctgagaaagccctaatattctaggctttttttccatccagccctgaaaattttttctgtagataactttatgttgtaacttattctgaatcttattatggcatttccctgtaaactatgtaagtgtaagctaatgattattttgtgaagcgtgctgtttcaggtattaatctgccatgaatactagatatagtagaaaaactgagaaaacatttagcttgagagccaatttgaactagacactatctttttttctcctttttaatggaataaatttaatgcaaataagtgtaagcaggtatacaatgtttagatgaggcttattttcccaactctttttaacaggttttatgatatccccaatttatacccaaaagactgctgagaggttttatgtcaaattgattacaaacttctctgggttgtatttcagtcttctgttaagtatgaaattgagaaatagttttgctcaacaaaagatgatgaggaattgatttgtgaatgtcactggagataaaagggtatgagaaggaatcccaagcaggcaaagaaacagtctagctgtcaagaagaaaacagggagatacataccaaacccaggagctactaatataacaatcatactatagagcgaagtgaacttacactttttgataaactgatagattttttgtaatgtgattatggtaaaatactgaaatatttatgttaatttatttgcatttgaatgcttacatttttaattgacagaatctttgcatttcattacttgagtcatgaaggcgaaattaaagaatggcagtctaaaatacccaggtaaagaagataatttctagaaacaaaaataaaaattcttttcaagccatgttgtttgaattaaatgac

SEQ ID NO: 120175 - DNA, 334 bp, Homo sapiens
gcttttttattaatgctttgaactgactaggttatttaggggttaaaataataactttcaatttgcatctaagtgtcaaaattgctgaatggtttacaaactcagaaagacaaataaaagagcaaggccaaagtgttgcaggcccatggtagatgagcagcttccatggggtttatcagctgggtttactcaagattgtgtcattcactttaatagcattagctaaatacgtactctagggaaagtaagaaagctgcttacttactgtgctgtccaacgaattggtagctgctctttccatgaatgtcacataagactttaaacttgaagaatg

SEQ ID NO: 120176 - DNA, 402 bp, Homo sapiens
ataacagatgaattatgtgtgatctattttataaagaatatcctacaagttagacattcatataaaagatgttgccttttaattcatcactgttagggtggcagagtgtgcacgcctttattctagaatatggcagtattcaaagctttgctggaaattctcttttgtaattcttactctgcagcattttaaagacttttcatagtgtcaaaccttaacattttgagaaacaaaataagaaacaacaaaccttaacatttgagaaagaatttctgtgaacaatcaaatacttttagatctaaacctgctgcataaaatagaaaagcataatttaaaaccatgtattaattagaaatatatatttagtatgttctgtaactgtgatggagcaatttatatcaa

SEQ ID NO: 120177 - DNA, 361 bp, Homo sapiens
ataacagatgaattatgtgtgatctattttataaagaatatcctacaagttagacattcatataaaagatgttgccttttaattcatcactgttagggtggcagagtgtgcacgcctttattctagaatatggcagtattcaaagctttgctggattttcatagtgtcaaaccttaacattttgagaaacaaaataagaaacaacaaaccttaacatttgagaaagaatttctgtgaacaatcaaatacttttagatctaaacctgctgcataaaatagaaaagcataatttaaaaccatgtattaattagaaatatatatttagtatgttctgtaactgtgatggagcaatttatatcaa

SEQ ID NO: 120178 - DNA, 1083 bp, Homo sapiens
cttgaatccacgtatgacctggaagcctctgcttccagttgtcccattgttccagaccgaaatagtgtacattttacatatattgattgatgtcttatgtctccctaaaatgtataaaaccatgttatataccaaccaccttgggcaaatggtctcaggatctcctgagggctgtgtcacaggccattggtgactcatattcggcttggaataaaccttttcaaatattttacagagtttgactcttttcatggatagtagtctcacatatttaagtagtttcctttctacttattagaaatggttactgtatttttcatcgggtgcctaatctgtaattaccaatccgatcacaagttttcttcttccttttatctgctgaaataatgactaatgttgatagaatttttcgactctgaaccaatcttgcacctctggcataaagttggtcattgtgtattcttttcatacattgtgaaattctatttgctaagattttgacttttttggatctatgctcataaatgaaactggcttctggttgctttatttttgtactacctttcaggttttataaaggaaactaagtaaataaaatgaaatggtgaacttccttcttttgctaagtagttttttaaaagatacgcaactatttaaaacggtttggtggggaagagttcccattaataaaaatcaacatcaacatgcacactaaaaccaatcaatcagtcaggcaggtgcccactccctgttccccacaccactgcccagtatggtctctggtgagaaacaggaatatccagtgtgggataatgagtaggttaggggagaagactttaggtaatggcttaattagactctaaaggtgtcctacagaagtgttttcatgggtgaggagaagaaacttaaccatgaggttctagggacttgactttaaaccacatacgacaatcccaacatttagttgaaaatgtcgtgatactcaaaaaacgcttttctcaataaacataactgtggggaatccctggtaatgaaaattctaagaaatttatggaaatatggtagttacggctgggcgcggtg

SEQ ID NO: 120179 - DNA, 815 bp, Homo sapiens
ggcagagtgtgagaggcctgcagagggcgaggctgcgagggctgatgctttctcaggccggcatgcctgtccgcactcactgtattgcagactttaaaggggtttttttgtacacaaattacacctcaataaagctgattaattaaaagacggaaagctgacaacatcaaatgttggcaaagatgtggagcacctggaactctcatgcattgcaggtggtaatgcaaaatggcacagccacttttaaaagaagtctggcagtttcttacaaaattaaacatactcttaccataagatccagtgatcacattccctggcatttatccactggaactgaaaactcacgtccacacaaaaacccacacacggatgtttacagcagttttattcataattgccaaaacatggaagcaacaaggctgttctgcagtaggtgaataaactgtggtatatctacacaatggaatgttattcattacttaaaaaaaaaaaaaagagctggtcaagccatgaaaaaattttgaaagaacttaaaaggcttttccctagatgaaaaaggccaagtctgaaagggtaaaaacatttgattccaattacttgatgactttcgtggaaagggcgaacatggacacaattaaaaagatcaggggttgcccaggttctaagggggaatgacaggggaggaagtggggagccggagggatttaggaacagtgaaagtttcggggacgatactaataggagggaatctggtattatacattgttcaaactaaaatgcgaatgcaacgtggaaccttattttacttgactggt

SEQ ID NO: 120180 - DNA, 415 bp, Homo sapiens
agtaccagtagggcaaggtgaatttgattcctgttttgcagatgtgactgttaggttgttagggttaatttaataacccaggtggaattgatttggagatagacttaccacttctgatcctttgattggatctagcctccagctcaatataccttcctcaatttgcctacaagaagaaaaagatctgaagctcagcataatgctggctttagccagaagaatccagcctttaagccatctatatgtgtagccatgaaggaccttctaatatgccttgtgagcccttatggggccacctcacagccacaatttatgcccacgtgtcagcctcacagactcaggaggtgtttctattcattgtaaagcagaccagatgacatttcaggatgaaagaaatgtaagtcatcattacata

SEQ ID NO: 120181 - DNA, 887 bp, Homo sapiens
ttattacctgaggatataggactgcaccagaaagtttatgctgatgatgtgacttatggtggggcattgggccaactggtatcagcttggcctcttgaggagctggaaacaaagaccagataagcttatatgaccagccttggataaaaaaaaacaagacatcaaggctcagtgagcttcactgtctggcaatactttatgtgtgttgcacacaccgttggtggtaaaatgaagtgctgtccacatgactccaatgagggaagacaaatgtgtacccggtttcttctggacgctctcctaggtgctttttcccatggttgattttactctatatcctttcactgtgacaaattttaactatgagcataacagcttttctgagttctgtgagttcttgtagcaatgattaaacctgagggtggtcttggcaaccctcgaatacaggtagttttcttgtacatatatcctcagatgaatacttgatgggaaccctctggaatctctggctttatctttctgtgcagctgtctcctttctgacactctcccacatgagttatagtccccttagtctcctgagactaaattccatatcctcaaatctggtagtctgccatcctacacttgggttccccttgcctgcaccgtagcttgggaactcaagcagtaaaagaggaaaatgatagggattattgcatttgtttcttgtctctcagggaatcatagttattcagtgcctgttacaggatagattttgtctgctcaaaaaagtttgttgttctaactcccagtaccccagaatgtaatcttatttagagatcaatctttacaaagttaatcaagatacaatgagggcaggctctaatgcattatgactgatgtccttat

SEQ ID NO: 120182 - DNA, 553 bp, Homo sapiens
gagtcttgtcctgtcacccaggctggtgtgcactggtatgatctcagctcactgcaaccatcacctcccaggttcaagcgattctccttcctcagcctcctgagtagctgggatttcaggcacatgccaccaagcctggctaatttttgtatttttagtagagacagggtttcaccatgttggccatgctggtcttgaactcctggtctcaagtgatccgcccacctcagcttccccaagtgctgagattacagtcctgagccactgctcccagccttacagaattgtttcattttggggcattcagaagtctgacataaaaattaacttgagacttttatgttcattctttttatcttccagtttctttccttccttgctttaaaaataccttggacttattttctgccctcgattttatttatttctttaggcattcagataccaaaaccttgtcctccacctgtgcttgtgaattgagtcacagcttgtggtgtacgttatttccccaagtccatgctcagttgatgtgatgatgtagcgctccctcagc

SEQ ID NO: 120183 - DNA, 509 bp, Homo sapiens
tagtgcttagcaaaatagtattctatatttaaataattcttacatattactaacaacagttagcatttatgtagcctcagaagactggaactcactttgaatgaatgttgcctcataacacctctttgatgtagtcaggaagtatatgattctctcaatgagaaattctggttagaagagttccccaaattatataacaaatcaatagaggagagatacaagtttgcacatttttacttcacgttatgattgtatagttcttgaagttggaaccaagaagccatttgttataaaggtataatggaaagcaacttgttctttggaggcagaaagacctgagttcaggatatttcttatttaagattttccttatatgtaaaaagaagatacaaatttaggttgaaggctatgggatataggtgatcaataaataggagccattattcctgatgccctggtatagcattagtgagacagtcccacttgagaaatgtgatggagcactcagt

SEQ ID NO: 120184 - DNA, 482 bp, Homo sapiens
cccagccaagccctgctagccgctgcagtgtcctgggtaacaccagcccccatggggacaccctcaagccctgactcagacctagacccctgagcggaagtaaaggaggaagaaaaagaaactaaaaagttatccaatacttggttgggcgtggtgggtcacatctgtcatcccagcacttttggaggccaggggatcacttgaggtcaggagttcgaaactgacctgggcaccacagtgaaacaaaaatacaaaaatatctaccaaaaatacaaaaaattagccagagctgggcatggtggtgcatgcttgtggtcccagctactcgggagggtgagacagaaggatcgcttgagcccgggaggcagaggttgcagtataccaagattgttccactgcactccagcctgggcgacagagtgagaccctgtctcaagaaagagaaaaaaagtttgttgtgcacgttcggcaggtcaaatggt

SEQ ID NO: 120185 - DNA, 228 bp, Homo sapiens
tttgatgtgtatgtgagttgtagcaggaggtgggtaattatataaggactcgttgtttgattaatgcccagcatgaggcagcacacagtagggtctcacgttgaggtcgttgaatgaatcatattctcttcagttgagggaggctgtctccattttacgggtgaggaaaccaaggctcagagagggacagctgctttcccagggtcacacagcgagcagggggctgag

SEQ ID NO: 120186 - DNA, 263 bp, Homo sapiens
aaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaa

SEQ ID NO: 120187 - DNA, 223 bp, Homo sapiens
attgaaagtcttagtttctaaagccacttctttttcactaggtttgtacatgcattcaattcatcaaatacttgaacacctgctctgtgcctggtactgttcttgttctaagtgctggaaagagaacagtgaacaaaacataggaaaatatgtgccctcaggaagccttcattctcaacctcactgcctttacagagaggtaggacacagagatcagtaaata

SEQ ID NO: 120188 - DNA, 382 bp, Homo sapiens
agctcccagcccagagcctgacttgctcttttaggttttatacagctttctacctggctttgtcctggatgatgggaaggagattttcagtaattcttttttttctcactctataaataagggaaattttcagatcatgtcttcctgacattctagtgatttcctaatcatttcttggacatcttctgggcactttgggagacatcaactttctaagataccagaaatagcatagattattctcattagatcatgaggacctgaaccagaggaaactaagtgaccacagacaagtcagcttccaaaatgcctcacttactcattagagaaacttgggctttaggaaaatgtaattccttcatttttatcaaaatggagtaaa

SEQ ID NO: 120189 - DNA, 744 bp, Homo sapiens
atcaaggggggagagcttggaaacctggagaccttgtgagcaaggcttcgtagtggggatttctattatcatttacgtattgcatagcatgtaattttatctcttgtgggagaagcttaactcaaagtaactcttataagggatgaatctagtttttattttgaatattgtataatcaaggaataatacagttaagcaacatgccatcagaaatgcacagagttacattttaaatactgtataacacccaagatgatcttaacatggtaggttgtcttcagctttcagtgggagactgtatatttagcttaatgagaacagtgtttctcatttaagctgctttatctgaaataccttctttaactttaggatagctgctgaagtggtacacatttcttccatattacagtgtacttttttacaattgaggttgtatattgacataaaagaaagtagccagaataatggctaatgagttgttttgccagcagatgcagtttactctgatactacagtgggtgtaacctagaagctgtggtaatcctcgtccccatgagggagaaggaggagctgatgttggggcctgctatagattagaccttgtgcatggcactgccccacagcctaacgggatccccaagacagccatctgagtggatggcattgtccttcttgtatacaggaggaaaccaaagctcagagagaagagtgatttgctgaaggtgaggctaggaagtgccatcc

SEQ ID NO: 120190 - DNA, 429 bp, Homo sapiens
tcaggagcttgaggttactatgaactgtgatcagacttctgcactccagcctgggcaaaagcaagaccctgtctctaaaaaataaataaatacaaagacttgtgctgatttttcatgttagtatttttagttttacatttctcttgcatgcttacttttaaaataattgagccaacctctctgtccctttttgttattgcatgtaaatctacagccttctgatataacctaagcttgcagaatcttccatccatcaccttcctagtatgcctcttggcccttattccagcagttagttgcttaaaacaaagcactttgtgttggtagtggtactatataacttatagtctatgcactgttggggattgacacactcttcccttccctaccactgcagtgggaagatcatttagaagactaagttcgatt

SEQ ID NO: 120191 - DNA, 529 bp, Homo sapiens
aaaatgtactgggtgtctgcaatgcgtaaatgacatcattttctctctagtttctaaaaagagttgaactttctatgctataaaagttatccaaaccctcattgagataatattcagcaagggcaaaaccacagggaaaaaagtgatctcagcgttaggggtttccagcttcctaaagaaattgcttttagaagcagatcaatttgagtacaagttctagctacacctctgtagcaaacagaataatggcctcaaagataatcagaatccaatacccagaatctgtgaataggtttggttacacggtgaagaattttggtagcagacagaattaaggtggctaatcagatgaccttaaaatagggaggttatccaggattatggggtgggtcaatgtaaccacaagggtcctttgaaagggaagacagggttggaagacagaccagacccgatgttgctggctttgaagatggaggaagggggcaagccaaggaatgtgggcagcctctagaagctaaaagagagaagg

SEQ ID NO: 120192 - DNA, 693 bp, Homo sapiens
gtatttacatggtatatctttttgtatcctttcacttttttatattattatatttgaagtgggtttcagtacccgacttacagttgtgtcttgtttttactctctaatccagcaatctctttccttattgtagtttgaccatttattttaatgtaatttttgacatgtttggatttaggtcttccattttatttttggcctgtttttctcccatcttttgctttctgttttgttctcctctctttcccttttatgcccacttttggattatttgaaaatttaaaacctatctattgtttttcaaatgtatttctttgagtagactttttattgatagctctaaagattacaacattaatgcctaatttttcatggtctacttagagttgatattttacctctttaagtggaacatataaatctttaactatgtaggtcctttgcacgacccttttgtcctgtaactgttattatgtattacacataccttcactgaaaaccccatcaaagtgttattcttttttgctttcaacagtcaagcatattttcaagaacttaaaagaataaaaataatacatttatctcgattttacctcgtcatttgctcttccctcatttctgaagttccacagttttctctggtatcatcttccttcttgaagcggctcctttagcatttcttttagaacaggc

SEQ ID NO: 120193 - DNA, 288 bp, Homo sapiens
cctgtaagtgacaccgtgaggcttttaacccaaagagtttggttccagaagtctgtcttgctgccttcaagccagccctcgctctgctgctggtgctaacctaaggacttgataccttttttaaggccctcctgagagggaggtatgattctcctccattttcagatgagaaagctgaggctccaagaggttgccaaagttcagctagctgacaagtggcagagccaggatctacagtcacagccatgctcactgtgtcctgtgtcttctgacactcacggctgagct

SEQ ID NO: 120194 - DNA, 270 bp, Homo sapiens
gatagggagatggtaaaatttgtccagcccttttctgcaaagccttctgacagaaaatgtaaaatttttgctgagctttagtcactgagtgtgagtaacatgggcaaagatatgggaccaagaaagccatgagttttaggaaacactaaggtcctttgtagcttgaatattgtgattctacatctgtgaagcctcccaaatccagacctttctcatatcaggatatctgcctggaccttcgaaaacacctctgatttctctgccttatct

SEQ ID NO: 120195 - DNA, 395 bp, Homo sapiens
acccgcctcggcctcccaaagtgctgggtgtctcccaaaggcgtgagccaccgcgcccggccctcccataaagtttttaaataaatatttactagtcagttggtgcttcttgaatttctgtaagtaatttttgtgtgcaacagttgagtcaaaggaagcatgaaaaattgttttgaagcttgactctcacagctatttaaataagttgagaaaataaaatttattcccctctcagaatcagataagacaattggaaattggtgggcaagaggggtgaatgctaaagactgactcccttcagccaaatggggctaacactgaggtccacgccatgattttggggattctgatactgcatgtcagacagacgttgcgattctatagttgtctcttta

SEQ ID NO: 120196 - DNA, 678 bp, Homo sapiens
ctgcagttaaataaaaagattttgcctatgttatttgcatggttaatgtatctagaagggttaattttatattgaagaaacaagtgtagtaattatagaaatgaatataaatattaccagtggatttgaggaattaaaatgtcacagtttcatttattactttactatatcagacctgtgttaaaaagttttgctccagttgaacaaacgagtaaaataaatataggaaaaaataccccaaaaacttttacggtatataaaaagaagaaaagcgatgtactttttattttctagaggtgatgaaaagtgaactagaaataattcctctgttaaaccaggcatcttgtaaaagagaaccatcactatatattgttcctgggattccctgtgaataactggcaatgtgaggctatagtagtcacagctctttattccttccaaaccagttattgtgctgctaattagaattggatattggtggtagtggaaatggggaaaactatcaatgttactttgtgttaaattttaatcacacaagttaggacattcagaattatggtttccatggtaaccacaacactgagtcctgtgtgaaggcattacagtgggggtctttgattaaaagaaagtaaaccagaagtgaaacaaaaatgctccatatgtgcagctaaagttaca

SEQ ID NO: 120197 - DNA, 280 bp, Homo sapiens
gctgggcacgtccagtactaaatcaacccggtccctgtggggtggggcctgccttccctggggcagtgagttcgccttttggtcaagggtctctgggtaccggtatggcgttcgagctcactgcacaggaagccagctacagggaggaagctcgtaggtttcccgtccatggcctgtatccctggggcccctgggttcttccctgggatggtgggacagggggacggtcactctgttggtactgaaaaggagaggccctcattcctagacagagacccct

SEQ ID NO: 120198 - DNA, 283 bp, Homo sapiens
aaatttttctaatcatagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaa

SEQ ID NO: 120199 - DNA, 1064 bp, Homo sapiens
tgtggagacggggtttcactatgttgcccaggctggtcttgaactcctgggctcaagtgatcctcctgcctgggcttcccaaagtgctgggactacaggcatgagccaccatgcccgcctttataaattttgcaatattaagctcttgtctggttttagatcctgatggtgatgttgctgtgatgatacctgggttaactctgaacaaataaggaaaagtgctttacaaagaggctgactgtgaacaaagatccttgtcgtgtatattacccattgcatacaatgttaaaaatgcacatatctgggaaatgacaattacattaaagctttaatatctacatttacttgtgtaatgttaactacaaggcacttactaatttaattaggatgtcattatatacacacttataaagcacatttcagaaagaaaggtgtagatgaaatatagttaattgaaaagcactcagttcaagaagtcaaatatccacaggggagatataaaaaaggaaacaagaaacggttaagaaaaaacaaggttcaagacaccaggggttaacaggtgatgccaatggccagccacagaatgagcaggaaagagctcaagcaaggctgtctgtacagtgtcagctgggcatcacccccaagttacactctaaacacacagaatttttcctgaagttcttaaggaaaggcaagcacctgtttttcttcagctggtgggattctggcttcttgcaatccttaacccactccgattaaaaaaataaggattacagccgggcgtggtggctcacaccaagtaatcccagcactttgggaggctgaggtgggcagatcgcagatcgcttgagctcaagagttcaagaccagcctggccaacatggtgaaatctcctctctactaacaatagaaaaattgaccaggcgtggtggtgcacacctgtaatcccagctacttgggaggctgaggcatgagaattgcttaaacctgggaggtggaggttgcagtgagctgagattgagccactgcactccaacctgggcaacagagcaagactccatctc

SEQ ID NO: 120200 - DNA, 466 bp, Homo sapiens
gtgattatcctgcctcagcctcccgagcagcggggattacaggggcacaccaccatgcccagctaatttttgtatttttagtagagacggggtttccccatgttggccaggctggtctcgaactcctgacctcaggtgatcagcctgccttagcctcccgaagtgctgagattacaggcatgagccactgcacccagcctaacaatatttttaattgagaaaaatactcaatttacaagagcaaagtgagctggtgagtccaacacaaagtctgctaaatggaagacactctcaattctctttttttccaaccaaaatgtgtaaatatttcagtccaaatgtttggcatactgtctttttgctttcattgagaatactgcaagccctcaaataaactagttttgttcactgttgtttttgctcaatgttgtttcattgtaatgttgatgagaaagaaaaaaaaaga

SEQ ID NO: 120201 - DNA, 711 bp, Homo sapiens
gccgacccgtctgatcatcctgctcacgtatgtgtcagacttttagtgcccactgcgtgtgtggctctgcactgtgttcttggggtctaacataatgtaggcaatctgaaggttactgtccagtgtgggaagcaaaaggaaatcacggtataagttttgctttctttaatagcagaaggggctacatcctactgtgggaatgcagaaaagggagtgataagctgccttcatagactgtgctttcattttttgcaaaagtaaatgtaatcaatatgaatttgtggaaagtgtagcatatattgccatgtgttatgactttgagcttattttaaaataaagatggatgcctgtttctgcctaacatgttagtcagtgttatcaaagacaagaggcagaccattcattcactcatttccaaaacactgaatgccattctgtgcctagcgctatacaagacatcggaaattcagtgtcaataagtctttgctttccaatcaacagggacgattttaattatagattgtcttcctattaagtatgaattttagcaggtattaaaattagtttgataatatgagaaaaaaatgaagattgaggccgggtgcagtggctcatgcctgtaatcccaatactttgggaggctgaggtgggaggacttgagcctaggaatttgagaccagcctggacatcatagtgagacctcatctctac

SEQ ID NO: 120202 - DNA, 507 bp, Homo sapiens
tgtcatggtatactagacattgctcaagtgaatcccccctctagtgttaagggcatttactcatgttgaacctagttttatttacagtatatttgtatgcatagaagatggaggtccaccaaagtgttaattatgcttagttgtaggtcaggtatagctaactttccttttttaatatatatatttacatttgtgtttcctttataatttatggcatagattgccacgattttcttaagtatacttttataatcagaaaaatgatattaaggactcattttaagtacactaaatcaaatattagaaggcttctttattttaagctaattgtgaggattatttgtcatttaaaacttttgcttctacttattaccctgaagtatctttgtggtgcttatgtttttcacagactgtataaattgatatactctcccgccccatggtaatgttgctacacataagctctaataattatcatttttaatgttttaagattaattcaactaa

SEQ ID NO: 120203 - DNA, 485 bp, Homo sapiens
ctctcctggttcagaggttgccaccgtgtggcccatatggagatgtgtgcaacgtgttttgcagaaactgcaggactgtagacctctgcagagctagcctccccaccatcccccacaggaagttctattcttgcatagactccagggatgctgtaaacaatctcttcaagaagctcaagttcattcccatgaaaacttcttgagtagaacagcttaggtatcagtcatattgattaagcaacacactgaatttctccaagtttttctatcagacgtatagatgtttgaaccacggggtgttgagtgtgttggcgagaaaggcagtttgctaaggctatgacttcaggatatatctgctgtcagatgatttcataagaactgctaggattctcttcccagtgccctttggacactcggaaatgatctcttcatcttggaaaggggacctgaactgagtctcagcttcctgactcctagcccaaagc

SEQ ID NO: 120204 - DNA, 536 bp, Homo sapiens
gagatctcaggtaggatacatattctgagagcttaattgaatagctctacttatttgtgaaaattagctatagcctagatttaagcacagatgcataacactaagtgattattttttaagctatttggttttataaaagcaatggtatgatttaaactttgcaatgagccatataaaggcatttcataccacctgtaatacaacttctaaacattataaataccaaacagaaagagtaagcttcgaaaactccctaaggggtcatttacatttaataatgatttgactaattcatgctcaaatgtgacaaggacttaactatgagaacagctctgtctgttcaggaggaagtaatctgattctgggctcaatacaacacaatgtacaatgaatgccctgtgaagctagctgacttaataaacttacagatagcaagatcagttttttaaaaaaatgagcaagttcggaattctttcaccattcaaattaccctttgaaattgccaaagaaatataaaatgggcggaggggggaagg

SEQ ID NO: 120205 - DNA, 436 bp, Homo sapiens
gataagcgccctttcacttcacgccttgggttgacagagtaagaatccgagctccaaataaaaaaaaaaaggtacatgcctgagagtcattcttgaatttttcagccttcagctctaaattagttcatgtactagacttgtgtttattacataatgagttgatttattaaaaaatacaagaatatcagaactatcagttctgaagctatctggcattaaacatgaccttgtggaaattaacagaaaataaaaattgatttagcaaatgtaaaaaattgaaaagatgaggttaaatgtcctaatcccataaagtaattctaaatgttcaagcaatttgctgatgcatagccatttccagtcatattttaaatcttgtagataatcttttcatcagggaaaagccttcttggctcaccagtttaataaacaaatccag

SEQ ID NO: 120206 - DNA, 508 bp, Homo sapiens
caaagctgcagggtcctctctctgggtgcgtcattcgggtgtattgtcatgagtgctgggatgaaatggaaatgaacttgccaaattattaacccactctgcctcagtgaggttgacttgagccaggggtgggctgggggagggagacaggggagagactatccattttttccttatatgcttgtttattctttgaattgttagaacaaacgtgagattttcatagcaaccacccaccactacaaaaccattaaaatactgcttaaagggtgaggtgcagtggctcatacctgcaattccagcactttaggaggcagaggaggttggattgcttgaggccgggagttcaagaccagcctggccaacatggcaaaaccctgtctctactaaaaatacaaaaatcagccgggcgtggtgacatgcacctgtaattcctgctttttgggaggctgaggcgcaagagttgcttgaacacaagaggcagaagttgtagtgagctgagatcgtg

SEQ ID NO: 120207 - DNA, 346 bp, Homo sapiens
tgctgtcctctctacttttatatatgtttgaaattttctgtaataagaaaggtccaataaaaacatccattacttaaaagtttttacatgaaagatagaagtttgtatgctggctgttttgggagaaataaggaatcaataattttttgcaataaagctaaaatacacattaacttcatgaatagaaatttagtccttgaagtcagttctgcttcataatgtagagatttttttaacagctaaaattaaatgtgtttagaccattgtttgtgatctaatttcctcttttttccaattttggttatttagtttccgaacacctctaattaaaaaaaaaaaaaatcat

SEQ ID NO: 120208 - DNA, 337 bp, Homo sapiens
tgagaggtagaggctgcaagggagccatgttggcgtggctgcactccagcctgggtgacagagtgagaccctgtctcaaaacaacaaagacaccaatctttccatcctcatgacccagtcacctcccaaagacctcacctcctgccgtccccttgggggtgagcagctcagtgtatgaatttgaggagacacaaacattcaccccacaatatgaccccttgtcaaatgttcaccctgtgatggacatggttccctctgctttacatggatggactccatgaactctcacaacaattccaggacgtcaacaccttcataatcaccgttggacctgtgg

SEQ ID NO: 120209 - DNA, 1003 bp, Homo sapiens
tctggagcccagatctgtctctctcctctccacttccttagttcaggtgccctagaacctctggcctctctgtctggtcctcagataggagtgggtcctcagataggagtgggttggttgacccctgggggcagggcagttggagtacagatatcactagcaggtcccagatggtaggaagacagatcagctcagggaaagctgctcacagcctccttcagagttctgggtcttgaaagcagctgttttgggagcctaactgcttttcccagggacttaaggcctttgtaatttttgtagccctttcatcctccagaataaagggaccttcttgagctcagggccttctcagtactggcatgccccagggctcctcctccctgcctggctactctggccagctccactgcttacccagcccagtcactcctagtccaggtggatcccttcagtggcttggcccacggcctgcatggtgaactgattagcagccccaactaatgggtccgacctcagctccagacaccgctgcactggtcgcccatccgccatcactgttgatgccagggtggttcttcccttcactgttgatgccagtggggcccctccctttactgtagatgccagtgtggcccctccctttactgtagatgtgagcgaggtccctcccgtcactgtagatgccagctaggtccctccctttactgtagatgccagcgtgacccttcccttcactatagatgccagcgaggtccctcccttcactgtagatgccagcgaggtccttctctctgctcagacatctttgactccctcttatgcacatcccactgatgactctcagcacatcccatcaccttcacctttgaggtttatccaggatctgacaagtcccagcatcccagctgctgccccctggcctggcctcctgctccccaaccccaggcatcttccccttctccacatgcggttggcgcaagccaggggggaatcagagcccccc

SEQ ID NO: 120210 - DNA, 565 bp, Homo sapiens
ggactcgtgtgggactttgaggaaggggcttaaatgaagctggctcttcagggagggccccttttggtcttcttgagttcttccgccttctggccagcaacacggttaatgctccagcagcagcttggaccatcgggtggccttagaaatgccaaccaaatgtcttcgtggtgaagcaggaagatggagcctggcattttgctgggactgacacactcaccctggactgcccagccttggacatcctttatgggagagagaatacacttctatcttctttaagtctgtgatttggattttctgtttatccatccaagctgcctgcaatgaataaaatcatgttccccgtcctaggcaacgtttagatgggtctaaatgtgtacaccctctactctgagaatgataggatagttacagaatgtgggaggcaggagtgggaggagaaagcactataagtatgggcctgtcttgagagagccaagaaggactttggcatagccgagcactaggctaacctcacctagcagaggattcacttgcccatcgtaaggggcttggtgagggt

SEQ ID NO: 120211 - DNA, 307 bp, Homo sapiens
tttttttttaatttagagactgaatctcactctgtcacccaggctggggtacagtggtgcaatcactgcagccttaagctatcctctcgcctagctaggactacaggcacaagccaccatgcctggctgatttttaaaattttttgtagaggcaggggtctcaccatgttgcctgtgctggcctcaatctcctgggctcaaatgatcctcccacctaggcctcccaaagcgctgggattacaggtgtaagccactgtgcccagacttaaacactttttgactagagtaaaactatgtctattcaaca

SEQ ID NO: 120212 - DNA, 302 bp, Homo sapiens
tgggtgaactaagagataaacagggtgggtactccagagacagcaatgcccagagaggcaggggcagagggagggcgtggagttcccagaccctgcagccgggtcaccagtggaagctgggagccctgggggcctgtctgtcgcagctggagagaaagggagagaaggtccagccccctctgtctcatgctcaggcctcccatgggtggaacctggaagtgtgggagataccacttgcaggggtctgtccccacaagacatggcagaggagggagaggacaagtgtagagtctcaggacaac

SEQ ID NO: 120213 - DNA, 198 bp, Homo sapiens
tctttctcctcttccttctccctgcctggcaacatcttttcatttctctttcccttaggtgacttattagataatgatgttcctctggctcccatactctctcccaggtcctcttccattcttaaagcactcacaccctccctggatgatagtacccactcctgagatggcagttacctcctgaaatgtgagggaccc

SEQ ID NO: 120214 - DNA, 358 bp, Homo sapiens
cccatgctatcatgggatattttaataataatcaaattgttatgtagatatgccaaataattctgttcaggcagacccatttaattcagcaggaatttgccgatatcctgttctatgcatagttcattagtggattattttaggagtttgaaaaaaaacacctgtgctttaaaaatttatactattttaatgtcacaaatatatatgcagagttctgcttccactaatgatagagtagcttatattggattcagtttaccgaagactagaattataaatcaggacaaaatattaaaacaaaaaaaccaactatttaaagatacaagacagtggtcaaatgcaagcaaaaaatgaaatt

SEQ ID NO: 120215 - DNA, 326 bp, Homo sapiens
ccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttca

SEQ ID NO: 120216 - DNA, 796 bp, Homo sapiens
atctcaatttgaattgtatctcccagaattcccacgtatgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtctttttgattgtagcctttctagtgggtgtggagtggtatttcattgtggttttgatttgcatttccctagtaattaacggtattgataatcactttcatgaacttatttgccacttgtatgttttctttggataaatgtcttttccggtcctttgcctattttaaaatggtaccatttgtctttttattgaattataataatatttatgtattctggatactagatccttattatatatattatttgcaaatattttctctcattctgtgtattgtcttttcactttcttgacagtgtcttttaataaacaaaagtttttaatttcaatgaa

SEQ ID NO: 120217 - DNA, 416 bp, Homo sapiens
gaatctgcctgatgactttttttcctctccacacaaaattttctttttctccccataagtcctcatgcattcattcacagcccttccttggcttccgctggtcagttcctgaagcaatccctggccacagagaaagcgaacgggtactaactgtgtcccgtgctgatgtcccactggtggtggccagaactcccaggaagatcaggaagcaccatcataatcaggagagcggaggccagcttcccagtcctgcagggcctctaggggacacaagatacagggcccaggcacggaaggtctcactggtcaagtcccagtaagaagaggagctcccaagtgagagaatggaaagactcttattgttggctacttgaggtgtgccaggagctgttctaagcatttacatggatttgctc

SEQ ID NO: 120218 - DNA, 138 bp, Homo sapiens
tcaagttgcacagcatgaaaattggatgcagctcaatcattacttttagcatgccatagagctcttttgataaagttttagaaggtccaagctaacaacctaaaacatcatgtattacatatcacacacatcacatac

SEQ ID NO: 120219 - DNA, 511 bp, Homo sapiens
acaggtttgggctagggccagagattctgcatttccaacaagaaatgatgcggatgctgctggcccatgatcacgccccttgagtagcaaagttcttcacgacaaaggaattggaccctcttttgaaatctgttgaagagaatttttctgcgtccctgattcctggtagtgtgctttctctgtggagttgactaggggccgtgaaggaagacagaaggcagtgaggggcagcgcgtcgactgcacactctggaagcccactattggaataggaataggaacagacctttctcaccaatgggccaatttgttcattcagcaaagaattccttgccctgatccggacactgtaattttagggtatcaatgtcctctggccaacgacctccagaaactcacctaaaattgaatggatggaattatgctccatgcagtgcaggaggactgtggggtgacttaggaagaggctttagaaagagattgttaaggaactgggcttgtgtttggtgttt

SEQ ID NO: 120220 - DNA, 347 bp, Homo sapiens
agctcctcctctgtgctaggcacttagtacctcataatatctacccatttaatccccaaagcaaccccatgaaatagatacttttaatacctcctagtctacaattgtggaaacttttataaagacacaaagcttaaacaactttcccaaaattatattaatggccactaatgtggaggagtgatttgcacctaagccaactgtcttggaagtccacattcttagctgaaagggaaatctgcgtttagtaaaggtatgagatggagctaagtttcttcatctgtattctgtaacttggtcattataataataaacattataggattctcagttctcaaaaactaaca

SEQ ID NO: 120221 - DNA, 388 bp, Homo sapiens
tgtcagattgactttccacaaaggagattttatatatccagtcaaactttggatttttggaaaactatgtctgaggaacataaattcaagttgagtaaaatggcaaaggctgacaaaattggaaaatgaaggccaggcacggtggctcacgcttatagttccaacactttgggaggctgaggcaggagaattgcttgaacccaggagatggaggtcgcagtgagccaagatcatgccactgtactccagcatggatgacagaacgagactccatctccaaaaaagaaaaggaaaatgaaaaacgattaatccataaatgacactaaaaagatgagtgatttcagtgcttctgaatggtgaccatgtggtttcttctttattgagaatt

SEQ ID NO: 120222 - DNA, 192 bp, Homo sapiens
catcaccgcagaaacaaaggctccagcctccggacaccatgtctgtgcgcttttcttctacctccaggagacttggctcttgcgggggcactggctctgtgaggctctctagtgggggagcaggctttggggctggaaacacatgcggtgtgccaggcattggaagtggcttctcttgtgcttttgggggca

SEQ ID NO: 120223 - DNA, 376 bp, Homo sapiens
attggaaggatgagtaggtactaaccaggggtcaggtgttccaagcagagggaatagcacttgaaaagctcacaagacaggaaggagcttagagccttcccaggactcagaagtgtgtatggccagagcatggaagggaggatgaaataagctgacgctcactgaatcaccgaaggggaaggccgggatcagctctgcacaaccttgtaggcctcaaaaagggagggcatggagaaagagaacaaactacgtgttaggtgctttaccaggtgctaacacacacgcgatcacctttgatccctgcagctaccccatagtaaatgttatcaccatctccaatttacaaatgagaaaacagaggctcagaaagggtcag

SEQ ID NO: 120224 - DNA, 295 bp, Homo sapiens
agacaggctttgctactaggagagcaaggccttggaataaacttttgaaggattgcttgaaaataacattaacaggctgggtgcagtgactcatgcccataatcccaaacactttgggaagctgaggtgggcagatcacctgaagccaggagtctgagaccagcctggtcaacatgacaaaaccccatctttactaaaaaaatgcaaaaattagccaggtgtggtggtgcacgcctgtaatcccagctacttaggaggctgaggcaggagaattgctggaacccgggaggcagag

SEQ ID NO: 120225 - DNA, 538 bp, Homo sapiens
gaaatgctactagacaaggagattaaaggctcttccaacaactgaaattgagatagaaattgctctctggctacatttttggttatagcctaaatttcttcagtagacatccttctcatgtttcaaatttagtttattgttaattataatacataattgatattctttaaaaacactttagtatgattgtgctattgttggagcagggggtcagcaaacttttttagataagagtcagatcgtaaagaatttcagacatgagagccataatggcttctgtcacatccactgaaatatggtgttataatctgaaagcagccattgacaatatgaaccgataggtgtggctgtatttcaataaaaagtaacttacaacagatggcaggtcagatttggctcatgggctattgtcaacccctgtgtgatacgcagaatagtgactcctccaaagacgtccacatcctaatccccagaatctatgactgtgctgtgttacaagccaaaagggatgtttgtgtgagtacatgtcaaaacgcat

SEQ ID NO: 120226 - DNA, 548 bp, Homo sapiens
tgggttccgcttgactctgcattctcctacttccctgcctgcttactctctgccatcatagttttttgcttcaaccttcaaatgtagccattctttttctaaagcggtacttattctctttattagttaaaattattaattttatgcacttactgttctagctccaattttgcatttccagttccctgctgggaataaattaaattggcagaagctcagtctaagtgcctgcaacagaatttgtcccatatccatacaacttgctcctccacaacaaatgggagaatcatcctcttacctccagcacctgcctcaaacaaagtttctgatccatctaccacgtaactttgacgctgaccaagaattacagcttcaaagaaatcattcgaggatcattaatatcttggtcatgaataacttttatgtgaaaggctctgcagctaatctcaagtgcagtgaactctgtttcattactgtatttccaaatttagagttatttgggttgtatataggtcagataatttacttttttgttttcaacctaatat

SEQ ID NO: 120227 - DNA, 185 bp, Homo sapiens
agtaaacagtatgaacagaaggcattgcaatttagatattcattccaggtactaaaggcaaaacaaaaaaaaattcatttctgcacatgtgccctttcagatttactttaattcaagtcttctgacagaattcagtcagatttctcctgaaaatgaaatgttttctttttttttgtttgtttgag

SEQ ID NO: 120228 - DNA, 611 bp, Homo sapiens
gtttggtagaatacagaacataaatgcttatattcttctattgcacttctaggaataatctaacttcttactgtggatttggctctaatacctgcatatgaacacttttctcaccaccccaacccattctagaaatacagttgtatgacaattttggttaaatgaaaataatttttctccactggtgctaagagatacaacgggcaaactgatatgatgaatgaaaaatagtaagatcttttttaaaagcctgtactaagagtattttgtttaattctgctaagtctaggcccttaaaaaaattaaaataatgcccttcaaaaataaatcaatttgataaattagattacaatttaaattaatttttatgactgtgagtttacctgaagcatgaaaaattaacataagagcaatttcacatttaaggcaataggattaaatttaaaaggtgacatttttaatcagtctgacaaggtggactagtccatgaaggctgcccagaaaacacaactagatgtgaaatgattaaatacctataatctgccatattaaaaatatagttagaaaaagtctaaacataaaaaaattataattataaaaatataagaata

SEQ ID NO: 120229 - DNA, 504 bp, Homo sapiens
ccaagaaactagcatgacttgtttcctgcaagaaatatctgggaagttctgtttatacttgaacaaaaggtatgtcccaccactgatagtgccacagtctctctgttggagttattttgcatagcgtgaaactagaaagcaaagcacaaaaggatggtggaaaaagcagttggcaaactactgctcatgagaaaaatctagcctgccacctctttttgtgaataaagttttattggaacacaggcatagaaatgtgtttacatatcatctacgactgcttgcacattctaacaacagagttgaattttttgcaacagagactgcatggcccaagaagcctaaactatctactatctgtccttttacagaaaaagtctgctgtcttctgccctgggctcaagagcttggactcaagagtctagagtcttgcaacttgaattatggtccacatactagcaacagcaacagcacctgaagcctgttagaaatgcagaatctcaggct

SEQ ID NO: 120230 - DNA, 419 bp, Homo sapiens
cagacaggtattctgagcacagagaagagcaattaatctaatctgatggttcagattgaggttagatactgttatttaatagtggatccaacaaaataccttatacctagatgatgctccttagtagtttgttgaatgaacaaactaaagacctgttttgcaattgctgaaaaattaaagaaggatatcaaaattgggggaatgaccctctgcagtttttcacctagtatctaagggtacaaaactaatcttctgaaagaagaaactaaataaaaaataatagactatagagccaaaagttggaatctttctttttctactgttactctgatggagaaattaagagattgggagaagatatagttatgggactataggccaaatgagtttccttataatttgtttggtattgagctggt

SEQ ID NO: 120231 - DNA, 870 bp, Homo sapiens
gtggaagcctccattgatatcagtaccaaccaaatcatactaagtgagcaggttcttagtctttatatgaataaggctttccctaaagtagaaggagtatgcaagcagcaactatatttattgagcctacaatgatatttccttttgatataacattcaaattactgtcacctcaaagaagacctaaatttgtcttaaagattatacagtactctttatctaacttaatcacatcagttttatatttatttaaatttctgtcttcactcttaatatattctacctcccagaaacaaactgagaaaaatgcctgcatgagattatttcatgacagaatgaaaagttatcatgctaagagtgtcttactctaaggaaatttttatattcagttaactcatgattttgttttttctttagccctactttaaattgtttttcaaaggggctaaatttatattaatgtatagtcatatattaagctagtatactaatgaactgcaatcagaaaaaataatagtgcatacctcatttaattgagcatcacttgattgtgcttcacagataaacctgttttttacacattcaaggtttttgacaaccctgtgttgagcaagtctatcaacaccatttttccaacaccttttgctcatattgtatctctgtatcgcattttgctaattcccacaatatttaaaacttcatgattattattattatatttgttatgatgatctgtgatcagtggtctttactattgtaattattttggggtgccatgaaactcacccatataaaactgcaaacttaattgataaatgtgcatgttctgactgctctacaaactagccattccctaagggtcctgtggga

SEQ ID NO: 120232 - DNA, 266 bp, Homo sapiens
taacctgcaagatttggaggaaaggagctgtttctaattcatctttgtatatctgtggtgcttaataagtatttctcaaatagatggattagttgtttgtagtcttgtgtgtatctctggaaaggaagggctcattcaaatttaagcctatgtgaaaatgaacccttgggcttgagagctctaatttgagtaccagaggtaccttagagtgagtactttagaggaccttatacaatatctggaggcataaaggaggtgtttttttt

SEQ ID NO: 120233 - DNA, 417 bp, Homo sapiens
taggttcagcagtgcatgtgcaggtctgttacatatgtaaacttgtgttgtggggggttgttgtacagataatttcattatccaggtgttaagcctgttactcattagttattttccctcatcctctccctcatcccaatctccaacctcaagtaaggcctagtgtctgttcttcccatctctgtatccatgtgttctcataatttaaccgttacttataagtgggaacatgtgttatttgattatctgttcctgcattagtttgccaaggataatgaccttgggctccatctgttcacctgcaaaggacatcttctcattttttatggctgcatagtattccatgatgtatatggattacatagtattccatgatatatatggaccgcattttctttatgcagtccacattcatgt

SEQ ID NO: 120234 - DNA, 286 bp, Homo sapiens
aggggagctagtcccagtgtttgaccagccagagtaggcccttctatcagtaagtgaaagaagtgggtgtggggggaggtgctgcaagaatagtggggacaacaccaactgtcatatttactctaatccttggtacccatacaaagtcactaaaatctagaaaagtaatgtttttttaaaaaattgcacccagaataagggagaaaaacgtctttttaagttctataatcccaggttatcagttggcttgcaactcatggagaaatagaaaccacagctgcttagt

SEQ ID NO: 120235 - DNA, 229 bp, Homo sapiens
catatagtggtgtgttcctgaagtcccagatactcaggaggctgaggcagaattgcttgaagccaggagtttgaggctgtagtgcaccatgattgcacctgtgaatagccactgcattccagcctgggcaacatagcaagacctccacctctaaaaaataaatattaaaataaagtattagattttttttttctaaataagaaagattaggcctttgaaagaaagattg

SEQ ID NO: 120236 - DNA, 454 bp, Homo sapiens
ggggactgaatacctggactgacaggcacctccatagaactgagacccatgagacccgggacccgcagcctccctgccccgtgccctggtgccggccctcagcccagcttcctcgtctgcatgcagcagctcctctgtccaccagcagaggctcttctagggccttgctgggctgcagctgactcaggagggcaacagcctcttcagagaatttgacagcatggagaaccaaacaaaagcagaaagtgaagcctcagaactgggttcaccatcatcccagttttttacaagctatgattttgtcccatctttattaacaagataaggaagtatgaaaagtaatctcgacatctgagatggtgagattacagccccaggagccacccagctggctgaggagcctgagaacaaggcacagccacatgacctgtgccagacaaatgctagaatgatg

SEQ ID NO: 120237 - DNA, 343 bp, Homo sapiens
gagctgagatcgcgccactgcactccagcctgggcaacggagcgaggttctgtctaaaaaaaaaaaacctcagatctcgtgagaattccctcactaccatcagaacagcatgggagaaaccaacctcatgactcagtcacctccctcgacacatgggtattacaattcgagatgagatttgggtggagacccaaagccaaaccatatcatcttagctgtaggcaaaaaaaatgggatatatctttattctttgactttctagaaatgccactatctcaaaaatataagcctaggagacagagggtgaaggtagggtaccattttctatggtagtggggatgag

SEQ ID NO: 120238 - DNA, 747 bp, Homo sapiens
gatcaggacaatgtaaaaaattggactgaatttgtattgtgcagaccttgaatttgttggtttatttcttaaccatttctgccatttaaaaggtgtagtggaaaaaattggttatttgaattttggataaatataatttacagcatgcttgtatattataccttttagatacatgcaaatttatatataagaatgtgcagagtttttaaaacaaagagtaacaaattaaaaaataaaagaatgtgcaaaagtttttatttttaatttcttcttcttggccttttccattgtttccccaagttaatgccaattaaaattcagttagcacaaatatacgttgtagcaagaatcaagtactgtacctcttcagtccttgatgttcattaacctttcctagctactggcatcttcatgttacaactatatgttagtaaaccaggtagtctaattagatcaacagtctgaataccaccaaccgttaagtttgaaatgtagaaattgatgtcctgttcatcagtttcagacctgtctatttaaagagagaatttgtgtgtgtgtgtgtgtgtgtgtgtgtgtgtgtgtgtgtgtgtgtatgttatgtatttatttatttattttatttttttgagacttgagtctcactctgtagcccaggctggaatgcagtggtgcaacctccacctcttgaattcaagcagttctcctgcctcagccttccaagtcgctgggattacaggcatgcgccac

SEQ ID NO: 120239 - DNA, 230 bp, Homo sapiens
cacagctgtgcacacagcaagctcacagctggacttcctatcgacattctatctgcccttgaaccattttttccatccttgactgtgtcctacttaattaaagatgctgctgtctgccttgctacccaagccagaaacttgacggttatttctcaatgtctgcattcaactgtcactaagtcctatcaatctacctcttaaatgccacttaaacctgtccttaccagcct

SEQ ID NO: 120240 - DNA, 770 bp, Homo sapiens
agctgagagggcgtcaccagcgtgtcggcgcctgcggttttcttcgggctgtccccaggcgtcgtgcccgcgtccgtcacgcgcggtggcttgcaggggcgcaccgcgacagccttaaaggaaaacctgttagggacaagggctgctgtgggcagcgagggttatagactcatgtgtgttctgaattctggtgggggtagtgatggacgctgacccagttcacagaattatctgactggcgaagtaaaggtacttgaattgcaggaaaaaaggtcaaggtgaactgaagaaaataagtctttccccaaaggaggtagaagatggggaagatgagatgtcagaagctaaggacaatggcagtagagatgaggttcttgtccctcataagaattgcaggaagaataccactgtcccgggaaagaaaggggaggaaaagtctctggctcctgtgtttgctgagaagttaatatcaccaagcaggaggggagccaagctcaaggaccgtgagagccaccaggagaatgaagacaggaacagtgagttggaccaggatgaggaagataaagaatccttctgtagggggttcccgatgagtggctgtgagttagagacaagctgctgtgtgtgccattctacagcacttggggagaggttctgttaaaaatccatccctctgaaaactgccttggcaattcccggctgattcttcgggatgggcctcattgatggggagtctcagtggatgtttgacttttgctttctacctgacc

SEQ ID NO: 120241 - DNA, 598 bp, Homo sapiens
ttgagactccgtagtcaagtataattgtaaaccagctagtaaaattgaagtttcttttttcatccttgtgttatttggaaacaaaattaagaaatagagtctcttttcttcctcctactttattcaacagccctcactccatatggatactgtatactttggattttagaatattttaactcttaaaggaatgggcagtggaatcacaatatcactgatttagcagatccttggtaaatattcgtcatgtgatcctgtggcaatcctaaataggaattcacctctttctcttaagctttcccatagtactttatatctctttaaaaaaatcagttgtttacattactacattgaaagttttttggaccaccaaccttgtttctgtctcagaaccttagctaaatgcagggtattcaaatatcccatccttatttcctgtcatttcttgtcatgagtcttaggtcctactactatttacctgcttataattacacatttagtttgaagtgttttatgtttgcatgcttttctttcacattattccccctaactgaaatgcccttcatacatttttttgcctaattaaatctgtcagttc

SEQ ID NO: 120242 - DNA, 382 bp, Homo sapiens
ggggcgggtgacctagaggatcccgatcagagcataccgtatcatcctccatccctggcagcaccaatctagttcctgtcactatggatttgcctattctggacatttcatataaatgagataatcaactctatagttctttctggctggctgctttgatttagcttcatgttttcaaggttattccccagttagaagtgtatcatttctctttattgctgaatgatacaccattgtatgcatagaacacattttatttgtccatttaccagttgatggacatttgggttgctttcactttttggttatgaataattctgtgatgtacatttgtgtacaagtttttgtgtggacacatttcatttctctgggatatatacct

SEQ ID NO: 120243 - DNA, 632 bp, Homo sapiens
atccaaggctgtaaaactctcaagggccagaatggtgctgacgtcccttaattcttgccagaaatggagaaagcggcccttatcctcatcagtactttgttttgttattaggacttaaagtagaactgcttgtctatcctggatttacaaattttttttatgaagtttagtttcttcctaaaaagctcaaaatccagtttgtaagattaggtagaggacaaaatgccaatgtgttccttctcttgtccttgatttttaaatctttccatggacacaggcatatactttctctgtatttaaccgaaactcaacccttcttgcaaatctactcatagaaaaacaagtcaacagattcaccagctggaacattatttcagatgcattgaaattcactttgtctgagtttcttttgtactcaaatagaaccaccaattacattgacatgctgacttcaaggtttctgtgcacaaaccaggtagaaatattgaattgctaggaaaagaataagaatctaatcttagaggagaggtaggagtagttacatttatgttggggagttgttcgaatagtgacagtgctttgaagtttaagaatagaagggctcccaatggtgagcatggagagtgagaaaa

SEQ ID NO: 120244 - DNA, 688 bp, Homo sapiens
gtgacttctgaatgcggactggaggagatgaggatggagggctgggaggatagtaagagagggagcagggagaccagttacgggccactgaagtagtcaaggtgtcagacaagagctttgagacaagaggactcgtcttagagatagattgcatgagggccatgagggtaagggaggtgtccaagctgacctcagccttctggcttgtccactggttggatggggtcaccattttattgtaatggcggatactggttgcagagaactgagtgttggaggaccatgaatgagttccatttcagatctgctcagcttgctgtccctgggagacaaccacaggagttgtttaggagacaccgggctacttcagcctggagctccaggaggaggtctgcattggtcgttgggacaataggaccaggacatggcaggctgcaggaccccagttgcaccaaactgccatcccctcctgcctggtttcccttcttcatgaaccgatcaatgggccatagccaggttgggatgcatgtcttccacaggatgggaactacctccagctgatcagttaacagttcagttggggacctttgagtaaaatagatgaccctctattaggtggttgggcctcttccaatcagttgacagcctacagagaacaaagactgatctccccccagcaagaaggaat

SEQ ID NO: 120245 - DNA, 369 bp, Homo sapiens
ataagctaatgcgtcgacctgttatttcatggattttggcagacagcatgaaactcctgagacagagacaaaaggttttagtacccatagtacatcaagcagcatgaacatcatgctgacatctgctcctcatgtcctccaagtcccactggagtagtagtgagtgggccagtggatgctgtgcatgcagtcagtgggtttgtctctattgcagccaaggaacactgggcttagggagcccactgcttttataaaaagcctgctcttggccaggcgtggtggctcatgcctgtaatccctgacctcgtgatccgcccgccttggcctccgtcgacgcggccgcgaatttagtagtagtagtcgacccgg

SEQ ID NO: 120246 - DNA, 392 bp, Homo sapiens
attatacatgtgggagttgtatttctaaaattttctcattaatatgaaaaacagagtaatgaaaaacagagtaacttattgctcctttttgagattgcccagtaagtacaatagtatttaaaagtgttggaaggcgaggaaactaacactttagccacaccagtatgggttgtaagacttgactcctgaaaaactcacctaatcaaagtctaagctggtaagaacctcagctttcatcccagttcagcacaagtatagtccatgtcatcttaatatcatgccaagtaaaagcagcaagacacaaaaggccacatgttatatgattacatttatacaaaatgtctcaaataggcaaatccatagagacagaaaattctttagtggctgtcagg

SEQ ID NO: 120247 - DNA, 726 bp, Homo sapiens
tgggattacaggtgtgagccactgtgcttggccgttgtcaggctttgatttaaaaaagttatgctagcttcatacaacaggttaggggtgtttcctatttttatgttctctggaagagtttgtataagattgtcattcttttttacttaaaatgtttagttagaatctactggtgaagccatctggagttctcctttaagggaagtttttgaattatggatacaatttcttgaatagttatagagctattaatattttctatttcttaatgtctcagttttgataagttatatatttcatttatcatctaaatatgttatctttaaaattttttaattattggcataaaccaagtgtagtggctcatgcctgtaatcccaccactatgggaggctgaggcaggaggatcacacttcaggcaaggagtatgagaccagcctggtcaacacaatgagaatctgtctttacaaaaaaattaaaaaattagcctggcatggtggtgtgagtctttagtcccagatactcaggaggctaaggtggtaggatggcttgggcccaggagttcaaggctgcagtgagctatgatcatgccactgcactacagcctgggcagcaaagcgagaccctgtctccccctccaaaaaaaattattggctggctgggtgaggtggctcatgcctataatcccagcactttgggaggccaaggcaggtggatcacaaggtc

SEQ ID NO: 120248 - DNA, 268 bp, Homo sapiens
ctagaggatcccgtgtgtcgagataagaggataagaaatcaaagataattcagtacactttttattttagtaatctcaatgtccacaatttaccataaacagttactatcggaaaaaataaaaacaaaaaagagaggaagagataatcatatgaatatgataagcattatcaataaatagcgaaaggtcaggcacagtggctcatggctgtaatcccagcactttgggaggccaagatgggaggatcccttgagcccaggcattcaag

SEQ ID NO: 120249 - DNA, 185 bp, Homo sapiens
gctggaagcacgatggggaaggctgggtttatttctgggtcagaatgttgaggggcctcactggagggagtgatacgaattccctcaatttagcctaccagctcttgtgcccaagccctcataagtggcttaaacagaacgcctgaacacacatgtcataaatcagccacacgtggaacatatct

SEQ ID NO: 120250 - DNA, 182 bp, Homo sapiens
ccccttgtctatggccaactcaggttcttccatgccctctcatcttgcaaaaatctttccttctctccccagtcccaggccctacccacaagcccatctaaatcagccgttccttccacaggctccaaatgcttcctccactccatcctcatagcaaggatcacactttggtgcaattcatt

SEQ ID NO: 120251 - DNA, 216 bp, Homo sapiens
acatttgatatgaatggagtcatacactgtgatctgtcgtctctggcttctttcattgtactaaggcataatgttttcagggttcgcccaggttgtagcatgtatcagtacttcgttcctttttatggctttataatattccactgtgtgggtataccatattttatttatccattcttgaactaatggacattttgattgttgccactttttggg

SEQ ID NO: 120252 - DNA, 168 bp, Homo sapiens
gagagagaatgcttgtgcctgcctctgcccaaacattcataaaatcatcagaatttcatgactggaagggaatgggaggtgtcaatggtgaggaagagagaagagtcaaagatgtccagccctctggctgaagccactgggtagatgatagtactgttgaataagatg

SEQ ID NO: 120253 - DNA, 334 bp, Homo sapiens
ttactgtgaaaatgttattaaaaagtccaggcggtgctttctttttactcaaaccaaatgagtattcttccagagctcatttttattttaaagcatatttcttttatggagctgtgatttagtctctaataaggataaataatcattatataaaaaaaggctggtgtcatagattttagtactacatattgatagaaactgcttcagtggttttagataagtgtattttccggaaataacttttgaatttgtggaatgatagtttttctctttttaacagttaacttgtctctactcatttctgcccaatatagaagctctgagaagctgggag

SEQ ID NO: 120254 - DNA, 311 bp, Homo sapiens
tccccttgccacagagaggcgatgagactgaataaaataaactcaacagagaggaggagagacgtgtgtgtgtgtgtgtgtgtgtgtgtgtgtgtgtgtgtgtgtgtgtgtgtgtgtgtgtgtgtgtgtgtgtgtgtggtgtgatagggtgatactatgttttatatcacggtgggtgtgctatcctctctgatgtggctctgcctatccaagaggaaaatgtataatactacgccttatatcgcgcggtgtgtacaccttttctgtgacatcgttcgtaaaatccggtggggaatcagtgatagcacgcc

SEQ ID NO: 120255 - DNA, 455 bp, Homo sapiens
agcatcaaatttatctgtaatattacatttaaaaaaggataaagtaaatatgacaaaaatggatacatgttattctctacatttattatcttaaaaaaatttttcaaaatgaatgttagaataaaaaaacacgacctaaccactgtttcatgtaaataacagctagggctttgaccattaatagtatgttttccatttctctgccctgtatacaactgcaatgtagctattaaaaagccagtatgttaccagatttcatgaatagtgggtctcaacttcaaggaaagacgttatttccaatcttctctctactaccagactacacttggaatactgtgtccaatgctgggggccacaaagtattgtgagatgtttaagatgaggaaggtcctaaaatcccatcttaaaggtgatatagctaaagtaatagggcctctttagccagaaaaaaattg

SEQ ID NO: 120256 - DNA, 349 bp, Homo sapiens
ctcacatccttcccaagccccactttctatttcaggaccttcttgtctctcactggggctcttgcaaatagcctcccaattgatctgcagactcctctcatttttccccccaaatactgataacattttaatgttattaaggcatggatttgaataagctattcctctgcttgaaaacttgcaatgtaggctctccccatggcctacatactggttgaagtccaaactccttagtctgtgccatatttgagggtaacaaatgtatctaatcagaggccttctcttgggaagtgagaatgtgaagaagaagtggcgagggggttttcattcattcaggaaatattgatta

SEQ ID NO: 120257 - DNA, 385 bp, Homo sapiens
ctctctacctagctcgccacctactcattggagttgtaataactagcatttcataatttccagtgtccagcattctaagcatttaccaatgttgttcattttaccaaggttgtcttctcacaacaactttatgaggttgtataaatatcatccccattttacaggtgaggaaactgaagcacagagcggtaaataccttgacctaggccacacagccggtaggcagtacagctaggacctgagtccaggtagtgtggctccaaagtctgcaccatttaccaccaagctgtaagaaaagtgctcatccacagaacaccagatcatccccaaattctctactccaaagggcatgagggtgccaatgaatgctccaccatctaaaata

SEQ ID NO: 120258 - DNA, 266 bp, Homo sapiens
agaacattcattggggaaatgccaagaacattcattgatactactactgagaaaaaaaatcagtatttacattccaatagtaagaatatagtttgtcacaaatttctttgtaaatggagggggaggaagaccagaattcattagtttcttgacaaactttacttcccaaaattaataaagcaccatctgcatcacaataccttattcatctctcttgcaaaatcaatctttcttcccaaaactaaaactgatttctgcctacaaaa

SEQ ID NO: 120259 - DNA, 512 bp, Homo sapiens
atgaggcatttgaacttgggtatcatcaagtaatgtagagctgagagggatctcagaggtcagcaaagttagtttggcctatagcaggagaattccttgtattgtatctttttcagtagatgtatttagcttttgtcctccacctctgggaggaggagacaccatagctggctaggagaacccaggtaactgctgggaacttgcacagcaaagctatttgcccccagagcctgattctgtgatgttcacttctttatttcatgattttattctgtaactatcatactttcccacccttagccctttctgccctggattgaagatactttaatccaaatgtcaaccaggccaggcaggtaatgtaaaggtgtaatgttccagggcgccctgttccctagcaccaaggcacctgtgccacttcccaaggccacgtggaatgagggctcagtgtcagcagatcttcagatttcccaagagaagctggaaatccagatttgattgatatttacatg

SEQ ID NO: 120260 - DNA, 485 bp, Homo sapiens
cgatctaaggatcttcccctgtatcccaccctacctatacttagtccttttcttatacaaatgaaatatttgcttagtaatcctttttgattcatatgctgttttataataactatagtgcttcttctacttaagtaatttttgacatctctaatcaatccctgttgacttaaatacattagaagtcctcaaaatctaaacattaaatagtttttatttaaagaagataaactggatataagtaagaaatactcctcaacaggctaatctttgatatccaaccctggggtggactgaattatagggactttgtttatctgacgtaaaccagaacaagtaaaacattcatttcgaattaaagtgtttttttttttaagagtatgtatgaaaaatgcattattaaaactaagagacaggccgggcgtggtggctcatgcctgtaatcccagcactttgggaggccaaggcgggtggatcacctgagg

SEQ ID NO: 120261 - DNA, 244 bp, Homo sapiens
atcagtgttctgtaaaatgaagaggtcactaaccggcattcaaaagcttttggctatctaggcctccctgtcgcaggcttagaactgaagacactggctgggcgcagtggctcatgcctgtaatcccagcactttgggaggccgaggcaggtgatcacctgaggtctagagtttgagaccagcctagccagcatggtgaaaccctgtctctactaaaaatacaaaaattagctgggtgtggtgg

SEQ ID NO: 120262 - DNA, 777 bp, Homo sapiens
gaactggagatgtagaaagtacttttcctgaaggagttatgtctagatagtaaaccatcatattattattattattctcagacatttgcattgtcagggatttaactaccacttctgttttggtgacccttcaggtgagctctccctgatacccatctttaatacctaaaatcaaactcgtgtcttttacctctatttcttctcggaacgttttttgttttatctattaaataaaattatattatctgccacttagtttcaaaatcctaaggttgtcctttttcttgataactgtcagtttgatccttctacagcagttagagaaaaacaaccaaacatcgatacctctccaaattctaacgtttatttctttgccttcttttttctccctcactttttccccatcacaacacatatttaaggatttcatctttactgtgtgaacctttattttgttttaactttttcattcttcctacacacactgccagattcatattgtaaaccttttttaatatacctcattcttactatcttaagaaacaataacaaaacttcattgtctccattctgtccacagggtaaaaatcaacccttagtagaaacagcctaaatgtcaatagaggtttgtttaagtaagttatggcatatatatacaatgcaagaacaggcaacctattcaaaataaaattctatttcctgtgaactgaaaaaaatctctaagttacatcattaagaggaatcaagatatattaagtgagaaaaatgaagtgcaca

SEQ ID NO: 120263 - DNA, 444 bp, Homo sapiens
gacaatctgcagtgagcaaggctggcttgttagtctcaggcaggcattggacatttttgtctttattctgtgaacagtctcacaagggagacatcattgtcccgctccacagatggggtcactgaggctcatgagtgccctggcccaagattctgcagctggcaggtggtgtgggactcacacccaggtctgtctgatttcagatttcattactatactgtgaggttttggaaactgttgatttgttcaaacaagcagtcgaaggacataggttaaaaaagaaccaaattctggctgggagcggtggcttacgcctgcaatcccagcattggaagccgaggtgggtggattgcctgaggtcaggagttcgagagcagcctggccaacatggtgaagccctgtctctactaaaaatacaaaaattagccaggtgtgttggtgggt

SEQ ID NO: 120264 - DNA, 438 bp, Homo sapiens
tcttatatatggtactagaggttgaaaagtcattagatatttaagaccatagactgggtgagatcacccaggagtaagtgcagataaagagaacccaagactgagcccaaggagactggggagtagcagccaaacagcttttgccatgcagagatcataaacgacctttacaagagaagttttggtgaagtgctggatacaaacccgtaatttagggtgggttcaaggaagaaatggaaggagaggaactgaaggcagaatataaataaatgcttacacaaaatttctctgtaaaggtgagtagagaaaggctgtgactggaggggaaagggaattcaaatttgtttgtttttctgatgggagaaatgccagcatgtttgcatacagatgagaatgacccagatgagaggcacaattgatgatgcacaagagtccttg

SEQ ID NO: 120265 - DNA, 456 bp, Homo sapiens
ggccactaaatacctctttgttttgttttgcttagttttctgcatacctattatttatccccaaaagctccagaaggactctgaaacaactctatgtaagcaggtatgcttggttatgtattagtccgcatttcttccccattagaagcatcctttctggggccttacatctttctgctccaatttatatagctgctacacagctttcatcttgagactttgttttactatcatcttgagaactctcttctacattggatcacttgagtcttggatcactccatcttcttgctttacctcctcatgctggtgaatcatatccttcattttcatgctgagaaaagggtgaatgaaataaagttttagagatgatatatgtctgaaaatatgtatattctactatcatacttggagtatagaattcttttaggttggtgcaaaagtaatagcggtttt

SEQ ID NO: 120266 - DNA, 103 bp, Homo sapiens
taagggggagtatgtactcatgggctttaatgaacaaactgtgaaatgtctagatatcttgagtagccaccactctagtttgtcagtggatgaaggtgccatg

SEQ ID NO: 120267 - DNA, 540 bp, Homo sapiens
tcacaagtttgctttttctagtctttttcatctcaggatgacactatcatccacccagttgttcaagccaagtatctagaagttagccttattctccacatttatcctgtcagccaggtatgattaaactaatattcaaaagctatctcaaattgtctcctctcctctaacatcatggctcaggtctacaactctctttagagtcctcccatggattattatgtcccaacagtacatccctccatggagaagttgaagtaatttttgaaaaatttttattttgtaaagacagagtcaccctatgttgcccaggctagtgtccagctcctggcctcaaataatcctcctgtctcggcctcccaaagtgcttggagtaatgttttaaaagtgcgaatgagaccatgttgctctcctgcttgaactccctcaaagcttcccatctcacctagaagaaaaatcactctccttactcaggcttacaaagtcctacatgatcattcacctgtctcctctttgagcttattttgtgatccttttctc

SEQ ID NO: 120268 - DNA, 288 bp, Homo sapiens
accctcagcctcagacatcaccaccagcccaccctcaccgtcatactcacccactttcattttcagatgtcacccagtccacccttactttttgacgtcacagccagtccaccctcaccctccaatgtcacacccagcccacctgcaccctcagacataacccagctcaccctcagcctcagacatcacccccagcccgcccttaccctcatacccgcccaccctcattctcagtgcaccccagtccacccttacttttggatgtcacggccagtacacctcaccctt

SEQ ID NO: 120269 - DNA, 533 bp, Homo sapiens
ataggtatcaaaaaacaaaaaaagaaagattgctctggtgatgagcgaaaggatgagggactagctattgcagaagtctagttgagaaatgacaaagcctgaccttggagagaggttgtggggatgatcaaaggattggatttagctttttactagtgcaatattgttgccatatttctagatgaggatttttttttagagctaatctgggtaaagggctccttttctgtcaaaagaacccattagcaagtctgaataatattgccaggttatatatgttatgtatagtatgagagtgaattgttcattagcatctttgagaaattagaaagaactatgtcaggtgtaatttggaagagaacttgaagtttgttattgttactatttttgagatggagtcttgctcggccacgcaggttgcagtgagctgagattgtgccactgcactccagcctggcaacaagaatgagactctgtctcaaaagaaagaaaaaaaaaattcgtgttagtactgatagggtacccagtcatct

SEQ ID NO: 120270 - DNA, 470 bp, Homo sapiens
atcctcccacctcggcctcctcaagtgctgggactacaggtgtgagccagtgtgcctggcctggaatttttttctaaaatttacatttctgagttaagaatgcttaaaatattataaaaacagaagcacaattcattatgtgtttcattaattacctctattaaaaacaacacaattatatttcaataggacaaaaaaatgtttaagcaaatgaaaacaaaaccatgacatacccaaactcaggaggaggcaacaaaggcagtgctaaagggaagcttacagctgcagatgcttaaattaaaaagaagaaagatctcaaacccggtaaagggaagcttacagctgcagatgcttaaattaaaaagaagaaagatctcaaagccatgctaaagggaagcttatagttgcaggtgcttaaattaaaaagaagaaagatctcaaaccaataacctaacattacacctaaaggg

SEQ ID NO: 120271 - DNA, 483 bp, Homo sapiens
ttgggggacaaaaaagggggaagggggggcacgaaggctcatcattcaaaataaaacaaaataaaaaatattaaggcgagattaaaaaaattttgcattacataatttacacgaaagcaatgctatcacctcccctgtgtggacttgggagaggactgggccattctccttaaagagaagtggggtggcttttaggatggcaagggacttcctgtaacaacgcatctcatatttggaatgactattaaaaaaacaacaatgtgcaatcaaagtcctcagccacattgtgaactttgggggatgctcgctccaaccgactgctgtcaccttcaccgttccagtttttaaatcctgagtccatctcaaaaaaaaaaaaaaaaattaatgagaagatgacattttttgaaatcaaattttaaatgctttttagttcatttaaaagaattaaaagtattaaagaggctgggggtggtggctcatgcc

SEQ ID NO: 120272 - DNA, 613 bp, Homo sapiens
gcaaccatgacgatttaacaaatcaaaaaggagacatgaccgcagcaccagtaccagtgccaacagcagtatcatttaccaagcactgccgagtgactgtgagatggtccacaaggccataaattggacactattgccatagcaagttgtagagccaagattcaaacccaggccttctgattccagagtttgactccttagcaatggttctctaagcctctgcaaactgttaagctcttcttagctgatgagctttgggctgtttctttctcggtgacagtaggagtggaaatgagcctgtgtgaacttgacactatcagtggctgcttgctgcccacctcagtctgactgacgcacatatgagtcatgggtccatgcattcagcaggcattatttggacacctactgggtgccagcacagcctcggtggagcacccgcatcacaccttattgctccgtccctgtgactagaaaatgatgtcatagtagggttgttttgtgcaatccgtagagagtgtgactctgagtagtcataggtacttctgggagcaattttgctaactgttcctagccttaccatgtgggccctctgctctccagagaggaggaggac

SEQ ID NO: 120273 - DNA, 778 bp, Homo sapiens
  misc_feature (483)..(483): n is a, c, g, or t
gaagatagacaaatgttcctcaaatttggtaaatttctggtatactttcatggtgatggtaacattaatggctggattttcatttttgacctattttgagaatgttaatacagaagcatagtgtatattaatatatttggctctgtcatcttgttttaccctatttttttatgcttctctgtcttcatttgatttttttattctatgagcagtttgctttgcttttatattccacccatcttccctctatagagatatctcaaagtagtgtgtgtgtgtgtgtatgtgtgtgtgtatctatatacatagattcccttcatacacagagtaacattactgatatttctgatagtgggaacaatatagggttattaactttttattttgaaaatatttcaaacttactgaattgtgagaatagtgtaatactctcctgtataactattccttagattcaccaattaaaattgcaccgtgcccggnctgtagatttcatttttagaaggtttgcttttaacagtttaaatttgtaactcacataaaacaaaacttattatcagaaagagaaactaggtgttaggatacagtaaacaactaagcatttgtgtctcttctgtctctgtacgatttcacatcgtttaacttcattacaatcaccttcccttgggggttcaactagctttcacccttttgtaatacctcttgcgtgttaacacttgagcatgaaacttccatcaggggttaagaaacctttcattgacactctcaattatgtgta

SEQ ID NO: 120274 - DNA, 468 bp, Homo sapiens
ccagttgctgcttcttgaatacagttcctccggtcctctaaagcatggataaaccctgtgggggggaaaacagaaaagcaaaataaaattttctcaagtcatgtcacgatcagaaattgaagccatcactttcctccttttttataagggctgggatctcactatgttgcccaggctggagtgcagtggctattcacagatgtgatcattgccccttccagcctcgaattcctgtgctcaagggtatcctcccatctcagtctcccaaatagctgggaaaatagacatgtgctaccatgcctggctagaagacatcactttcaagaagccagttcctgcttttcaaagctctctaagttaagtgacttgtttaagatcatagaacccataagtgaggcagctgggactagaacccaggtctcctgactcactgcagcacacagcctttcggcaatctccaaaccagcc

SEQ ID NO: 120275 - DNA, 252 bp, Homo sapiens
cttgataataaaaactcccagtgcctgatgccagctgacagacactgggagttttcccaggtaccctgtgacctagagaaagcttggattcctgcctttggcttgggctggcaagccctgtgcctttactctacattttaatgccagggagacctggaactggagaagggagtgctgtgggaagaaaacagaaggaatgttgttcccttgttttagctttgtgttcatccattatgggttttgggttttttt

SEQ ID NO: 120276 - DNA, 315 bp, Homo sapiens
gcaataaactcaaacaataaattttaaatctgactgaataaacaggtatgtttatatagattcatgagcccctgtaataattccatgctcttaccctacccttgccccctagcccatgatgctcagctatgaacctacactgttgagtttatctggctcgtgagcttaatccatagaacgtgattatgacacatgatcagtgtggacacagtggttatttgaagacaaacttcctccctaatatgaatggccccaggaaagcctggagagtgtgtgaaatatgtgaacacatgttccatatggtggcacccagaa

SEQ ID NO: 120277 - DNA, 336 bp, Homo sapiens
catggatacttatatctatgtcaccagctgacacctctcttcttctgcctggctcggaaggtgttttgttttagtttggtttgtctttaataagggagcagtggccatttcagagatgggtggctgtagatcctcctcctgaaccagcagaggccaactccattccatcctggacctttccctcctccttcactttcttccagcctctcctcttgacctgtggctcagaagggcatgtgacaagtgctgtccccacctcactgacccactgattgctcttaccagatttgcttctttgagccactggggcagggactgactgggccacatgcacct

SEQ ID NO: 120278 - DNA, 368 bp, Homo sapiens
gggctcaaatcccagctctgctgcttacaagctctaagacctgaagtaaattatttattctctctgcctccatttcctcctctataacgggggataaaatgagtacacaggattacaatgagaattacagaagctaacacacataacaagcacttgaatggtccctggtgcatagcaggtgctcaaaaaacattagctattattggccaggctcacacctgtgagctcacacctgtaatcctaacactgtgggaggccgaggcaggctgattgcttgaacccaggagttcgagcaatcaatcaatacggcaaaacctcatctctaccaaaaatacaaacaaacaaacaaaatagccaggtgtggtggc

SEQ ID NO: 120279 - DNA, 298 bp, Homo sapiens
aatatagctgcgaactggaatttgtacgcggaatggaattgcaattccattccagcgtacagttaacagtgtcagagatagtgaaaatatgaaacaagaactgcttacaagaaaggagcactcaggggaccaaacctctgccagagccagcggggaagtgacttatgcctctctcttctttccctcctgtccccgcccctcgtctcccgcaatgaagcgggtacttaatctgtgtcctgtggaggtcccctttggcagccagctggaagcccgtgcacccttcttcaaataatggctt

SEQ ID NO: 120280 - DNA, 145 bp, Homo sapiens
taacagtccctgactgatacaccacaaacagcctttcctcttctcctctttggccatgatcttctaggaaagtgcagagagccagtgccttcacatagagtgtgcccgataggagtgagtcagtgggctaaagagaagtccactg

SEQ ID NO: 120281 - DNA, 531 bp, Homo sapiens
gttattgccgctgtggggtgtgtggttctctggtggatgctggttattgccgctgtggggcgcgtggttctctggtggatgccggttattgccgctgtggggtgtgtggttctctggtggatgctggttattgccactgtggggcgcgtggttctctggtggatgccggttattgccgctgtggggcacgtggttctctggtgggtgctgattcaattccggacccacgtggctctaggctgtctggggccacagcatacaggaaagttgataatcacaggtgtggcatgttccctctccactgcccacccccagctgtgagcccacccctgcccctctggagacaccaagccagaatgcaggagtgctgctgtgagagtagcttcaaaaccgtcaaaacttctatcaaaagcagttattccaaaccttctgtgtcatattgttgggaatgcattcctttttgaaagtctgcacttggtcacgggtgggctggcacctgctatcgatggatgtttcttcatcctctgagct

SEQ ID NO: 120282 - DNA, 529 bp, Homo sapiens
ttatagggacagggtctcactgttgctcagattggtcttgaactcctggcctcaagcaatctgcctgccttggcctcccaaggtgctgggatcgcaggagtgagccagcccccagtgctagcagtgctcttgggtaatgaacgtgtgaatgagagcacactgaatggtcgcgtggggcggccaccctcctgagggacagctcactatggacaggtgataccaccacttggtacctcctttcttcatccataatttgcgaatggtgacagtgactgtcccacaggcctggtggggtattaattcagatagtacacgtcccacacctaagatgagcctggcacaaagcagcgctcaaaaacacacatcttcctttaacttcctcctcggttcccccaatgggggatcttgcaggcaaagtgttgacgaaaggtccgcccgttcccaagaacgaccctagagggcgccaggcagcggggcttgaatggaccgggcgggtttcgctttcccgctagtagccgcccgcggccgc

SEQ ID NO: 120283 - DNA, 337 bp, Homo sapiens
caacgtttgcgcaaaaacctgtgtaggaatgttcaagcagctttattcataatatgcccaaacaggaaacaactcagctgtccttcagtaggtaaatagttaagcaaattgtcatacccctgtgtcatggagcactacctagcaataacaaggagcaaattattgatacataacaatctggatgaatctccagagaattatgttgaatgaaaaaagccagcccctgaaggatacatactgtatgatgccatttacataacattcttgaaattctaaaattacagagatggggaacagatttgtggttaaagatggagccgggtgggaagaaagtagg

SEQ ID NO: 120284 - DNA, 379 bp, Homo sapiens
tctggaaaagtgggacaacttgaagcaaaggcagaaagactccaagctgggagggggcttccaggtcacagataggtgagagatgaaggttgcattcttttgagtttctgattagccttttgaagggaggcaatcagatatgcatccatgtcagtgagcagcggggtaactctgaatagaatgggaggcaggttggccataagcagttcccacctagacttttccctttagcttagtgatttggggtccccaagattttctttttatacctcttacatgcccagtttctcacacaggctgtcaccagccatcagagattaggacaaagactatacagagagtggaggcttctcatgcatggactctagggtctgaaata

SEQ ID NO: 120285 - DNA, 349 bp, Homo sapiens
caaattcatcagttaaggctacactcctacagaccctaccctcctatgcatcaagggctgaaatcactcaccgaaaaaggtttggttggctggacatggtggcccatgcctgtaatcccagcactttggaaggccaaggtgggtggaggccgggagttcaagaacagccaggccaacatggtaaaacctcatctttactaaaaatacaaaaattagagaagtgtggtggcatgtgtctgtaatcccagctacttgggagtctgaggcacaagaatagcttgaactgggaggtggaggttccagtgagccgagatcttgctgctgcactccagcaatgactctgtctcag

SEQ ID NO: 120286 - DNA, 281 bp, Homo sapiens
ggtgtatgtgtgtctgtgtgtgtgcgtgcgcatttgtattaaggaaatgagatctgttaactataaagcagctaagtggagtccagaaggggtagccactgcctgtttggctctcttaaacagtccctcttctatttccagttggaatattgggggcagggagatgggggaatatcaggagctattttttcccttataccatatgcatgtcatgtatatattaaatgtctgctttctgaatggcaaaaattatctagaaaatcatgagacaaaacaaaacc

SEQ ID NO: 120287 - DNA, 436 bp, Homo sapiens
tgtcagtggcctgccagcagtgttggagaagagagtgagagggcatgattgggaggcttttgtataccaggcctaggataggagctagtgaccaaggctaaaagagagatggttgagaataggcatctgtctactggataggtggtgaattgggtgtgtgtgggtgtttatttgcagaaaatggttgaggtggctctgagaagagtgaggtgcaggacctgcgcaaccccaggagggaatggagaagctcctgcctctatgggcagagttcgggaagggccaaggggcctaggacttgttcctggtaaagaaggcaagtgatgcaaaggtgggagagaggtccctgggtcagggaagagggagctgagaactggggtgttagtacacctttgtggtgagcttcttaaaggctagggagacactgtttatctttttt

SEQ ID NO: 120288 - DNA, 294 bp, Homo sapiens
ttttgtgtgtgtttggaaatgtccatattagaaaagaatcaaatctaacagtatcaactcagcagtactatggcagggttaacaggcctatctaccgagccagtttaatgtatactggggaagtgacattacagattcactgcaaagagcttaggttttggaatcagactctgccacttaaatgcactggaaccctgcacaaatcccttaacttgtcaacatctgtttttgcacctgtgaaactgggatattacttccttgtgtcgctttgtgaagaataggtgagataatgtg

SEQ ID NO: 120289 - DNA, 336 bp, Homo sapiens
caccaaatctttgtttactaagcaatgaaaatcttttgcacaggattcctctgtctctgcctaatcagaatcttaagcttcatcttataccttatctggaggtagcgctggaagcacagcccccacccccaacccagttccttcactggaaatggattggctttggtttacataactttccagcacctacccaaatagagttgggtagggcattaagtgtacagattgttcaaatggacatgtcagctgtagtgttcccctcctcttggagagctaaatggagttcttgaaattattcctcagagacagacccagtccacttcaaaggcagcttcc

SEQ ID NO: 120290 - DNA, 309 bp, Homo sapiens
gtgcattttatgtagtgatattgatctatccgtgcattttatgtagtgatattgatctatcttctcttttgtggcacctggtgtggtgttagcttgagcgctattccccttctagggattttaaagactctcctatcttcaacaaatgcctttatgataagatgaagtgacagtggagattccattgtgctactcagaatggtgtgcaattcaaaacttaggaattgtttatttctggaatcttctttcttcttttttaaatggtactgctccttgcagagcagagctaactcacatgcatgcacccgg

SEQ ID NO: 120291 - DNA, 461 bp, Homo sapiens
cttccacccatccctcccaaagctatgattctgagatgtctaagcaacactagaacagagataatgcaacttctgtcattatgcatgcttctaaatatcatcaaatctattttattttcgtgtgtattgtttctgaccaatttccagtagattccacctttcctggaatggtcagcttttttcagtagattccatcgtgcctggaatgatgaaagaacaccacatcccttaatggcacaattgaattgtactcaggaaatgcagttattttaatattattgcaaaccaaagataattaagaatatgaattttcccaggaaaatatcacatgacttactgcagaacgaaacagaaatgaatctcagtttacttgatgatttggtttatctacttcaccttccattagttaatttaaatgtttaatatttaaggcatctaaaaatcaacaggaactttctact

SEQ ID NO: 120292 - DNA, 225 bp, Homo sapiens
agaaggtcttgagaaataccggattatgtagagagaccaaatctacaagtgattggggtacccaaaagagacgggcagaacagagcccccccagcaaattgcagcagccttacggaagagtggccagactgttaaacagaaaatgacccacaaaaatctcatccaaaggtgtcagcaacctcgaagatcaaaggtagataagcccacaaagatggaaaacatact

SEQ ID NO: 120293 - DNA, 276 bp, Homo sapiens
gtcacactgtagatcgctcacaactaagaacggcgcacctgttagaactcggcccggctaatttttgtatttttagtagagacggggtttcatcatattggtcaggctggtctcgaactcctgacctcaggtgatccgcccgcctcggcctcccaaagtgttgggattacaggcatgagccaccgcgcctgggcacaaatatttgttgagtgagtattatgtgctgagcactcttctcgtcataggaatcaacagtgagcaaatcctaccaagctc

SEQ ID NO: 120294 - DNA, 423 bp, Homo sapiens
tgtaagtgaaggagaaacccctgaatattgattctagagaagataagatggtctcttttacagagctgagaacggatgctattgctcttttatgtccatggggtagacactaaacattaataatgtatacctggagacaagaaaattctacacttcagatacaaatgtcttctcaattaagattgttaatcaattttgaatagattatgaagttctagatactccgtagctgattttgaaagattaattgtcaaggaagtggtctttgagcatgatttttttaaatttattcatcagccctccgagcaacaggagcctacattttcttcagagcttttcttagagaagcttaaaatatgtctgcagaaaacttccacgtaggtaaaatgcaatgccgctttaaaagtataaaactgatgtatg

SEQ ID NO: 120295 - DNA, 372 bp, Homo sapiens
agtgtgggtgtgagcgtgtgacacacagcagccctgggaagggacgtgtgattgagctgtgcagttagtgagaggcagcctgtgggggagaaataccctggtaaggaggctcaggccttctcactgcgggcctgcctgtgcctctctggaactttctacctctatcaagggagaagctcagacatcgccagagtgagagatgaaatgtatcacaaattaaaaagagaactaccatatgatccagcaaccccatttctgggtatttatccaaaacagtcagcatccttatgctcctagaagcctatttacaatagccaagaagtggaagcaacctaaatgtccaccgacagatgaatggataaagaaaatgtg

SEQ ID NO: 120296 - DNA, 154 bp, Homo sapiens
gttcacctggtgtttcaccctttaagggacctgtctggcccatgaagtcatttgtgtttgcaagtcctgacgcagggccaagtactgtgatcaggctgttgagagtgatgaagatgttgtcatggggtcaccaaagaggcctgataccaccctg

SEQ ID NO: 120297 - DNA, 1195 bp, Homo sapiens
  misc_feature (896)..(896): n is a, c, g, or t
agcagtgatcccacacttgttttaattacaatagaataagttaaccaagaaacaagttggaaaatggaaggcccctcccaggtttgcacccagaggcagggagaggtagaccctcaccagaaagacctccagtaataacacagatagccacctactattttggttttttttttttttttttttggaagaagtggaagtttccgcctctgtgttgcgcccgagggtgtggcgagtgtgaaaagtgggcgcacaactctgcgggctcaaggtgaaacccctcgcgcctctcccgaggttctcaagaggcggaattactccgtggcctctcaaggccctctcctctatagtataaagtggggggtactataacgagggcgacccaacctattcgaacagccacagctataaaattatatattttacaggatagaagaagtgggggtttctccacccaaagcgtttgtgccgaggcgtggtctctctcaaaaaactctcctgtgaaccctctacgggtgtgatctcacaaccgcgctgtgtgtggctctctcccccaaagacgtgtgctgtgagggcatatataacagggcgtgtagaacgaccaattgtgacacccacgagcacaagcacaacgcccacactataatttctcgtataagaggggactttattttagttggtggttgacacagacacctgttggtgtggtataaggcgcctttttggggcgatatcttatttttacaccgcgctcgtttgtttataattttttcacgatctctcgttcaaagctcttcgttttgtaggtatagcgccagccgtactttgttagagggcccagaaactatgctatgttcattatatacacgctgttgacaaccaaaacatgtagggggtgncgccatcatgtagcaacagaaaaccgctgtaagtgtgtaggaacgccggccccccaaatggggcggcgcccatagacagaagaaggtcctactaaatgctgtggtaaacgaggcctagtcattttttttaacaacctgcgctagttatatattactctatattagcgtgtgggttcaccccacaagagaggcggcaccttcgtgaacacatatattcacttgagtagataagacactcgtacgacaccaactattcttgtaagtacatctattttccctataagtgttttattcacccc

SEQ ID NO: 120298 - DNA, 789 bp, Homo sapiens
aacatggtaaaaccccatctctactaaaagtacaaaaattagccgggcatagtgacaggcacctgtaatcacagctactaggaaggctgaggcaggaaaatcgcttgaacctgggaggtggaggttgcagtgagccgagatcgtgccattgcactccagcttgggggacaagagcaaaactccatctcaaaacaaacaaacaaaaaacaaaagaaaatacagaagtacaacaggaaaagtaatattttcctttaaggtattgtaatataattgtgatattaatagaatagtggaggcactttatatacacacacacacatacatacatacatacacacacacacatacacactatccccacacatacaactcttgtccaggtaagtcacagtattttatggtacaaagattcttcccatgtaaattaaacaataactaacattattgggtgcttaggatgtgccaggcactattctaaacactttaaagaaaatgcagtcattcatttaatactcagtacaacagcattagataagtactattcttcttttatgagaaaagtaaagtacagctgtccaaagtcacagagctagtaagtggaagagctaacattgaacatagacactcaggcgaatgcacttgtgaacttaaacatcgtaatatactgcataattgcattgattgttctcaactattagtacacttgccaagcacctaccccagaaagccagtccccctgtgaaggacgggaagaaagggaggggttggatctcaacagagctagattgc

SEQ ID NO: 120299 - DNA, 139 bp, Homo sapiens
gtatgtaggttctatcaacttggtagccattggaaaataaaatatacataaattgaagctaagtttatttttacttcattcttaaccacaattactaacaggatgtacttgccttttgggcactgcacagctttgcaaa

SEQ ID NO: 120300 - DNA, 227 bp, Homo sapiens
attgctgcctcttgccctgcctctacctgccaaagcagccggactcaatgcagatgccatgcagggctcacttagtgaatggcctaatctgtccctcctcctgccttctcccttgggccacaccttgcacccactccagcgatcatcacctacaaatcgttattcactccaactttcttcagctctcttccctggtccatttgcttttccctctctcccctgttttt

SEQ ID NO: 120301 - DNA, 116 bp, Homo sapiens
tagaatactgacaatcaataattataattactgtatttccaaaaaccaaaatatttgtttttttaaaaaacgttattttctagcatccaattagcaagtctgaccaggctgtacca

SEQ ID NO: 120302 - DNA, 808 bp, Homo sapiens
tagtcaggatttttcaactctctttctatcttctttttctttttctaaactattcactcttggttctggaacatttagagcaaagcctgaaagtcatgagtactgagcttttcatgatgtgccatccatctgaaatcttactcatttttaaaactatgggtgctaagcttcattggaccctgatgtcattcaggtgcctgaattgcaacattataaaagcatcagattattctggttgagcacatatttttacaaagatcatcccatgttatcttcatcatcccaaggagaatttctactcttaaaaactcaaagaggaatatcaaagaaattaacccactacctcagctatcagtttgcccagagctaaatcagagagcattaagagagcagattgggcaacaaattgatgcccttcttgactttgtgctactctgattgtgaatgtagtacttgaaaataacaatttcctattctttagttcctcttcttaaaacctattttgtaccatatgtctatgataatcttctaaaaaaaaactattctgatcttgtttcattcccacaaaaatatcttaagccttcaggactcatgtctaaaccccttctgtatttttaaaaacccttcataaaagtgctaggattacaggtatgagccattgtgcccagcctataatacatattcctaaacattagttggatgggttcatgaataaatgagcttataatctaataaataaaaaatgtatttgttatttcttataattaaaattatacagactaatatttagaaaatacagaaaagcaaa

SEQ ID NO: 120303 - DNA, 2511 bp, Homo sapiens
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120304 - DNA, 817 bp, Homo sapiens
  misc_feature (782)..(782): n is a, c, g, or t
  misc_feature (809)..(809): n is a, c, g, or t
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcacgcatgatactcttttctnttcagagtctgaagccaaaaggagctnatcagctg

SEQ ID NO: 120305 - DNA, 2631 bp, Homo sapiens
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggatggcgtgaccaagctactctgtcactgttggaagccagatgccaagcaaaaagctttcggggcttaggatgagtgaagcatcagctgtggaagaaaagaaaatcaagcagagggaatggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120306 - DNA, 2307 bp, Homo sapiens
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgtgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120307 - DNA, 2001 bp, Homo sapiens
  misc_feature (1738)..(1738): n is a, c, g, or t
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcatttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaaaaaaaaaaaaaaaaaaaaaaaaaaaaaaaaaaaacatgtnggccgcctaggcccagtcaactctggtctcgcgcatggtcaagcatgcttttggatttggggatgattaggccagtgccccctattgggggtcatttgccaattcaccgctcgggggtgtacaattacaatactgggaaagccgtttaacaacccaacttattggaaatccgggcattcccattttgaaaggtgtggaaaaaataccagtcccgcacggtgggcctttcccaaaggggcccaacctgatgcctttcgttgttt

SEQ ID NO: 120308 - DNA, 1072 bp, Homo sapiens
atcgaggtcggtacccccgctggcccaatggcacccgctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120309 - DNA, 1029 bp, Homo sapiens
ctattttagaagtttcaatagcaagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120310 - DNA, 979 bp, Homo sapiens
  misc_feature (30)..(30): n is a, c, g, or t
tcaaaactccctgaccctccaagtgaattnccccctgcatcgggccctcccccaaagtgccggggattaataggccatgagccctcccacgccctagccctcaagtggtccctcttgagtcaaccctagacctacagtcctatgcctagagaatgtttgtgtgtgtgacaatgtatgttccttgaacatcatagattcccactttggatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120311 - DNA, 2366 bp, Homo sapiens
ggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120312 - DNA, 2243 bp, Homo sapiens
ctgctcttctgttcctctttccctggaaactgctagcaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120313 - DNA, 1714 bp, Homo sapiens
  misc_feature (126)..(126): n is a, c, g, or t
  misc_feature (130)..(130): n is a, c, g, or t
  misc_feature (138)..(139): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (159)..(159): n is a, c, g, or t
  misc_feature (161)..(162): n is a, c, g, or t
  misc_feature (166)..(166): n is a, c, g, or t
gtacccagttcgacggagactctcacaggcttcatgcaggcctgtgagagtgcctattccagctggatgtactcagcgaggacccagcacctcgaactagatctcactactcaattccacggagantctntgacaganncnctntgnantccagcaagnannacanctggtcacccacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctaactctcaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggtatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 120314 - DNA, 1378 bp, Homo sapiens
actgttaaacaccgatgacgcatgcactgctctgggattttccaacagaggtttttcacagcattccttagttttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaaaaaaaaaag

SEQ ID NO: 120315 - DNA, 1347 bp, Homo sapiens
actgttaaacaccgatgacgcatgcactgctctgggattttccaacagaggtttttcacagcattccttagttttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatagtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaaaaaaaaaag

SEQ ID NO: 120316 - DNA, 371 bp, Homo sapiens
gtgtgatgcccctgactcttacatttatctttctaaatcattttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgag

SEQ ID NO: 120317 - DNA, 283 bp, Homo sapiens
gtgatcagtttccagcgtctctttatttcttcaccatgatggtctgaatgatgacttcaatgaagggcaaactcaggcactctaggaaagatacattactcagcgtgttattgcctgacacgttctgggaaatcacaggacaatcatcttcatgtgcaacatgtgggtttttttttaatttatttgtttgtttttggcacatttacagttaaattccccagatccaagaaaatgacttcccagttcctggggaaaataaattacgaatggagatggaacccag

SEQ ID NO: 120318 - DNA, 240 bp, Homo sapiens
atcgaggtgtaccggtgttatcgatgccacaagtataatactgtggcatgaatagacagacaaaacagcaagttcagatatggaaacaaatcatttggaaatttagtatatgttaaaggtaggtcttaatttgctgggtaaagatagcatttttttctaacaaatggtgtgaagacagttggggagccatctaggaaaatataaggctttttctatacctcatgtatcaggtaactctca

SEQ ID NO: 120319 - DNA, 210 bp, Homo sapiens
tcaggaagttaaatttgttccctttgtctcataagagtagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagacataatgggagca

SEQ ID NO: 120320 - DNA, 576 bp, Homo sapiens
ggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctga

SEQ ID NO: 120321 - DNA, 208 bp, Homo sapiens
atcgcggcgccccgggaggcgcgcaccaaccacgcggtcaccccgcgctctcgcgggcgtgcattcgttcactcgctcattcattcgccgccgcccacactccccgagcgcgcccgttcgccgcgttgcggccaagtcctcccagacgtggtttttgcaaacgccctgagttgcgcaacggccgggatggttggagcgggcgggcccg

SEQ ID NO: 120322 - DNA, 181 bp, Homo sapiens
atggttgtccctccctttagttttagcatttctgttcgtctctgacagaggcacacaggagctccctagtcaccagaggcaggctcaggaggggccagaagacatgggggtgggacggcagagagggaccccatgtctcttctaatcacccgccgccccccgcgccctgtgtgtcgtgtgt

SEQ ID NO: 120323 - DNA, 390 bp, Homo sapiens
atccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctt

SEQ ID NO: 120324 - DNA, 360 bp, Homo sapiens
atccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcatgaatggcgaggtgaacaaggcaaagcagactcaaatagaaatgtcgtacggcccataagggaagggcaagagaaaaaaaacccctacaatagaagtgcggtcaaaaagacatagcagggccagggaaaacagtaccatatatatgcaagaagggaggtcg

SEQ ID NO: 120325 - DNA, 386 bp, Homo sapiens
cagggtgaccctatccactacagaagccaaaagaggcaagatgctttctgtcccatcaacctgctgccacttggcaaatccacggtcttgcaacataaattaatacaactataagcttctgcccaggaattctgaacgtagagtgagtaagtggaaggcaaagagatagtcggaattcacttttggtgctgtgtgtccccacatcctgcagtggtccccagtggcaggggtgatacatactacaattgccccatcctgagaagactgtcacagcattgaaggcttcagagatgacttggtctctgcacattttccagactgctcctcaagctttatgtgtattctttgagcccccataccctgccaggaaatctctttaagcttaa

SEQ ID NO: 120326 - DNA, 458 bp, Homo sapiens
taagctttaaaggctctgtgttagggcatagtctagaaacatggggcccaagggcaccgggaaaacttacaaagggaagagatggaactgggagggttcaagctaccagttccatctctccatgttttagagaattggggcactaagtcagccaggtaaggtcaggtcagaggagggcccggatgaagcatgagatgcagagggacagtgcgtgaatggagaccttgggtagcaccaacgtgtagcggcagaggtggggtggatgtggctgatgtcagggagagaatggggagcatgcacagggctcagtcttatacatacattgaaaatcctttagcctttcaaagattattaacccaaatcacctttcttgcttactccagatgcctcagcctctgatataattgctaagtatctgccgtgttaaaaataaacatttgagaatcaagggtgatttt

SEQ ID NO: 120327 - DNA, 395 bp, Homo sapiens
cggtacccggtgtttatcgatgccaccagtgtcactcaagctgaagtgcatctcttttaaaggagaagtgacactggtggtaggatgaaagggtaccagacagagggagcaggagatacggaccctggagcattgtcccaattccttcttctaatgaagaaatacgcttagttgatgatgcgtttggaaaaatttgtcacatggtcagtgatggctcttgggtggttcatgttcaggcagcaaaactgttgggctctatggagcaagtcagttctcatttcttggagcagacccttgacaagaagctgatgtcagatctgaggaggaaacgtactgcacatgagcgtgccaaggaactttacagttcaggggagttttccagtggcagaaagtgg

SEQ ID NO: 120328 - DNA, 315 bp, Homo sapiens
tgttatgaacatccaatttgctctagtaggtgaactaagacaggctttttggaacaagaatcttggcccttcttacctagtctgttcaggttctactactctaaggtgggagaaacatgctaacaccaaacgaatgtgtaaaggaaccacagatgaagtaagtgtcagcctcatcaggtgaccgtgcagtccagctgccgccggggtggagaccacgcgtcctttcagaagtatgtgcctacgcgggggtgcagagtcaggagagtcttccggactcacaccacaggctgaccgttcggtttctcttcttcctcc

SEQ ID NO: 120329 - DNA, 435 bp, Homo sapiens
caatgaaaatttaggagagttggttgagagatggcaaaagagcaaagcttctgagagaagaataaaaggaaataaagggagaatttaaaaaggaaatagtcataatgggcaggtgggattggggtaggatatggttggggtgacccatgtctctgcacacatggcagtcttaggagaaggcagaggctggtgacaagaagttaagacagcaactcccagtcaataaagctgagtcaaaaagcggagtcactgaatatccatattaatgtacttgctagcattttatacacagtagtatttatgcctaggtaatgcttggaaatttgttttacttgaagaaaattattgataagccaggtcacagggttgaagtacttcttaactctaaagggaagtttaaaactttgggacattgattatttggaagttacattt

SEQ ID NO: 120330 - DNA, 953 bp, Homo sapiens
ggacagccttagacatgatattagcagaaagaggaggagtttgcgtcatgatgaaaactcaatgttgtaccttcatcccaaacaccaccaccactgatggaagtataacaaaggcattgcaaagtctgactactctgtccaatgagttagccaacaactcaggggtaaatgacccctttacaggatggcaagaaaagtagttcggtaaatggaaaggaataatagcctcaattcttacttccctcgcagccgtaatgggtgtacttattcttgtcaggtgctgtgtcataccatgcatccgtaggttgatgcagaggctcataaaaacggcacatactaaaacctcccttaactatcctccaccttatccagagaagcttcttttggaaaatcaagcaaaacagctaagccaagacatgttaaaaaaaggtttgaaaagaaagctgtaaggaaatacaaggggagggattgttagatatgagttctaaatttattttcaaagaatcaatatgtcagtatgttcaattctttaccttctacttttaaacttaacttcctcataaagcaacctttttcaattacctgctccaccctgattcatttcaatcacctgctccaccctgactcattctgattacctgctccaccctgactcattccgattacctactccaccctgactcattccgatgacctgctctgtcataaccatttttcctgccaaaccactcaccctgtcactgtctttaaattagccaatcagaattagtttagcctgtgcggtctaaccctagccaataggggaatgacacagcagcaggggccgtatgcatcagggataagaaccccttcccctcccttgtccaagtgtgcactcaccattgctccatgtgtaagcatgcacccttctatagaagtaacttgccttgctgagaattaaaagaaaatgttat

SEQ ID NO: 120331 - DNA, 443 bp, Homo sapiens
ctctggattcagagttcagtctaaatttgggtcacgactttgaagaagtggcctttctcaatggtacatgcttaaactaattgaacgaattggctatttctgccttgttagaaatgtaagtcttctttttctatccacgggcaggaatttagtcatattatcctttgtctttgctgtgactaattatctttcttccttgcagagccccagaactcggaggtggttccaactagttgattaggaataacaatatcacatggaaaatggcaagccccacccctcccctgacagcattagcaaaatctcatcctgagttttgctcttttaaccctaaactgtacgtgaggtgggagcccccaaattaaacaaaactagctcgaatcttattgcttagtggcaccttcctgtggctttgcagacttacttgggcagcaggagctgtg

SEQ ID NO: 120332 - DNA, 364 bp, Homo sapiens
caagattccatctcaaaaaacaaacaaataaacaaaatatagagaagaacagaacaagaagtgttttgagtagcagaacacgactcacacagacatctaatatttagtcaaattgcttttatataaaagaaggtatacattgaagagcaacagagcctacctctatgactgacattttcaaagaaaatggctaagaatcactttgatggccaggcacggtggctcacacctgtaatcccggatctttgggaggccgaggagggcagatcacgaggttaagagattgagaccatcctggccaacatggtgaaaccccgtctctactaaaaatacaaaaattaactgggcgtggtggcacgtgcct

SEQ ID NO: 120333 - DNA, 374 bp, Homo sapiens
cgacagatccaggaagctcagagaatagtaagaaggacaaatgccagaaaaaaactacacatacacatatatattattttcaaactgcagaatatcaaaggcaaagaaaagtcctgaaagaatccagagggggaaaaacatgttacctacaaaagagcaaagatagaaactgcatctgacatgtcctcagaaactatgcacataggaggagaacggattgaaattaaagtgttgagacaaaagtgccaaagcaggaaatctagtcaggagacaatgccagtgtctaggtgagagataaagatgggttggaccacatccactactaccttcctggtccaactctactaaaaatataaaaattcattttgggaggc

SEQ ID NO: 120334 - DNA, 622 bp, Homo sapiens
tatgtacattatcaatattcatttaattgtaaatacctgtttttgtagccagagagcaatctccctaagtgcagagagaagacggtaatgttcatcatgttatctcatatgcctagagtactgcctgtctcccagttagagtacaatatgtatttgtagaaaggagaggggcgtgagttaaagataaagtgactaatttatgccacctatcaataaagttcatctctttaaaggattttctcagcttaagaagtagatgtgctttatacaaattgaaaggtgaaaataagcatcttaaagctcactttcagccattagttacattaagaacttggattcatgtctgaactaaaaatatacctaatcaattaatttctttttgaaaaatgataggataatataggtttattggtttatttccagtacccttatacatttttttttcatgggtgtatgcatgcatgcaatgactaagcatacagaattgcttgtgaaaattctggccatttctctaatactgaatttatttcaccttatactatggtgcaggcagatgatcatagattgtcttaaagccaccacagcaaattcttcttactacaatgtagaggcaaagacaatt

SEQ ID NO: 120335 - DNA, 877 bp, Homo sapiens
ggacaatatatctttatgttaaatctgttgttggaagttggttggtgagaccaaccagctaagtgggataattgcttcccagtctatgtagctaaaatgtagttctaatgctgatactgtggactgactctgagtccaaactccattttaattggtctgtgaggggaaaatacatactaaaatacaggtaaatagatgttcaggaacatcttgtccatcttccttcctccttcacaaagggtctcttagtggtcagggaatggtgtagcactatgaatatttctttttttctcctctcccttggtcatccagagttgcaacaaccttggcagctccctgtaggataagaagtgaatttgagggagtgcatttaattttcatggtagacttatcctgtctctaatgtgtgcaagttagttgttcttataaaccatttgtaagtttgtatgtttgtaagtttgttatagttgtggggatgcttttgtactttgtgacttttcctttgtctctcccctctaaactggtcatttctcttgtgcctagactgttttcttgcattatgtctgtcaattttcattgcctttactctcactcagaaaaccttgtaattttaattgaaatttagaaacccaaacctaaatttttgataaaagaggcctctctaaatctcaagtggttcctaaccttttttgctttagggacccttctgagaatgataaagttttgaactcttttctccagatgcaagtattcatgtacctacttgggtctcagaaatcttagcagtcttttgcaggtcatggttaggcattttatttaaaaacctgttgcaaattttaacaactcattcaaagtgcacaggtgaagttccgtcata

SEQ ID NO: 120336 - DNA, 440 bp, Homo sapiens
cagtgactgatgataagaagggtccggcgagaaggaaggggtagggcatgggcgctgagggacaccgaactctgaagaatcttggtcagggggactgagcagagatggggaggaggcaggaggaacgagtctctccccaccctccaggcgagtctggtgaataagcctgacatggacctgcttcttggcacttcctaaccatgtggtcttgggcttgtaacctaactctagctctacactcagttttctcatctgtgcaatgggataataataatagggatggccggtgtggtggctcatgcctataagcccagcattttgggaggctgaggagggcagatcacttgaggtcaggagttcgagaccagcctggccaacatggtgaaaccctgtctctaccaaaaaaaaatacaaaaagtagccaggcatggtggtgtttg

SEQ ID NO: 120337 - DNA, 147 bp, Homo sapiens
aactgtgggtggatgacttttttctctacttcagtagtctcaacaagttggcatgatgtattgtatagaataaatacacaatcaatttttactgaattactgtgttttcctttgattttcacactggttccttccagtcacatcact

SEQ ID NO: 120338 - DNA, 276 bp, Homo sapiens
tgacagagtccattacacactatcccgggtgagcccacagtccctcaaggtgcaggtgagattatctgcattttataggagaggacaccgagggtcccgcagtgagtccctgcagagaccagggctggaacgccaggtctttggattctgtgttctttcttccatatcatctctgctaatcagactctggggctatttgtggcagccaaatataagtcagccagcaaaatctttatatatcgactttgttccctgtgctggtgttgtgagaaatag

SEQ ID NO: 120339 - DNA, 653 bp, Homo sapiens
  misc_feature (239)..(239): n is a, c, g, or t
tcagctcgtaccccacttatgccgtgggcggggggacccaaagggcaggccgggcgccccatgtgggccgcagctcctggcccggacacacagctcgctgacacccagcattggccggcagccgcagagacgcacgggggcaggttgacacacaatacacgcacgggcacactaacccgtggcacaggcatgctggcgcacacactggcaaccgctagcacacgctcatcacacgcagnggcacgccgtcatacacgcctcggtcaacacattcttgctgacagccttgttggcatgcacagctcacactccaacacacaccaattctagcacaccctcgtgctggcacacacgtgtgggcatacactgatacgcacactgtcacctgcactcgctgtagcaaacactcttgctggcacacacatcaccctcactggcacacacacttgtgctggcatgtctcaccaacacagcggagcgcaaggccacaccaacactgacccccacagacacaatcagactgatgccctcaaagactggcaccccacaggcacgagctgctagcccaaggcccgctgacacacacgcttcaggccccacatggccagaagtggaaacacacacatcacacagggtagagcgccccccgccac

SEQ ID NO: 120340 - DNA, 320 bp, Homo sapiens
cacagaaaacgcttccgtcactgggcctgatatggaggctttcctcttacagttgggttttggctttcttttcctcttcttcccccctcccaaacccctcagccaggcttttatatgaactcaactccttctgagtaaagatgtggttctgagatcagttaataacactgggcacattaactaattaacaagagtaaggagttcagaaaacaaacagtcatggagcaacgctatcattatgtggcttctgcctgactctcctgtcctccttaagcaggcagcgatgtcaatatatctgggaaggcaaagtgaaaatcctt

SEQ ID NO: 120341 - DNA, 342 bp, Homo sapiens
cctggcttggtggagcagctctgaaccagcgtcaaagggcggtcgttattgtgttagtggcgatcctataggagaccgtatttctgagtcttacaagaggctttaccatatcagtgtgatgtattaatcattaatggtttgatctaatgctcctttgaatattatcccagtaagaggtgtggattcaatctctagaaatacgtttattaggggggaaccaagtgcagggtttctctgcaatgtcccaaaataatgtcaaagcctctcattcatgaaactgaatgagcagtgaagaagagccttgctcacaccccctaagttcagagccagggggtaccgagc

SEQ ID NO: 120342 - DNA, 350 bp, Homo sapiens
tacatgtcacacataaatacgtaaaatttaaaaatctaggttacacatggtttcattagatagaaggaaaagaaaaacaagttgagttataatttaaaactgttgttaacatttattgatctttatcagctaacaactccaaggcagaaataatttacggctaagttggatgaactgcgtattgatctaaatcatgcaacgctttttcagggtcttagtcaaaataaggccttgataattagagcaggttaagaacggcagggtggcaatgcaaattattgctttaaatagaatgaaagagagcagtatcctagcgccctcttcacctccaaccctttttaactcacagc

SEQ ID NO: 120343 - DNA, 415 bp, Homo sapiens
aatggatcatgataatgatgtaattgagatgttgtaaaatattggtgagtatggattattggaacagaaagaatgagatgttgggaaaaactctggatttaagaggtgtggctgtgtgtgatggtaggggatagggaaattaatatcacagtgggaggaaataattatttaataatgatatgctaataggggagtcaacattaacttcagtagttatggaaggaaggtgatgtttagcacatttgacaaacaaaaataccttgcaaattaccaggaggaataaaaaaaaagaagagaaacttaacgaggtcagcaaaaaaatataaaaacaggtaaaaaagaaacaatagcaaaatgtaaaaaaattgaaattaaatataagatggaggaattaagtagatcagttattacaaga

SEQ ID NO: 120344 - DNA, 169 bp, Homo sapiens
cagggctttccagaaattgccattcacgtcttccttcagccctggttgagcccatgtgtatataaatacatttcacttctcagtgcccccgtcaggcctcttagccacaccaaggctgccatacccccaccacctgcacatccccgctttgccatgatgcagcccgggt

SEQ ID NO: 120345 - DNA, 101 bp, Homo sapiens
atacagataaattatgaaaaaaaaaatctcacccaaatttctgtcccagagataaccagattttgatataaatccctcaagattttttccactgcaatttt

SEQ ID NO: 120346 - DNA, 561 bp, Homo sapiens
ttacaatcaatgccacagaaatctgaaaaatcattagaagatgactatgaaccattacacaacaacaaattgaataacctatgagaaatggctacatcgtaaaaaaaaaacacaaaacctaccaagactgaatcacaaagaaatagaaaacctcaacagaatcacaactagtaagatgacggaattagtaatcaaaaatttcccagcaaaggaaattccaggaccagatggcttcactggtgaattctgtcaaacatttaaagaattaattccaatccttctcaactcttccaaaaagctgaagaggagggaacacttccaaacaaattttaggaggccagcattatcctaatcccaaagctagacaagaaccttattaaaaactacaggctaataaccctgattaacatggacgcaaaaatcaccaataaaatatagaaaatcaaattcaacaacacattaactaagtgagatttatctctggatgcaaggaagggtcagcacaggaaatcaatcaatgtggctctaccacattaacaaaataaagggcaaaatcacagg

SEQ ID NO: 120347 - DNA, 766 bp, Homo sapiens
gcaggtgggatattttttggattatggagagctgtttgatttcacatcagtgggttcttccctcaaccttgttcagatcagtgcctgagtaagttctaatatattaaccttttctgagagaagagatgtgaggatgagggtggagggtgtgaatcttgttttttcaccatcctgttactcttctgcatgcggtgtccccttactgaggaacagaatagaggagctgtaagttggggtatagtgtggcaaggtttgtgagagacttaagaacaaagggtgtttatcataggtaattatcacagtgttgttagagtgtaggcagagcagctttctaaccaacattacaagtttattttgctagtgaaaccttttatttaccaatgaagcattagaatttcagagagttaattgtttgtgaactttgttcatggtctttctgaaactttcaactctctgtttagttacaataaggctcattttatagcctttattgtcctcttttgagaagaggcagtataggtagataggaacatgggcttgggatcagatagactgggaatagaaatccatgcctgacgcttggacaaattgtttaaacttctgaatgttaatttcttaaccagtaaaatgggaataataatgcttaccttacaggcaaggggacaatttctttgtgtggaataaaaaaaggaaggtaagctgactcattttcagaaagatctttaaaaattaataaacatgccatattccttaatcttatttatga

SEQ ID NO: 120348 - DNA, 949 bp, Homo sapiens
  misc_feature (949)..(949): n is a, c, g, or t
tgggacttttgaaatgcattctgtgaatgagaagaaatgcaaacatgttggcaaaactgattattttcattgtggatctcacgcttgctttggccatttttgttatcttttatttaatggctgccactgtttttttcatctcggtcattttctatattttcaaaagggagatggaaaaaaaactttgacttcaacaagcgccgaatctgggcgctggattctagcaatgctactgaggagcctttggcaggtggcgcagagaaagtcagctccaagctgcttcctgtccattgtccagctgtaggagaagggtctttcctgcccaaggacagtggtcctctcttctaaagagcaaggagctctctgaggtggaggaggcttgtgaagacttcccagaacactgcacccacctgaccaagaggtactttttttaaggtccttcaaactggttcatctaccaccatgtaattacacatggaaattctcattaacagaagccggaaatacccagggaggattgaagagtcaatcatgggcttcccaaggtacatgtttaagacattccacgacctcagggaaagtagacattcgggaatctttaaaggctcaatcttggggaggaagaacatgcttgttgatgacttgcgcagaaacctggtgtaataatcttggaggtgtgaatgttgagaagaggcatcgaaggtttcagaattagtgggaatgtgtcacaggttttgcagcaaataaagtttgttttggtgggaacaggcatccatggttgttgttagtaggcaaaagagattctagtgcgcagagaatgtggtatttttaaaggtgctgtcactactaatatacgtgtgatatcacgaaatatggatgtacacgaggtgtgagacttatttgtgagaaaaacggtgatactggggaaaggttgattagtcgaatgtgn

SEQ ID NO: 120349 - DNA, 815 bp, Homo sapiens
ggacataatgtggagacctgctttggttccttttctaaaaggaagcatggtttgaagtcttgatgaacagagaaagcaagaaaattccacaaaacaaattgaacttgtccagttagaatctatgataagtccacaactctttttaaaattattttacgttgaccttagagctttcagtaaagcttttggattttcccccagcttccccgggtcttatattttattagtggatgtaaaatttcaagctttatttttttcaagtcaacgtttttagtcatgaagaaatcctatagatttttgaatttaaaaaatctttttctttcttaatttttgacttgcaggttcaaaataatattttattttatcaaagttattagcaaaagaaaatatataatctaagagagtagcttgcactcaaattttcatgccctgttctgcattcttttgtataattttttaaacatacgccctgggtcaaggattgatttctctcatgtcctacctggcatcaaaaaacaggctagtatttaatagataatattactggactaaagtcatcatgtgtggctggagatatcaagacctatttgccttcagttttccctccttttaaggtcattgctggaaatttcacttttcaactcagtcttgctctgatgtttgggattaggtgaggtctatgttccatattgcctctctagataagggatttttaggaaattaatacaaaatttggaatttagactttttccatttcagtaggctacatttcataaaaactgatgattatttctggatttagaaataagacagat

SEQ ID NO: 120350 - DNA, 404 bp, Homo sapiens
agaaaaaaagacttactgggtaaatcttgctaagtagatgacactgacctttactatttaatcattataggcatcatctttaggagacggaatggcacttaataaaagatcagctttttatattacaattaaagaaataataaaaattcaaaggttacttagtaagctagaggatatatcaatctaccgttaagaaataaaaaggttgccaagcgcagtggctcacacctctaatcccagcactttgggaggccgaggcgggtagattacctgaggtcaggagttcgagaccagcctgaccaacatagtgaaaccctgtctctactaaaatacaaaaattagccaggtgtggtggcacacgcctgtaatcccagctacttgggaggctgaggcaggagaatcgc

SEQ ID NO: 120351 - DNA, 185 bp, Homo sapiens
tacagaattaaaatgtgaaatggagaattagcaaaaagagttgaggacttcagtagctcactttcaataatggataagacaaataagcagaagttctattaggaaatagaagacttgaacaacaataggatagatagaactaagaagtctttatggaacactccacccaaaataaagcaaaatat

SEQ ID NO: 120352 - DNA, 278 bp, Homo sapiens
cccccagtcccccacactcactcacaccctctccaatcagccagctcagggcagacgccgtcaccccgggggacacgctaatgaagatggccgacattaatctcttccctctcccgacaggtcaatttatagttccacggggagccctggcgctcggccagagggcctgacataactctccctgttccccgggaggacatcaggggtgggctagatggggcaagggaggctggagacacccgagacaggacagggagggaccctctgcctgagcaccc

SEQ ID NO: 120353 - DNA, 557 bp, Homo sapiens
attagaaaagaacgcgtcgacctgggtagaagcagatttaagtggaaagtaacaatgagagtgtgaaattcctgcagcagactcctgataacagacatggcatggctgacatccacagtggcatgtgggggagcagcagcaggactaacaggataagattcatggttgaacactttagactcccctgagcatgccagaaatacattataggggacttttgaaaaggactgagatctgggagtgtcccagtgcaatggaaatttgagcctgtatgctaatgtgaccttatttgtccccagaagcaatagcatttttgccatttgagatgcatccatattccaactcatctataacagtgccttacacccagtaggcatgcaataactatttgctagattgaaccaaataaatgtgcctaattcttcgattagtcatgaccagtcagtacattcttggttatccttccaggaggtagaaacattctgagttggaaaatattgtattaactataaagcaattttgcaaaataaatataactgtataatacttaataaagg

SEQ ID NO: 120354 - DNA, 329 bp, Homo sapiens
agagagctaagtggcgagaagtggtcagattctggacacacactgcaggcagacccaggacttggccggtggagtcctcacaacatggcaaggaagtaactgcggtcaggaatccagggcgctcaggagcttagcctggagctgtggagttaaaatccctgtcagacgcgcaggccggtagacaggtggctgcaggtggaaatgtggggtttgtaagcgtgtataagaagtgggtttaaggtcatgatactgggagcactcttctaaagagcaagtgtagacagaggagaagccccaggcagagtgggaggaagaaggcaaaccaggcg

SEQ ID NO: 120355 - DNA, 380 bp, Homo sapiens
gtggaatatcccccagtttgtgtttgggtgatgttttctcatgattaaattgaagttatgcatattttggaatacttcagaggtgatgttgtaccctttttggtctgtcatgtcaaagggtatatgatgataaatcttatccctggtgatattaaccctgatcacctgtttaaggtgggatgttccagtgttctcccctctcaagttcctatctttctctttgtaattttttctttttttggaacggagtttcactcttgttgcccaggctggagagcagtggcatcgaataaacaggtgtaaatcgatgccacttccggtgctggtgcgttggaaagtggcaatggcagaagccctgaataaatataagcctcagtgtc

SEQ ID NO: 120356 - DNA, 114 bp, Homo sapiens
tgtcttactgtctctatctttgtctccgtatgcctttctctctctgactcctctctcactccctctgtctgtttttcttccccttcacaatccagttggaggaaagagttgttc

SEQ ID NO: 120357 - DNA, 140 bp, Homo sapiens
acagtttgcgaacctgctaaaactgcagcttttgatatatgtgtgtatgcacatgagtgcacatatatgtatttttctggcgacagggtcttggactttcaacaagggatctcaaaggatcagttccatgaccaaaaagg

SEQ ID NO: 120358 - DNA, 295 bp, Homo sapiens
gcacttacagtgatatcctaaacctccggcatctaatccagcagccacaagccacataaggctactgagtacttaacatgtggttagtgtgattaaggagctgaatttttaattttttttttttgagacagggtctcactctgttaaccaggctcaagtacagtggcacaattacagctcattgtagcctcaacgtcctaggctcaagcaatccttccacctcagtcccgagtagctgggaggcaggaaaatggcgtggccccgggaggcagggggtgggtggagagcgggggtc

SEQ ID NO: 120359 - DNA, 448 bp, Homo sapiens
gcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacacaaagataggcacatgaggcagggtagtacaaatgagtttttcccccgtatgaagtgacaatcacatggattatatgtgaccttgacattgttgagtttctaaagactttttaaggatgccatacccacccccaatagatcacaacctatttctctcattctaatgttggtcatttgattacatagtcctttgtggctctgtttgcttgagactgcaaaataaacaaaatgtttgcaagtccaggttgacccta

SEQ ID NO: 120360 - DNA, 536 bp, Homo sapiens
attttttgtatatatgtaaaatatccatttttgtatatatgtaaaatatccattttttgtatatatgtaaaatatccattttatatatatatgtattctggatatttacactttatcagttatatggattacaaagatctttctttttttcactttatggtatcttgatgaacagaaaagttcttaattttaatgtagttgaatctatcagtcttttcctttatgttgtgtggtcttaatacctttcttaaaacaagtcccttcattactcaaagtcagagagatatattttcttttatcttagaataagagatatttttgtgccttatgtttaatggttttgcccatgattttttattcatgctgtgagttaggaattgttttgattttgtattgctgagaaacaatctaccccaaactttagtgacttaaagtaaccattttattttactcatgggttttgtggcaagcatttagaaagagctcaactagtagtttttctcttccaataaaggtggtgtcagttgggctagaag

SEQ ID NO: 120361 - DNA, 154 bp, Homo sapiens
atagtttgatggggccctggcagaggcttcatttctccaaaaggtagatattactggacactcctgagatgagaaacagtacttccttacagtttagaagatcctggagtatgcttgattgtgttcattgactgttggcgcacttgaacttacc

SEQ ID NO: 120362 - DNA, 740 bp, Homo sapiens
acgtgagcttctggaacagccggaaaccttgtcaactgtccaggtagtttgtccacctgaagtctcacctatgacttctctggatcctttggcatcctagcactgaaatctgcaaagctgcttatgtactttctgtaaggtgaaaattacggatgcagcacctgtgattaagtcatgatggctggaagtaaatcttggtgaatatttctaaatgttttccacatttcccatacagaggtttgataatttgttcacctagtttccattttataattgaggttggcagtggagaccaagactcgatgtggtgtgggtcaatttggaagaattacttcgaagaaaatgagaaagaaacactcaaatgaaatcccttttgaggaaggagatactcttttccttaaaaaaaaaaaaatcaacatttgtatcaataaaggttgagatcagaaaatgtttcccgttcaatgagaaagatttggactgtgatgaagataaactaaaaagaaaagagtttgaccaactggcaagggtttgacccctttcccctttaaaaaaatcacactaaaactacagcttatgtttcgcatgagtggatgctctgaattgcaatgcaaagtgcttatgaaaacttaagatcttacattactacttcaaagagtacatgtgataggaattcctatagaagaaaatgaaaaaggatatagcttgaaaatccaaatttatagcaaattctgcatctatca

SEQ ID NO: 120363 - DNA, 427 bp, Homo sapiens
agatgtttgccctcaaggaagactttgctgtgaccttgacctgaaaacatacacacccttttaactcaaccccaaaccaagctcatcctcactcatcatctgccgccccactccagggtgcagcaggtcagcaggaggtgaggggagaggatccacctgtcctgtcctgtcctctcctgccctgtcctggctccagcccctcccactcccatgccgcaccactccctgactccccacccccaactgcttgtgtcctcatccccaacctccttcaccccacagtcacctgcgtgtgcatatgtctcttccccttcgcttgtcacactgggaatgctgtggcacccacatccaggaatccaggatgtgcacgaactcccagaaggcattttaaagctttaaatgcattttccattctttctaaaaaaaa

SEQ ID NO: 120364 - DNA, 684 bp, Homo sapiens
tatataacaaacctgcacatgtacccctgaacttaaaataaaaattaaatttaaaaaataagattaatatctgcatacaaatctttgtttacagcttgttatatattgaattatgtctgctcccccaacattcatatgttaaagcccaaagttattgtgtttggaaatagggcttttaggagatatttaaggttaaataaggttataaacgtggagtcttaatctgataggattggtggctttataagaaaaagaaaagagattgctctctccccagtgcagttaccaaggaaaggccatgtgagaacatagcaggaaggcagccatctgtaacctaaggaaagagatctgtcaaaggacaaaactacaacaaatgtaaagatctcaattggctttatctgcgattctggaatcaggcaatactccatttcataaaacagaactagtgctccaatgagctgagcaaaaggggttgttagttttatagacagagaaggacggaagaaagcagaaataacgaatggaaagtagattggtcaaatttactttccttttaaggcagaaaaatagaacaataactattcaagtaatcttaaggttacttcaggttaagggttaaaacagaaggaattttatcatcatgcttattgaagattcaaactggcctgtttaagaaattggctg

SEQ ID NO: 120365 - DNA, 665 bp, Homo sapiens
ccacctctaaacatttttgttttgttttttatttttacttgaaaattctatagcagaaataatgacagacaaataggcttctgtcattactcaacttccttatgatggtgttatacttattgctgagtaatagtaattagtgtggttttgggtgtaggcattttacattttgaatctgagaagattttaggttcacctgagttgctgaatcaactcagtatttcaggaaagtatcttatacatgggttccaagtagtataaatattaaaaagttaattgcatatgctctgagaaattctgtaagcactctttcacgtttatttcatagatgaacagtgaagacagtggtgaggggattttatcaagtttatttgtaaaaaggcctgggctggcagactttttccttagagccagatgatctgtcacaactactcaactgttgacatacagcaaaagcagccataagcaacttgtaaccaaatgggtgtgactattaaaataaaactttatttaggcaggcttagtctgagaatcctaaatggatctggtggagggccaagggaaggcagttggcacacatgttgatgaaaacagttgtttaaacttctggcaaatttgaatactaacttaaaaaggtgtcaataaggtttatataaaaatgaaag

SEQ ID NO: 120366 - DNA, 277 bp, Homo sapiens
gtcagacatgggtcttctggccaattcatcatggcatctccaccaataaagcatggaaccaatccacgactccctctgtccccggggggaggcagtaattacttatttgctaatggggaggggaactgttttaaagtaatgcttatggctagatggtaccttagcaagggagaaaataagtcaatacatcttaaaatcttaagaggcagcaaaggatcaactcctccaaactcttcatttgtcactttaaaaatcaaaaacaaaaacaaagacgata

SEQ ID NO: 120367 - DNA, 210 bp, Homo sapiens
gccagctgctataagatatacttgggtaggatttttaataacaaatgagcaatatattttcagcaggctatatatatgctgtaagataagctttatagaagcagtacactttgtatcttatgttgactactaataatgattttcatttaaaagcacagcaaagagaccccatgtacaaagtaatataacccacttaaagactgcacaagc

SEQ ID NO: 120368 - DNA, 307 bp, Homo sapiens
aattcccagcttaagggatcatcctttgtcttctgtttgtctatgtatttatatgtagtatgtgtgtgtaatataaaagaattttaattaattgctttaataataataagcttaaatcaaatattttgtcacataagtaaaaagtgtaatgccttttagttcatgtgacttaagtaatctttgggaaataaaaacagttttaaagattactggtaaaataaagacatttggtctaaattatgcaggtcagatattaagtttgctaaatgccttaaggtcataaactgctgctttgactttttttttt

SEQ ID NO: 120369 - DNA, 875 bp, Homo sapiens
gggaaattctgttttaggaaggtacaactatgttttaaatttcaaggtaagattatatcataaaattaaatcaatattaggtgcttgacaaatatttgttggataaatgattgattgattagagttagcattttaattgccattcctgttctttattttttcctgtcagttaagtagttactgaatacttaaaaaaaagaattgtgaaaaaatactgcaagctgtattacactagtgtcctttaatttttttgcttttatatttttataaacgattaaacgtaaattagtattgtttcataagcaaatgtgtttatgaaaataaacatttctctaaacaatattttttccccataactttaaagttttagaaggttacatgtgcaagttgttacatgggtaaattgcctgttgctaaggtttgatgtataaccatcacccaggtagtgaggatggtacctgatgggtagtttcttaactctcgccccctctcccaccttccccccgttgttgtccccagtgttgactgctcccatctttaggtccgtgcttactcattgtttagctcccacttgtaagtgaggaaatgcagtatttggttttctgttcctatattaattcgcttaggataatggctaccagctgcatctatgttgctgcaaagggcatgattttattctttttcatgtcgacatagtattccatggcatatatgtactgcattttctttatccagtccactattgatggacacctaggttgactccacatctttgcagttgtgaatagtgctccagtgaatatgcaagtgcatatggctttttgatagaatgatttatttttctttattttcccttatttcattaaaaacattat

SEQ ID NO: 120370 - DNA, 429 bp, Homo sapiens
aggtaggacagttcacaccatgtcatcagttattagaattgggaaaatacagcttaatccaagacttcatgtacaggtcgaactggagggattgaatggctcaccggagactttccagcaggtcagaggctgagccaggactagaacccagaattcctctgtcctaggcctctgccctttcccctccaatgcctactcttactgctgtttctgtgccccctgccatggcacacatttacttatgctcattggtttgtccagggagtttgttctagactatggcatgagaaagggaactcttcccacctacgaactgaccttcctaacattgtgccacttggtcatgacagcccaagagcacaagcctggagccgcagccagtggcaggtggctgaggcatgtgaaggtggagggatgttgcacactctt

SEQ ID NO: 120371 - DNA, 396 bp, Homo sapiens
agcctcttaaaaaagaacctaaaggtcattgattgaagccttttattttcaatatattacatctataaatgtacttttaagaaacgatttatctgcatcccacattttattaagtttttaaaaaattttctttcagtttaaactattttttttgtgtgtgaaacttttcttggccaatgggtttttctgaagtattttgtttaatgttcaaatgttggggtgttattgtacatatcctactgttgtccatctctggttcatgatacaatgcatgttctccattgcacttagataacatgcctccatgtctctggagaattcctcagtctttctaaaatgcttttgatgaatactggcagttattttgtagaatgtccctcctcaatttcagttagt

SEQ ID NO: 120372 - DNA, 443 bp, Homo sapiens
gtggcctaggaaggctcagctccaagtgatcagctctgtcctacagagactgaagcttggagcagctggtgacaggaccacgggcacgtagcctggattgggagaagttgggagtggcgatcactagtgtttgcggagcacttgctaggaggcctgagccaaggatgtaatcttattgatgtacgttatcttatttaatcagagcctgccaaacatcccagtctgccccaaagtcccgggcgacacctgtcgccctggcgtcatcattaataacccccggaaggtgaaaactctcagagtgcccttgtggagctgagaaggagcacggtttcactgtgcttagtcctctgtcgagccctctggaatatccctatgatgtggatgaacaagctgtgggtcagggggatggagggacttgcccagggtcaccagctcggaggcag

SEQ ID NO: 120373 - DNA, 352 bp, Homo sapiens
cagagaggctaattccgtcagcgtgaggaacagaaggagtcactcgagaagccatctccaccaaagtaaacacatccttctggaagcttaaattttcactttatcccttgggaactagggacatgagtcataatgagttagcaggtggcttttgtgaaatacaagaggctttgtgaaatgcagcaaatatagccaaaagcatgtgtagtagcttcctatggctgctctcacaaattactacaaattcagtggcttacaacaacacacatgcattcccatttattcagttaggaagtcaaaagtctgaaatgcatatcataggctaacgtcaacgcgtcaatagaaccgtgtt

SEQ ID NO: 120374 - DNA, 377 bp, Homo sapiens
agctgcttttgtcctggtgatcccaagacccctgtggggcagcctgactctgccaaccaggttccataactgcagtgggtaccccgtgtttgttggtttgatggaggcatcttgactaagcactgcagggtgcctggctctgggtgggggtgggaaacagacaacccatcttcctgctgagtcgccaagtagcaagtctgcagggctgactgatgtgcggggttgtgagtcatccttcctaaagtgatctgggcgcccccagcattgccccagagctcaaaggatgacagttcccgcaggaggccattccagggaagagaattctagggagggggagagcataggtaaaggtgtggaggtgggacattcctgcatcg

SEQ ID NO: 120375 - DNA, 381 bp, Homo sapiens
caaaatttactagaagattcattcatcaatgcttttatgaggctagaagttcagtttaaaaggcaaatcaggcttggctcagtgggtcacacctgtaatcccaacactttgggaggctgaggtgggcagatcacctgaggtcgggagttcgagaccagcctggccaacatggcgaaaccccatctctactaaaaatagaaaaattagccaggtgtggtggcagttgcctgtagtcccagctgctagggaggctgaggcaggagaatcgcttgaacctgggaggaggaggttgcagtgaaccacgattgtgccactgcactccagcttgggtgacgagcaagacagtgtctaaaaaaaaaaaaaaaaaaaagaaaaaaaaaa

SEQ ID NO: 120376 - DNA, 769 bp, Homo sapiens
aaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaata

SEQ ID NO: 120377 - DNA, 588 bp, Homo sapiens
tggcaaaactgaggcccacaccagtggggagatttgcccaagtgtcctcagcagcagagttagagccagacccggtgtctgcaggattttaagtagctcagagacagtcacgaagtgctcatgctagtccttagctgtggctcagtggagggctggaaatgagctcagtggggcagttgctgggggtggtcagcaccatcctgagatggtgaggtgaacacagtccctggccacacctgtacagggagaagcacctgcatagggagaagctttccatggccaaccctcctttactgagagaggactcgtcatcaactaggcaccgtgctgaaatgtacatcaacttgggagacactggcaacaaccctatggggtacagcttctacatttaataaatgaaagcctgaggctcagaggcaggagctcacctgaggtcacagagattgatgaacagcagaacagttcaccaagacaaggactctgccattgcacatgcagggactttgtgagtgatgctgaacctcagagtggctcatgctccatcatctgcaaggaaagatggtgacagctcagattgcagaaggaagt

SEQ ID NO: 120378 - DNA, 322 bp, Homo sapiens
cagcagaatcgcttgaacctgggaggcggagattgcagtgagccgagattgcgccacagcactccagcctgggtgacagagcgaaactcagtctcaaaaaaaagtgaggtgaaagaaatgaggtggggttggttaccagttacaggaatgaccaggccaactgtggctttgtctgatgatgtgatctaggggaagtaggagctttgagaaatggtttgtcaaaagagaaatggactgtagttatggggaaggagtggatgtgttatcagagtttgtaatagaaacattgacagaagtcactcgcagctgagttatctgaggg

SEQ ID NO: 120379 - DNA, 340 bp, Homo sapiens
gagaatgtcaaatagaacaaaaagaaataagaattccatcttgaaaaatctttgaaaaatctttaaaaaatcaagtctaaattttatatcttgctccaaatatatagagatataaataggttatcatcaagatatggagaaagccatatcatggaaacactaaaataaggctgtggaaggactacattgatattagacacaacagagttcggaacaagaaatagtatcagagatgagagacaatagataatagaataatcaattctcaagaagatgtaaacatcctactaattagggtatgcagctaacaacagagcctccaaatacgtgaggtaaaaca

SEQ ID NO: 120380 - DNA, 712 bp, Homo sapiens
acctttgtgacttctgcatcttacatctcaatctgtacctcacttctgctttttgtccttttgtctcatccttaattttacttcccatttgttgctatacaatgtgtgtgcatagttcaaactaaatttaactctgctattttgagaggaacaagttaaggggtaatccttgtaggttacaataagaacatttggtagaatttagcctttataaacaactgaccattcaagtactgcaattttacattctctagttattcttgctagcagagctcctattgtctcaaatttaaaaattgcattaaacagttttgccaactactgtttgttaaatgccatcatcctggatccttggatttctttaataaatttgtgtcccttccttggcttttatcttctttcatccatatttcctgtattttttcacctcacgctacacctcccttcttctggtcatggtcctctgtggatatgattcctagtattaagccactcctggatcccatgcatcaaattacctttaccaatttgaaattctaaaataaatgactggcaggtttctgcttttctcagagccatgctggctggcttctcccacacatttacaaattcttaagattcatatatttatagaaaacagcttttaaagttctgtgtttggctatcttccagatatctatttgcatatttaaacccatctagctgactttgc

SEQ ID NO: 120381 - DNA, 469 bp, Homo sapiens
gcacgagaaaaaaaaaacaaaaacaaataaacaaacaaaaaacaacaacaaaaaacaccctgggtactattccatcaaatgaaggtactgtgagttatctaatcagttccctgttgaggggcattttgattgtttcatgtcctttactcttaggaacagtgatgcagtgaatatcctggtggatatttaatagacgttctctgagttgaccttgcctggatggagatgcatggataatagacgctctgtgtttctgctgcccattatactccaaacacttgcagccctgtcgtcagtgcaacctgagtcagttgttcattaatccaactatttattttagctgtacttgctgccatcatttgatttcatcaaatgttatgtaattttaatgaaagttcagatttgaagagatttgctaacattgaatcaccaaatttctgtcaaataaggcatagtagagacagctgtt

SEQ ID NO: 120382 - DNA, 794 bp, Homo sapiens
ggaatttgtgccacaacttttattctgacagaggggctattcatcctatggaattcttttaaaatcactgacctgaacaatatgcttctcagaatgttttcctgcttagcttataaagatattattatgtatctatgatataatcactagaaaatgctccctgtggggcatttgttgtccccctaattatcatagttgattgtagaattgatatacctgatatacttcaaggtacaacaggaaagcagataaaatcttttaagcaaatggcaacttctgtcttcatactgaaatctgttattatatatagtacttctaccaattaaaggatagcctataagcagaactttttagtttaaatgggcaaacattatggtaatagggttaaaataatgattcctctagttatttgtgattttgatatcaagacaaatctatttccaataataatcattagttataatctctgatacaaattactcctcagggactcagtttcctttctggaaaatggagctagaaatactttccatctttaaggactgatttgaacataaagagaggtaatgtatgtaaggagtctaacactgtgtttaactaatttctattagtgtttattttagaattcgtgcaattctgaagcccagagccataaattttattataccaatttttcttattttggctgtgatactgaagaatagtaactcaataaagttaaccaactataaggaaatcacaggcttcatctgtcacttaggtcttcatgattattcaaactatttgggaagatc

SEQ ID NO: 120383 - DNA, 410 bp, Homo sapiens
ttgcggtcttctgtgaggtgcgataggtcctgagccctctctgtctgattctgcacaatcccatggactgggctcttcactgcggattatctgacacatgctgcgggcggatttctggaggaaggtttgtccgaagagctcatcatgctgggtctggttcctgacgggatactttgatgctgaacagggctggagcacaaactgaaattcccctcgtaatcatcattttcttgcgcctgctcaccaagaggtatctccttgtagatcacagccatttgctccaaacctctttcctgaagaaaagcgtcccccaggtcctcccctgggaaaagcccttgttgtgactctagcctgttctcaaatgcaaagctctcaccaaactttgagcagagaccccaggtgatcctcta

SEQ ID NO: 120384 - DNA, 182 bp, Homo sapiens
aggtgtgagccacagtgcctggcctaaaaggaatatttcttaccattctttttccaaagtgtagattcacagtttgactagattgatttcgatgtcactgtaaggtggtagaggaagaggtacagagaaggtcccatttgtaaaccaaaaagtatctgagacaggactcaatcaatttagaa

SEQ ID NO: 120385 - DNA, 332 bp, Homo sapiens
tacaaaatagccatcattaacttaaaagaaaggtgccctacaaagaagggatcattattttttaaaaggttgctgtcctttcttgtaataaagcttggagccaggtaagtaagtggtacaagtaaagaggccgaggctgataggttagacttagataaggaggacacagagggaggcagctctatgtgacaacaagcactgaatggacaaagcatcccgggtaaatcagctggaaacccactgccaggcccagttccagtcacaggcacagtgagtgataacagctggggcagccacgtctccccaagcccggagaggcagatgcctcccca

SEQ ID NO: 120386 - DNA, 841 bp, Homo sapiens
gaacctttgaagagtctctaggttgccctggtaatgctgctagtatagtaacagaaaaaacaaaacacacagggtatctgatgccacctcgattcaagtgcaaaattaacaattctgaaaccacatggcatagttagtcgcttattccatgctcctgccctaaaaaccctggcacagatctgatagggtccttgaagagactttacagttgtctttattatcaatgttctttctttttctgctcccccaacctgggctttgccatagctcctgtggagagccatattctagagcaaggtgtctcaatcttagtaggattgacatttggggccagatcattattcgttggtgggggctgtcctgtgtgcttttaggatgtttagcaccatcactggcctctatccactagcaacatcccagcaactggtgacaaccaaatttctccagacattgcctaatgtccctaaggagtgggagtgaggggcctaatttcacctcgttgagaaccagtggtctagaataatcagtatagagtggtttctggcaggggacacagtaggcaagctctagcagcacctgtggcttttgtgagcttctgatccctatgggacatacacagtcagcatttccaaggggtcagtcttctccatagagagtgaggcttctaatgctataggcccaccctcaggaaacatatttttttgagtcttgtcaactggtttttcatttaaaattgtcagcctctcctccctggaagcatctgctgtcatcaagaaagagttgtcatttccaaaattaacgtgctgacgagtcagacctgacattcttatgcacactgtgc

SEQ ID NO: 120387 - DNA, 591 bp, Homo sapiens
gtatcgatgcacccaccttactaccagacaaccttagccaaccgtgactagtatcttaatcatttttattgccacaactaacctcctcaggcaaaaatagaaaataaaaagtaatgagcaaaaacttcatgacatatgggacaacacaaagcaatgaaatacttgaattatcagggtcccagaaggcaaagaggggagaacttttctagtctagcaagagatttagatatccagatacaggagattcagagatccctaaacagataacagtgcaaaaaggtcctctccatagcacattatagtcaaactcaaaagtcaaagacaaggagagaattctaaaaacaagagaaaagtgtctagtacctataaaggaactcccatcagaataacagcagacttctcagcagaaatgttacatgccaagagagaataggatgatgatatattcaaaatgctgacagaaaaaaaaaagccctgacagccaaagatactatatccagaaaaattatccttgctaaataaaggaaaaataaaatatttcctagacaagcaaaagctgagagaatcaccactacaccagccttacagaaa

SEQ ID NO: 120388 - DNA, 101 bp, Homo sapiens
catgctggggggtggggggtgacaatgatgaaatgcatccagaacctgtttcaaggccaggcctgtgacacagctccagactagatgcatagtgaaggctc

SEQ ID NO: 120389 - DNA, 388 bp, Homo sapiens
acagcgatcacgactcactgcaacctccacttcctgggttcaagcgattctcctgccacagcatcccgagcagctggaattacaggcgcccaccaccatgcccggctcgtttttgtattgttagtatagacaaggtttcaccatgttggccaggctggtctcgaactcctgacctgaagtaatccgcccccttcagcctcccaacgtgctgggattacatgcgtgagccaccgcccctggccaagggaattgctggatttgttttcaaaaaagaaaccctaatttgtaaaagattcctctaaacttagagaaaaaaagaagcatatagaagagggggtgtgagttctgaccttttttgaagtgcagcatgtgtgccgggaagggcccc

SEQ ID NO: 120390 - DNA, 170 bp, Homo sapiens
gaaggttgagactacattgagccacgatcacaccactgcactccagttcagcctgagcaagagaacaagatcccatctcaaaaaaaataaagacaaaggaaatgctaaatttcagaggttagtaaaaataaaaacgcatttttttcaagttaaagtcacagacatcccct

SEQ ID NO: 120391 - DNA, 637 bp, Homo sapiens
actagtaaatccaatgttaccagaaacaaaccacaaaaagaagtgtactctgggagtgctaaaagttaagagcacgttatatttagcaagtggtatagttgtctttgaaatggcctgttgattaaagttttgagctgtatttccaacctgttttatgagttgagaagcataactctcattggtaactgctcttagtaacaaaatcctaattctgctttaaatgctctttcttaattaagatatcatatttgattatgatatcttgaaaacattggttttctggataagttataaaacagaatttgtatccattcactctgccttcctgttatagaaatgctacagctcagggtaataaatgggtctcttgtcaaaatcctgtaatgttgtctcatttgctagaaattcttgtttgcccatttctttctggttgaaacttatttcttgtaaattaactcatctgtgctatccgtgcctggagaattattcctagtactttttagaaaattaataaggcagccgggcgtcgtggctcacgcctgtaatcccagcactttgggcggccgaggcgggcggatcacctgaggtcgggagttcgagaccagcctgagcaacatggagaaaccccatctttact

SEQ ID NO: 120392 - DNA, 358 bp, Homo sapiens
ttcatgcagttgagcatgctcattaaaaacagatgagagaaatttagacaactaacaaagcagatcaatcttcaactatctcacattgcaatctgggatatgcttacctttgctaaggtcacaggctcgggatcagtgggaatgtagctagcacacagaaacctattattattcattgcagtagagctgtagcactatcattaaaagtctcccataaaatatttggtactggtcaaaacagggaaaataatgatgttagaattctatatgcttacaatatataattcagaaaccaaacaaatgcataagccaatttaaaagttaaggaatctcttgggcctcccttctctaattactt

SEQ ID NO: 120393 - DNA, 798 bp, Homo sapiens
  misc_feature (798)..(798): n is a, c, g, or t
gtaagtgaatgctatggaatgaagcccttctcagcctcctgctaccacttattcccagacaaccaccttctccccgcccccatccctaggaaaagctgggaacaggtctatttgacaattttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcatgtccactccactcccaaaattaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaaaaaaagaaaaaaaaaaaactgttgttggggcggcccttgggcccttgggaaaggttttttagaaccttgggttggggacgcggaggcccccagttgggttatagtcaaccctgtcgccataggggtgttcccccgagggaaaacccgggggatcaatgacataggggctgggattttctccaccatataaaaaaggcgccggggggacccgcggagtgtttgtgacaaatttcccaatggagttccaagaaggacaaagggggtgtttttccacggggagtccaaaggagacctcatattcaattccn

SEQ ID NO: 120394 - DNA, 235 bp, Homo sapiens
tcgctattcatcggcacctggataccgcagctaggaataatggaataggaccgctatcccctgcctggtgtttgattgggtgttgggggtctggctgtgccaagctggatggaaccttcgaaactcagccacctacctcatttctcagaaggggagacagaagcccagacactcaaggatttggctatagtcacagagaaaggggtctccctcatggtgccgatgaatatctgta

SEQ ID NO: 120395 - DNA, 147 bp, Homo sapiens
gcatcctgctgaaggcgtcgaggactgaggtctgatctgctcctggagctcagacatcggggtgggattctctctgacctgactctgggttcctgctccgttggactcggcagggttgcacatggaagcccaaggttgagtccccct

SEQ ID NO: 120396 - DNA, 797 bp, Homo sapiens
aaaaggaggctgagtccctgataacataatggagctgctgcaccacttcttaactgtccgactccagacttctttgatttgagagactaaattgctgatttatttaagccactgttgtcaataaaaagcagttaggaatacagttcctagaaggcacattcatattttcatttcacactagaaaaatggaataaaatgtgttataagttgtttggggggggcttgctttttccccccaaatgataaaatcaacatgttctcagtatttaccagaaaactaaaggcaaagttcattgtcacaatgtgaggagccccactgagacaactatttattgacctaagttgatttttcagatctctggtgctgaacattgggaggtggggtgagagggtgaggagattgcgtatgtctacctaggaaggggactaaacaggaaggagaccagcagcccatcttatcctgggaaaggtgggtttgtatttctgcccctagcataggtaggcaggtgtgagatccaccttgaatctatgggaaagctgagcgtattccctggactgggatatggtgtagatgggtccggggccaaatcctgtgaccagaatttagcccagtggccttaagtcttggtcccaatttcccccacctaaaacaatcatgcctccagatgcttttcagactggcatgtaacactcttccaaaagatgaagattcctctcattctttaagacagggctccactgtcacctcctcctgtcccgattttcaccaggaaagtctccattctcttctctgtgcc

SEQ ID NO: 120397 - DNA, 790 bp, Homo sapiens
gatactggaattatttagatagattttccattgttgacagagtctagcttttctggaatgaactgtacatggtagtggtatattattctttcatgctaaattgtaattctggattctgtatatgcttaaattggaatggtattttatgcatccatttttatagatgagattattagcccttaacattttaaaaggtatgtggaaatcttagtattaatttttagagatagggtcttaccctgtaacctggaactcctgggctcaactgatcttcccatctcggcattccaagtagctgggattacaggtatgccctaccacacctggctggttttttaaaaaaatttttgtggagatgagtgtcttgctatattgcccaggctggtcttgagctcctgggctcaaacgattttcccacctcagcttcccaaagtgctggcattacaggtgttgtataatacatttcttttaagaggtgattttatcccattttcacattctttacttggggaagaaaaccacatggcaaacatattttataaacccattgtcttccagacttgtttcttgtcctctatgttctataagctattgttcttgagtcttgccagtgtataaggtgacaggttttgtttccatggtgctatgttgtaagttcagtgtttatgtttttctgtgcatatcacataaagatccttttttaaaaaaagtttagtgtttcattacttgcatttttctttagatgtggcgctgcaaagtgagtcagtaacctttgttgagtttcgaaaaa

SEQ ID NO: 120398 - DNA, 421 bp, Homo sapiens
catgacagccacatttctcctttaggtttacttgatattaatgtgaaggtattctataataatcatcttaataatgattttgaaagtttgtatggtttgtataaaagtttgtatagtggctagtttatgaaaccctttcactgtattataccatttgaagaatgccatagctttataaaataggtagagcagttatattcacgtgttgtgcatgaggaaactgtttatgagtagtgtcttgcctagaaagtggtaccatataatcaaactcacattttcggataatgctgctttttttaaaaaaaacagccttattatagtataattcacataacatgcaatttacctatttaaggtgtatagttcagtggcttttaaagtgtattcacagtggtttttgcaaccatcgtgtattagtcta

SEQ ID NO: 120399 - DNA, 422 bp, Homo sapiens
gatgatgataacagcggtgatgtggttatgatgacaggtggtgatggcaatgatgatggtgataatagtgatgatggtgacgatgatgatggtaatgatggcgatggtgatgatgtggtaatcatggtaatagtggtgggcatgatggtgatggtggtggtgttagtgataatggtgatatggtgattatgatcatggtgatggtagtgacaatggtgataatgatggtgatggtaatggtggtggtgatgttggtgataatgatagtgatggtggtggtgacagggcaagtattgatgatagtgatggtggtaatgctggtggtagcaggaaacacttatcttcatagaaatgttattgttgaatctgctgtacgataagcagttattttcagagaacaagcatcaaggagaacagagagc

SEQ ID NO: 120400 - DNA, 364 bp, Homo sapiens
  misc_feature (10)..(10): n is a, c, g, or t
tatcatcggnacagactgccctcgctatcatcggcaccgatggcgatggtgatgatgtggtaatcatggtaatagtggtgggcatgatggtgatggtggtggtgttagtgataatggtgatatggtgattatgatcatggtgatggtagtgacaatggtgataatgatggtgatggtaatggtggtggtgatgttggtgataatgatagtgatggtggtggtgacagggcaagtattgatgatagtgatggtggtaatgctggtggtagcaggaaacacttatcttcatagaaatgttattgttgaatctgctgtacgataagcagttattttcagagaacaagcatcaaggagaacagagagc

SEQ ID NO: 120401 - DNA, 738 bp, Homo sapiens
atacattttgtttttattagttaattaatcagacaaaaactattgtggaggaaattcacttaagggaaatgttgcaaaaaagaagggtattatttcttctaactgataaacaccttaaattggcttctaagttagaaaacaatttgatacatatgaaaaatattttttctgcttctcctttcatttaatacttttttttttaacacaccctaaccattaacagatttaggtaattcagattatttaaaactactcacaagttattttttttcttttaaaaatagagcttaatgttatggagccttattttcaaagaaattatttattaaggaatattttcattagaacacacacatatgaaagtgccttttattttatgaagaaaatacttctgtgtatcccagaggtctattttgttaaaaacatcatctgattagtttgaagtaacaaaaaggatgtctatatcaatttgtagggtttgtgaaaatgaatgataaaatgagtttttaattcataagacttcaagcaagcaaattgataacttgtttttggtctgaggcaaactggacaaaaaaaagaaaacttgtaacagatgaacataatggtattcctacttacagttaaaaatatattaatgacatctactagaaataggacatgtattatgcgtaaatcggtaattcaaactatatatttgaagtatatcctgtcaaaaaggactttacttgtataaaaatg

SEQ ID NO: 120402 - DNA, 293 bp, Homo sapiens
tggaaggataagtaagacaggaagagaagaagggtggagatgctgggagtttggagagagtttagtgtgaatgtcacttggggtttcagtttccagttgggaattcggtgggcaagccaaggctggcaaaccaggccggggctggctcatgaaaggccttggatgccaggttaagaacagcagattaggtactggctttagttcacatttggtttctgctgttattgctgtatctgagcttgaatgctgttagcatctggtttagccacatgtcctcaaagagcgtgttttcc

SEQ ID NO: 120403 - DNA, 734 bp, Homo sapiens
ggagttcatgctaacatagtattcaaaaaatgtttgctattattatcataccaaataatcatttggtaaattatttttcttaactagggtgaccatatgtcggtgtttgcctgggacagtcctagttcacaccgtttgtaccattgtatttattattagtgccctctttcattcacaaaagtgtcatgagttggaaggaagataaatcatatggtcaccctacccttaatttttttatctttcatattttcccccttgaatatttactaaaatagtaaatacttgtaatttggcttctgaatggtgaagtcttattttttattaataatatcagggttttacaaaaaaaaatacaagttagcaccatatgatggagacagtagcaacttttaaaaaaaggaaatgcataatttaaaccatgtcactatactttttccttttattcaactcactgtgtcactgggctactgacataatttcatagttcagtttaaggaggacatggactaacaagtagatgtgggtaaaattctcttttttttagcatatagaatttatttttaatgattacatgctgttttcatttgatcctacttctgtcttgtttaaatacttactttgtcacaaattagaaatgtgaccttgagcaagttctttaactttctcccaagttttttatctgtaacatagaggtagagctgtttggggctgttatgaggattatggaaaaaaga

SEQ ID NO: 120404 - DNA, 138 bp, Homo sapiens
tggatgcatggattgatgcacggatggatggatggatggatggatggataattggatggatggataattggatggatgaatggacaggtggatgcatggatggatggatggatggacaggtggatgcatgggttgatg

SEQ ID NO: 120405 - DNA, 224 bp, Homo sapiens
  misc_feature (19)..(19): n is a, c, g, or t
  misc_feature (59)..(59): n is a, c, g, or t
tgctggaaaagctgtttgntttttcattaggaattcatgtgagcttcctgaatttcaangaagatacatctgctctttaaatttcagtgctgtgtcaacacttactaggaaattcataaattctggtcaaaaaccatcttttgatctggtttgatttacagtttctaaaacagaatagaaaagcctaaatccccattacactcacatgtacagagatgtatgaa

SEQ ID NO: 120406 - DNA, 461 bp, Homo sapiens
attcctttctcattctccattcatctcatctccctccctcatcaaaagcctcccatcattctgcaagacaatatttcaagtaaccctcattagggaaggctcccctcttccccagtcacaaattcccgttcctcttgccttcgcagttctttactttcaattctaccatgtaaatttgtaatctgttttggattatgctgtttgcatgctgttttctctcccacagagtctaaactgccagaaggtaagaatatcctgttttcatgcctagtctctacagcacctagcacaggattctacatagaggtgctcaatcagtatcccctgaaatcaaacttgtagaatggagaaaaattagctcgagcttaaaaggcagatctatcaactaatgaatgggttaacaaaatgtggtatatctatataatgtaataccatatagcaataagaatactgatacatac

SEQ ID NO: 120407 - DNA, 983 bp, Homo sapiens
cgccagaaagctcagtctcctgctcaaaacaggagcgcagcagccggagggagtggggacaagctcgctgaacactgggcgtctcgacagggaccagagcctgcaggactgttccgagacgctgcggtggcggcggcgccggaggacgcggaggactccctggccacccgccctccgtgcgctctgccaccgggcgctcagcagagaccccgggctgcggctgcacttgctgagtgcctctccccgccgccgcagcccagaggcgcccagcacctggagctcactggagctgagggtccgagctgagcgggctgttgtaaagccgaaaggcgagtcagtgactgggacctctgtcctggtggcgacggagagaaacagtgagcccgaggggcgcgggcacagaactgtccagctccgagaactggggtccgccagccggcggggaaagcagctgagcgcggaggcgagtgagcggacgcgtcccggggtctttgcagtccccgccggccccaaggcaccgactctcggtcagttgggcgcggcagggcgggaggggcgcgccatggaggcgccgggtcgcgccagtatgctccaggccaagtgaagcggtccggctggggtcggcgggacccgcgggccatgtacggcgacatattcaacgccacgggcggccccgaggcggcggtaggcagcgcgctggccccaggagccacggtcaaggcagaaggcgctttgccgctggagctggccactgcgcgcggtatgagggacggcgcggccacaaagcccgacctgcccacctaccttgctgctcttcttcctgctgctgctctcgggtggcgctcgtcgtcctcttcatcggttgccagctgcgccattcggccttcgccgcgctgcccacgaccgctcgctgcgcgacgcccgcgcgcctggaagacgcggccggtgttcttgggactgagccacggccgccggggccccgt

SEQ ID NO: 120408 - DNA, 423 bp, Homo sapiens
gagaggacccaaaagccttcttctaggggagcacgcctggcagctctgagatatgaaagagagaacccagcaaaaacaggatgtcactgggtcctcgagtctggggatcagggtaacccaggctcagtgaatttttctgtctctgagcccctcagatgaattagcgagttcttcagggagggtctttttctccatggctggtactgtctgactgggtggagacttatgtcccaggaaaaccgaaataactgcttttcttgcaaatgctttcacatagctctttatctggtctgtggtttcagggaagggcccttctgcagtcaggaattgtccccagcctttatttagagggctaagctagggaaatggttctgaatgtaacatgtttctaactgtagtaatctatgcccctccccccccacc

SEQ ID NO: 120409 - DNA, 362 bp, Homo sapiens
tgcagttggactgttatttagcatctaggcccagctgctttaagaaagaaaccccgggcacagtaacttcatcgagatagatgttcatgtctcccttcagaacagccccgaggtatgcagtcctggcctggtggggctcgctctgccgtttcaggggagccacctgccacacccactcggcagcctatagtcacatggctacaagtagctgtgggaatactgcgagtgtagtttttggcagggtgaccacgtacccagctatgactgtggataaagagaattgccatagttgttcagagtctctgcaacttgtgttctgtgcaccccgaggtcccgccttcaccccatcagcagtgactggg

SEQ ID NO: 120410 - DNA, 688 bp, Homo sapiens
tgcaggggttccgaggcggacctggggagcagaaacccctgtttagggtgaaccgtggcgggcgccgatggcctcttggaagaggacagactagcagctgcgagggagatgggactgggtttcacccctgaaagggcccctggagacagcggggaaactgacagggagatcatgatgtcgccattttgatggggtccccagaggagagatgtcctccccaacggctcctggacaggactggggaaagagttcaggagggctgctgaacgccggagccttacaactgttaaactcaggcagagctcgggaaatgctgcccggatgggtgagtccttttaacacctcttgggttgatttttctcacaggttttcggggtttgcagagctctgagactgtgaccacagggtgagacctcaagctgcccagtactgtggccccatttcagaggccttgggcctgggccagagatggacgctggggctgccttttactccaagtttttttcttcattggtcattggtcattgggctccaagaaaagcactttttcaggaatcaaagaagcagtgatggaacgaaaagcagagaaagctgatgagccctgaatggaggtgaaacttccaggaaatatcacttgcctcttgattaggggaaatcacttttgaatgaccccgagttttgtgcccca

SEQ ID NO: 120411 - DNA, 911 bp, Homo sapiens
agtggtggtgggcacctgtaatcccaactacttgggaggctgaggcaggagaatctcttgaacctgggaggcagaggttgcagtgagccgagatcacgccactacactccagcctgggcgacagagtgagagtccatctcaattaaaaaaaaaaaaaaaaagagtcagctgcaaaacaatcttacacaaggacatgcacaccaacttagttaccaaataagcttcataaaactgtttattttattgttttggtcaaatgcctgaaatttttttgttaaaatgggccattttctgatttgcctgaagccctgtgacaatttgggaaaagttgacgaggctaataatcaactatcagcaggaggaagaagaactcaaaatagcaaaattcctaagggaagcaggacagacagagtctagaacttccttccactctgagaatcctagcacacctcagaaaaaaaggtatattggaaacactggagaaggagatataaacaacagtaaccaacataaattcaccaggtaaggtttcagtatctactagggaaggtggttaaaagcatatgctgggagtcacattgcctggctatgctgtttactaataataccttgggcaagttacttaacctctctaagcctcaggttcctcatctataaaatgaataaaacaacagtacttacctcattaatattattgtgaggattaatcgatatgtcttcagtgcctagaacatgcttagaacatattaaatgtgcaacacaggtatctattggtagaaatttgaccccacaattctacctctaggaatttgtcctacaaaaataatcaggcaagtatgtaaagatgtatgaataatatgactcattaaagcatcatttgtaaagaaaaaaactgggaacatcttcagtgt

SEQ ID NO: 120412 - DNA, 292 bp, Homo sapiens
tgtctttcatctcgcacagccttcactccaacactcacacatcttttcagaacaccctctcccccacctttggctctgctcatctgcgtggttgcagcctgttatgtaactgccaccttatcaaagcaccaaaatgtggaattgctgtatatttcttaaattatgcaaggcttgaccttattgctgggaaatacctagcatttttaaattgtcttcagaggtccaggcagcatttggaggagctattactatatcgcttgtcattcttcggatctatgctcatgcatgcaac

SEQ ID NO: 120413 - DNA, 1762 bp, Homo sapiens
  misc_feature (463)..(463): n is a, c, g, or t
ttaaaaaagcctcgttagaatttgctattcgaaaagaccttaaaaaccctcacagagttctaaacatcccattcattgaaaatacttttcagttaagtagatttgttttgtgcacttcacaacttttaggtgacatgaatttgaagcgtagcaaaagaaatgtataaagatagccttttctggtcattaccatgtctactcaagtttctgttttctaggtacactctagcattgtaactttttccccctgagaagtaattttaagatctatcagtctcaatttaaatgatctgttaatcagccagagttttagtttcataatatcgttccattgcctgacaaagatatacacactgaagtgcctttagcagacctgggaccgtcaagaatcttgttaccctgattattgcaagatgacatatttcttaagccatttataatctcatattcgggttgaatctgnatttacaaataaaagggttaaattgaggcagtttcaagcagcatttaggaaaatgaagtggcttcaaattttagtgtttctggttacattattttgtttgaattatacaattacataattttctgtaaccaaaatggtaattttgatggattttttaaatgccaaaatccaatcatcaaggccaaagaaatgcatgattactctgatttcttatgcaccattcagtcaagacttaactcagaggcagttgattcagtgcttacatctagacaaagctttaatgagtgcagacccagcctaacagtatttcatctaatttctttgatggcttaagccaataagcactgaggtagcttttctcagaaggaaacagattttattttccaggggctaattaatatgcaccacctaagtccccaaaggatcacacaggtgcctgtatcatgccatatgtcatgtgctatattcctgcaagctcaagagattaatatacaatcattattatgaattattatgttgcattgaagttaatgtcggtcttttgttctaattaaagtacaaacgtggcatctgaatagaagcttagctagagaagtggagttagagtccctattttaatgaactacatatatttttcaatcaaaatgtgtaattatttaattatctagcctgctcagtaatcataactctccaacttcttcaaagggcctttattcaatatgttaccactcatatggtcattacttggtaagtgttttatattttgaatttcttagatgctttcagtgtatgtgctagtgttttattaatattaaaaatttttgtttacttatatatcaagctgctgcaaatggactaccttattttaaaagttagaataaaatgctattactctctaaacagaactttagcatatctgtttgataagaaatacacaaacaaaatatttttctatgctattgcaaattgtccgcaggaagcaaaatgccagatggttaagtgtagctcacataattatattccaaaggtgttataaacaattctatttagcatctgagataggtctatattaggcaatttcatgtttacatttctaacagaaaggtttaatggcaaatattccttatattctaacttgctacttggagaatatggatattctgaaaagaaaaaccctttctagaacactgtgcaggactaatttttttttaatagacatccagaaaatagcctgggcaacaaagtgagaccctgtctctctaaaaaaaaaaagtcgacgcggccgcgaatttagtagta

SEQ ID NO: 120414 - DNA, 394 bp, Homo sapiens
gcacccagcatgattaggcagttatgatgggtatggggtctggtaacatattgtccagatgcagtgatctgtaaagtttcagttccttgatactacctgggaggcctgatggttggtttcctgagaaaggaactaatcaatagatcggagcaagccaggcctggcttgctcaggtctagtaccagcagtaccaggacgccaaggccgaggagggcgagttcgaggaggaggcggaggaggaggtggactaggctgctcccatcgcttcccaactgtaccctcgaggcttactgaactttgatccgctaagacccccatctctgaaccctagagccccgctttccctccaaggactgaatcccccctgaacctcacaataccttaggagctcgct

SEQ ID NO: 120415 - DNA, 398 bp, Homo sapiens
ttgcagcatgataaggccaggtaggcagagtgcaggagaaggaggactgctatgggatgggagtcagcgagggcttcctggaggaggaggcctggcacatcgtggcaggtaatgcaggggcaagaatagcaaaagccaaggccctggggtggggaggagcctggtatgttcaaggggcagaagggaggctgaagcagagtgatcaagcggacagggcaggcagagcctcaaatcccagactgaggaacatggtgaagaggacacttcgggggtccacacataaagacggagacagagactcagggcaggaaagtcacatgccctgggacaccccagtaaacagagccaaattcaaacctcagcctgtctgcagctgacataggatgaagttgaaggac

SEQ ID NO: 120416 - DNA, 385 bp, Homo sapiens
atggttcattaactcgcttgtttactgtggttacagtgaaagcaaggtcttaggtcagctcctcgtatcgaccagcacattcctttctcttctgtggccatagaatattccatgcagttttgactggctctctcaaaaaaaagtttgccattggtcacaccatggcctgagagaggaaattacatgaccattacaacaacaaaaacaatgcagatcccatttcttgctcagtgatggccccagtgcattcttctcatacatgaaacactgcatgttgcttataaatcaacctagaaaaatgtatgctcgagccctgagattactctgcctgggtgtgaatcccgccccacctcttactagctattgaaccatggcaagttattca

SEQ ID NO: 120417 - DNA, 234 bp, Homo sapiens
gaagtgcaaatccatctgattagctgaagcaccctagggtgtgaacgccggtgacatcagagaccctgtcacctgaggtcccccaccaaccagacacaatgaagggaagaggaaggggaagggggtggcaacagaaggcaaggctagccagaggctgaccactcgctcagctgggcttccccatcctgagagggcctacccaagtccagcttctcagaaaggcgcaccctttct

SEQ ID NO: 120418 - DNA, 367 bp, Homo sapiens
tgggaaccacaagagtgggaaagccagaatgagcagaagcctgtcctccatgagaacacagctgtaaagccccccttggtgctctagcgtcactcccaccctaccctcagatctcctggtcactagactgttcttctggatcacttctttctccagtgaggccagtacctaaagaattgttctgaatgggctgagacagcgaacccacggattcagggacctaaattttctacctgtgaacttccactatttggaaggcctgcagatgaagcctgcctgttaggtgacagtagaggtagagaattctaaacaactgccatggctttgagcaaatcagaggtagcagtgactcctctctcatcccatg

SEQ ID NO: 120419 - DNA, 331 bp, Homo sapiens
cgtctcttgaggttccccttacacccacgatcaccaccgaggcctcgaggcctattagcacacaccctggtgcctctaccactactatcccccattagcacacacactgggcctctctccagccataacccctattagcttgctttggaacttcctcaacaccctacccctgtgatacacccacgggtccctcacccgcgctgctcgcccacctcccgctcccgatccttagctgaactctggccaagtgcttgggctgttttgccttcttcaaccatggtctcaattctggacttggacacaaggccccaccctgtgccacctgctctca

SEQ ID NO: 120420 - DNA, 215 bp, Homo sapiens
gatgtgcaggtttgttacataggtaaacgtgtgcttctatgaagtagttctattattatcttttattattatttttgtttcacagatgagggaagtgaggcttagaaagattaagtaacttgaccaaggtcacataactagtaagtagtagagttgatttcaagcacagactttctgcgtttttatatgactctctcattttgtagttctaaggc

SEQ ID NO: 120421 - DNA, 526 bp, Homo sapiens
ttcggcacgagcggcacaaggaacatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcgcctgtggtcctagctacttggggggctgaggctggaggattgcttgagcccgggaggtcgaggctgcagtgaaccatgttcatgccactgcattccagcttgggtgacagagcaagactccttctctaattaaaaaaaaaaaaaag

SEQ ID NO: 120422 - DNA, 427 bp, Homo sapiens
tgtaattatccaagggaatacatcacctagattcattttgcaggatttcattgtaagttaatcaatgaaagagaatatgttacaatttgcaactcctttgcgagaggagtgcagcctgaggctgtaggttttagcttgcctgatattaatgacattttttattttattcagcttccctttacacacattgtaattagtggtattacccttcctttagcagtaattctttccacattcctatgcagaatttgatgagtccagtgataaacaactgacagcacttagtgggaagagccctgtgcagctgccaactaaatgctcctgtgatcacaggcaactctcagtctttttgaatctcagtgtcctgttagcaaatggggaaaatatgatttctttgtttgtagtcaaggttttcagttgcaaataa

SEQ ID NO: 120423 - DNA, 171 bp, Homo sapiens
aaagttacctgtgtttgcagaataatggactcctaaaatgtttgcaccctagctccagaacctgtgcatttacttttcttggtaaaaacacagtgcaggggtgataaaattaaaatcttaagatgtagatgttattctagattatctgggtgggcccattgtaatcagaag

SEQ ID NO: 120424 - DNA, 460 bp, Homo sapiens
ctacagcgcactctggtatggattaagtagtactttacgttatcaactcatttaatttttcctcccattttacagaggcataaactgaatcacagagaggttaagtcatttctctaaggttataattgttagcgaatagcggaaccaggatttgaacccaagtagtctagctccagtgattgcactcttactaatttaattataccacttcaaaagagcatattatatgaacatagatattctgaacattataagcacacaagtttatacccaaaagattaaagtaattattttagggatcttgagctccgatgtcagcaagctaccaggacatcatgaggctttctgaatgagttccacttctcccaatttccagttttttgatcttacactgagcagataaagtctcatctataaatctgggataaataattcttctccttctctttacatatggtta

SEQ ID NO: 120425 - DNA, 373 bp, Homo sapiens
actgtcatgctctaccactgagtgtgtgactcagttctggccaatgagatgtgagcagcgtgggtcttctaggaagtctccttccagggaattaggcacacctcctttctcccttccacattccttgctgcttggaatgtggatgtgatggctggagctcttgcagccatcttagactatgaggttgagagccacaccctgggagtggtgaattagttggaaggaagcttggttcctgttgacttcttggtgccttagactgcctatccctggacttcttttacatgataggaaatttacgtggggtcaaatttcatcctgactgatacatttggcaaagactcttgtctctcagaacgtgaggatttgggtg

SEQ ID NO: 120426 - DNA, 711 bp, Homo sapiens
tgttggagttgtttatgaaattaaagggcttttgggcagagactgtaaggtttagaatcatattgtctgcaaacagggacagtttttcttcctctctttatatttggatgccttttatttctcttccctgatttatctggcaaggacttccagtactatgttgaataggagtagtgagagagggcatccttatcttgctctggttttcaaggggaatgcttccagattttgcccattcagtatgatgttgactgtgggttttgcatacatggctcttattattttgaagtaagttctatcaatgcctgatatgttgacgatttttaacatgaaaggatgttgaatttcattgaaagccttttctgaatctattgagatgatcctgtggttttcatttttagttcttgttatgtgttgaatcacatttattgatttgcgtatgttgaatctatcttgcttctcaggtataaagcctacctcattatgagggattagctttttgatgtgttcctgaatttggtttccaagtattttgttgtgaatttttgcatctatgctcatcaaatatattgggctaaagtttttgttgttgttgctgttgtttttgtttttctgccagattttcaaatcatgatgacaccagtattatagaaggagtttgggagttctttctcctcagagtttccataggaatggtatcagcttttttat

SEQ ID NO: 120427 - DNA, 145 bp, Homo sapiens
caacagtacaagcatggggtagttccagtggttccaggaacaaaacgaattccttgaagaggttgtgactcatctgcagtcctctgtttcctttccttagatgtaagcagactgagctgcctgggtttgagtcctacctctggtg

SEQ ID NO: 120428 - DNA, 444 bp, Homo sapiens
aagctccatggtgaaccctatctgcagagagaatatgttcttcaaaaggaacctagaaatcattgatttagaactatcaggagtcaaggtgatatatattttttctttgttttctttttttaactcttaagttcaggggtacaagtgcaggtttgttacataggtaaacttgtgtcatgggggtttgttgtacagattatttcatcacccaggtattaagcccagtacccattagttgtttttcctgatcctctcccttctcccaccctccaccctctgataggccccagtgtgtgtcattcccctctatgtgttcaggtgttcttaggatacataattttgcctatttacactctttccgagtctttcacattctctgttagactgaaggacttttaggacagcatatctcttaatgccttctacattgagtcaagagcagta

SEQ ID NO: 120429 - DNA, 406 bp, Homo sapiens
tttcaaaactcctgagatgattctactaagcagcaaaggctgagaatgatggataggggtcctttgcagccatgggaagttaagattttatttcaagtgtcatgaaaaccattggggagttttaagcagtagaggacataattagggggtagtttctggctgctggttgtagaatggattttgtaagagattaagaatgagtgaggagaacagtcagaaaatgtcataattgtccaggttaaaagtgatgttggcttattttatgtgatagtgatggggatgatgagaaatgagaaacaggatggtagatgggattttgggggtagaacagaaaggatttgctgatggatgggaggatatgagcagtgagagagtgagtgaattcaaagatggctccaaggtaacc

SEQ ID NO: 120430 - DNA, 547 bp, Homo sapiens
taagggagggtgacagctgggcatggttgctcatgcctgtaatcccagaactttgggaggcagaggcaggaggatagtttgagcccaggaattcaagaccggcctgggcaacatagtgagactctgtctcaacaaaaaataaaaaattagctgggcatggtggcatgtgcttgcaggccgagctacttgggaggctgaggcaggaggatcatttgagtctgggaggccaatgctgcagtgagccaagatagcaccactgcactcctccttgggtgacacagcaaaaccctgtctcaaaaacaatcaaacaaacacacaacaaaaaataaatgaataattaaaaaaatttaaaaaatgttagaaaggaagggtgaggatgtgagatggcttgttaccagacatggtctttttagaaaagtgtgaacaggccaggcatggtggctcacacctctaattctagcactttgggaggccgagatgggtggatcacgaggtcaggagttcgagaccagcctggccaatatggtgaaaccccgcttctactaaa

SEQ ID NO: 120431 - DNA, 641 bp, Homo sapiens
gggagactggctgagtcttctggtcttcatctttctcccatgctggatgcttcctgcccttgaacattggactgcaagttctttagcttttggacgtttggacttacaccagtggtttgccaggggctctcagaccttctgccacagactgaaggctgcactttcagcttccctacttttgaggtttggaactcggactggctttcttgctccgcagcttgcaggtggcctgttatgggactttaccttgtggatcatggtgatcatggaagcaaatgtcagaagagcaaagcaacgtagaacgctcagccacctcaggaagaaccttgaaaagtcacctggatatatttttgtgaacaagtggtgtcccaggacagattttcagctgaattctacaagaggtgacaaagtagggctggtatcgttgatactgaaactattccaaaaaattgaaaaggaggcactcctgcctaactcattctatgaagccagcatcatcctgataccaaaacctgaccaaggtacaacaaaaaaagaaaacttcaagccaatatctttgatgtacataggtacaaaaatcctcaataaaatactggcaaactaaatccagcagcacatcaaaaagcttattcacctcaatc

SEQ ID NO: 120432 - DNA, 709 bp, Homo sapiens
agaggctggccctcctgatctgcacccaggcggcttctacaccaccctgcagcaggcctggccaccggcctcagcgcttctgggagaaggtcagccaggtggaagatggagagggcttctggactgagccctggaggggggctaggggccaccagcaggcagatgagccctgggacccagctggccaacccacctgaccacggtgacaaggactgcttgggaaggataagcccaggttcgggaaagcaaattcaggctgcaggacagctgcccgggccccccacaagcctggcaccagcccagggaagactgaggagcctcactccatggggactgcaaacacctgaacacagcgaacctgaaggtatagggcatcttcaggctgctactgaggcggtcctgccgcactcaacccagaacctcatcactaaaaggaacctcatggttcaggctagagtgcagtggcgcgatctcggctcactgaaacctccgcctcccaggttcaagcaattctcctgcttcagcctcccaagtagctaggagtacaggtaagtgccaccacgcctggctattttttttttttttttaatttttatttttagtagagatggggtttcaccatgttggccaggctgatctcgaactcctgacctcaggtgatccacctgccttggcctcccaaaatgctgggattataagcgtgagccac

SEQ ID NO: 120433 - DNA, 348 bp, Homo sapiens
gtctcttccaagattattgcgtcagcaaaggaagataggctagtctgctcaatacacatcacaacattatagagcttgtcaaaaacaaacaaacaaacaaaacctttctactctgttccttgcaatgatcttccatatttccccaaaaaacctttccccccatcatctccaaaacaagaaacttccagtcacaaaagtctaaattcaaaaggataaagtatttttaataatagagtaaaaaaacgggtcaggagtggtggctcatggctgtaatcccagcactttgggaggccaaggcgggcagatcacaaggtcaagagtttgagaccagcctggccaatatggtga

SEQ ID NO: 120434 - DNA, 514 bp, Homo sapiens
caaaatacaggcattatgcagttgagttgtgttaagtgtggactgtaaaacaggatagtatttgttataaaatatgtttttgtatgtgtttaatatatagcttcaaaaggacatgtatgaagaaagatgtctcagcacataggtagttataaaccaagggtttgagagactgactttagaatctagaatgagtaagaaagtgatggatctgtacattcatttgtattgaagtttgattttgctttcagtttcgttaattaagccccgggaatcagggacctttcctggcaccctctacagtgttagtggcctttgtggtaaaagaagttatctcagatactcatttcatgcaattacaggcaaactggaaggcaccttaatggtatgcaagatgtgaaatgaattactatgttgcattccactctgcccccactcatgtacaattatactttgtttaaaagtgcatagtttcagtggtatttattagctagcaaataaaactttaaataaataa

SEQ ID NO: 120435 - DNA, 143 bp, Homo sapiens
gacagtgcaagacttggctctttaatggctttcaaataatgagtttgtttcctagcatcctgagaggtttttttttaaaattgatttttaaaaaagtatcattatggggccgagcttggtgatttacacctgtaatctcagca

SEQ ID NO: 120436 - DNA, 591 bp, Homo sapiens
aggatgggtttactggggcctaacccattgtaagttgaggggcatctctgttactaagtgtaaaatgttatgactgattcttcttgattgttctccatctctcaattggaaagtatatgctgtttattattttagactgttactagaaacttgatttgtaagcatcctgagtatgttagaaatcatttccatatattctttgattacctttatatagtagttatatttatgtgaggcattgtggcatttagaaggcaaattacatagtattttttacatagcgtaaattctgagtaatttacactactgacactctgttgtaggttgcacaactatgtttgctttatgagtccacctttatgagtggatagaattgtttcccacataatccacctttatgagtggatagaatagtttcccatgaaaacattttaatatgttttttatgttttctaaatataaaatcataattctgtaggatttttataactcatagtttaaaaaagcagctcatcaaaattgtgctgctttataaataagattatctgattaattgtaggtacgtggattctgtttgaaggtaacatttgt

SEQ ID NO: 120437 - DNA, 333 bp, Homo sapiens
ccttgctgtttaaacaaacaaaccaggccaggacacggtggctcatacctgtagccccagctacttggggggttgaagtgggaagatcgcttgagcctgggaggttgaggctgcagtgagctgtgactgcaccactgcactgcagcctgggtgactgagtaagaccctgtctcagaaagaaaaaaaaaaaaaaaaaaaaaaaacccggtggggggggggaaaccagggggggggcttcaatttttgaccccagtgctttttttgcccaaagggggggggcttttctacttttaaaaaatttcccattaactctttccttgccttgaggggggt

SEQ ID NO: 120438 - DNA, 474 bp, Homo sapiens
accaaactcagaggtctatacagagtaaaatttctttcagataaaaatctagaaatggtaaaactcaagtggcaaaatgcaaatgagtgatcctcagatctgggcctaggaggaaggggcggactgcaaagggcagaagagtacatagggtgaggagaaccttctctatcaggattgtggtagtggttacatgctgtttatatttgtcagcactcatcaaattatacactggaaattggggatcatcctatttgtattatactgcactaaatttgtttaaggaaaataataatacacaccaaaaatattcacggctcaagaagtaatatacttcctgccgggtgcagtggctcaggcctgtaatcccagcactttgggaggccgaggcaggtagatcacctgagatcaggagttcaagactagcttggccaacatggcgaaaccccgtccctactaaaaaggcaaaaattagct

SEQ ID NO: 120439 - DNA, 356 bp, Homo sapiens
gatgggaccttagctccttctttgcttgtgtctggcagcagcaaaggatgaatagaggaaagccaggcagcaggtccactgctcacaggaatcctggacaaccccatgtaaatcctcgagtgtgattcaggcatttctcctggtgtggggagaatctacggagaagggcaggggatgcctggcattgttttcattttcaaatgtgacagagaatcccgtggaggcaggagatggacaggtgctgcctgtccatgatttcagggctgggtggaggccgggcaacacgtcaacattcttttctgttcttgggcattaattattgctgtctttttttaaaaaaaaaaagtttaaataaa

SEQ ID NO: 120440 - DNA, 371 bp, Homo sapiens
cttgaactactgacctcaggtgatacacccatctcagcctcccgaagtgctgggattacagatgtgagccacgacacccggcctggtcattctttttacttttctagcttggtgatttccctcttctgtaaagcgagggagatagaatcaatcactaaggtaccttttttctagaatcctatgcatctgtgctttttgaataaaagcagaggatcatatttccctggccatttcttctgaaacagccactataatatttaagtttgtaggctcagtctcagaatacaccgttaaggctgaaataaagacctttttttttttttttcgaaaagtcttttaatacatgaaacacctactaaaacaaatgaatt

SEQ ID NO: 120441 - DNA, 228 bp, Homo sapiens
tgctgggccagcccaggagatttcattcctttcctattattgtccaatttttcctctgcctagatagccaataaaatctacatcacaaagtggttctgccctgtgtaactggcttttttttgaaggagttttgttcttgttgcctgggctggagtgcagtggcaggatctcggctcactgcaacctccatctcctgggttcaagctattctcctgcctcagcctcacg

SEQ ID NO: 120442 - DNA, 341 bp, Homo sapiens
aagagaaaatggacacctttgtctatgactggtgggcaggacaacagacaaccttggtagtgggaattcatcaggaccgcctgcacttccccccattgggtttaacagccttataaagatataatccacataccaacaagtcacccacttacaatgtacaattcaacggcttctcgtatattcacagttgttcaaccatcaccacaaacaattttagcacatttttatcaccccaatcttcccattccccaagacccaggaaaccactcatctattttctgtctatgtatttgcttattctggacatttcctatgagtgaaatcacctagtgtgtggcctg

SEQ ID NO: 120443 - DNA, 633 bp, Homo sapiens
tgtatcataaacaagagaatgtaatacatatatgtattttttaaagaataagtaaacaaaggtgtatacatgtggatattcacctgtcaagcttgagtaacaaatatcactggcatgttaaaagctccctgtgtgctccttcctggctgaaatctctctcccccacatttgtgttaaccattaccttgcttttctttatactttctccacttcctgtataggttcctaagcaatatatggttctgaaaaacagagtagcaagcccaagccttgttatgtggggaaagggtaatgttgctatcttagataaaacctttcagaagataaactatactgtctctgggtcccaacctggttttaggttcccttctggggaagtcaaagggcaaggttataaacgagccctgtgacttctgccaggctatgctttaggctagttattatttatttatttatttttgagatggaatcttgctgtgttgcccaggccggagtgcagtggtgcgatgttggctcactgcaacctctgtctcccgagttcaagcgattttcttgcttcagcctccccaagtagcagggattacaggtgtgtgccaccacacccagctaatttttttttaatttttagtagag

SEQ ID NO: 120444 - DNA, 577 bp, Homo sapiens
agaatgctagtaggatgtgcaagccacactgagcaggtttcctttctgctattttattttttagggctctacaattgggctgacaaaataattttagactacgtaagaactcaagaaaacaaatgactttcatggcttgaagctcctgcgtagacccaaagagctttcaactgattcctacactttgacaactatgcctgcactctagcgtagggatcctacaaactaatgtctggcatgttggaaaaagtaactggacagtgatgtaacctcatctcaaaccagaaacctgcatgcaaaaacctcacagaggggagatggccaactcttcatttagtgatgccttcagacagacctgcatgggatatctctgattgttctctcagggattctagtcaatacattaggaaactttaaaattactttagaagtggcaattactgaagcatcattaaaaatgcattgagccacatgtgtaagaaaaactgcacccgctggcctactgctattctaaatggctttgttactcatacttttggggtacaaccaggctgacgctgcctgaaagagcactgca

SEQ ID NO: 120445 - DNA, 884 bp, Homo sapiens
tacatgaagactaatgttttaatgaatgataagatagttagggctcggcatggtggtggcccatgcctgtaatcccagcactttgggaggctgaggcaatggatcacttgaggccgggagttcgagaccagccctgccaacatggccaaactctgtttctactaaaaggtacaaaaattaactgggcatggtggtacctgcctgtaattccagctacttgggaggctgaggcacgagaatcacttgagcctgggaggcagaggttgcagtgagctcagatcacaccactgcactccaccctgggcaacagagtgagaatctgtctcaaaaaataaaaactaaaaaaaaaaggatagaaacacagagatcatggagttgatttctttcattatgaatttgaacaaactaaagccaaggaagttcaagtaactttctcaaggttacatatccttgaaaagagctacatctaaaatccagttcttctaaaacccagtccagtgtgctcagttattacatataatgaagtccttcacttttgcgcttccttaccccctgttatctggcagctgagtacctacctactcattcgtcatgcaagatataccttaaattcttatttctttatggtattttctgcatcctgcttttgttggactttgtatttatgttacagcaataataagatttttccctgcatatttgcttatatgtctgtctcccctagcagagtcatggttttggtctgggaacttacacatttttaaaaatccgtatcatttagcacagttcttgtcccagtgtaggtactcaataaacaggtaacctgaaagagttgttgtagtgagaatgctaccagatgaatgggtattctttaaagtattttc

SEQ ID NO: 120446 - DNA, 292 bp, Homo sapiens
caagcagaaggaaaattaaaccacatggaaacttggccacaaggagtttagagtactggaagtggtaactatctgggcaaatatataggatttaaaaaaaattattatttgaatatctttaaaagacaaatgactgtttaatataaaaatgatgacagttgccaggtgtggtggctcgtgcctgtaatcccagcactttcggaggccaaggcaggcagattgcttcagcccaggagtttgagaccagcctgggcaacatggtgaaatcctgtctctccaaaaaaaaaaaaaa

SEQ ID NO: 120447 - DNA, 460 bp, Homo sapiens
catccaggccacaccgatgcaagcggtgggctcccaaggccttgggcagctccaccactgtggctctgcagcatacatcccctgcagctgctttcatgggctggtgttgaatggctgtggcttttccagggcatagtgcaagctatcagtggatctatcattctgggatctggaggacagtggcccttttcttacagctccattagtcagtgctctagtggggactttgtgtgggggctccaactccacatttcccccccacactaccctagtagaggttctcaatgagggctctatttccacagcagacttctgcctggacatccagacatttccgtgcatcctctgaaatctatgcagagactcccaaaccttgattcttgccttctgtgcacccacaggcccaacaccacatggaagccaccaaaacttggggcttacaccctctgaagcaatggcc

SEQ ID NO: 120448 - DNA, 618 bp, Homo sapiens
aggcctcgtagacctttatagaggcaggcaggcaggcaagagctgggggcttcatcggatgagcaggggaccacgtactacgggcggccccaggagttggtttgaggtggaaggctgaggactgcaggattctaaatagtatggggattgtgtggggagtgaggcattagctgcttgggcccttagtccagccttgttggtggctgctgcagctctttggctcactcactctgtccttcgtgcctcagtttccctttgcataatgagatacggtggcagagaagaacgccagtgccacatccatgactgatagcttgaggacggagatgaactggagggtagaaaaagaggatgcctgagaaatttatacctaccaggtcacatcttcgaatcccaggaagttatccctggattcatttctgcctttgatgcaagtctgtggttcttttcagtacactttgtgtgatattgattgtatgtatcaatacttgacttgctgagtggttaaagtgttttggtttgtgggaggcatagtccttgttgtcttggtcagttaattttcagttaatctcccaatagccattgcttcgcctactcttcaattgggagattagttga

SEQ ID NO: 120449 - DNA, 449 bp, Homo sapiens
attcttcatgttttgtagagacagagtttcacatatgttgccctgactggtctcaaactcctgggctcaagcaatcctcccacctcgtcctcccaaagtgttgggattacaagcgtcagccaccatgcctgccccaacagtagattcttaacatatgtcaatcgttttcactttcccagcagcaagaaatacaagcaagcatgtgtatgatcagagaggcacaaaaatcccaggccagggtagtgaagagggctttgcccagaggaagtttctggcttttatttccgacattctttgagattttctgtgtcacacagagtagaatttcccacttggcatctccttgataaggtaggtttgtatttcttgaaccagttacctaaaattttcgagactgagttttttcatctataaaatgggaacaactacttcacagggtgttatgagaa

SEQ ID NO: 120450 - DNA, 404 bp, Homo sapiens
tgaaacaccacaaatgagaattaggaaaacttagtaatgaggaaatcacactcaagaattagaaacaaaggaaaatcattctggaaatgactttactagaaggcacacgagggagataaactcaaaggcagctacacatggcataacatctcagccaatgatagtccgcgtaagtgacagcagtcccacaggattgcaaaagtgcattttcactgccccttttctatgcttcagtgtgtttggatacacaaatcctcaccaccgtgttacggttgcctactgtcttcagtacagtcacacgctgtccaggtttgtatccccggagccatgggctgtgccatactgctaggcgtgcaataggctatgccacccaggtttgcaaacatgggtggcatcgataaaca

SEQ ID NO: 120451 - DNA, 557 bp, Homo sapiens
agtgtgagactccgtctcaaaaaaaaaaaaaaaggaaaaagaaaaaaaaaatttctttttcaccaagcaaatgctaaaatgtttaagaataaataagtaggaataaaagaaaaccgaaagaaatatcacttccctgcttcatttctctgaaatgtggtcactactatgcacctctaactattgtctttcactttgctctatccacataggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctcca

SEQ ID NO: 120452 - DNA, 523 bp, Homo sapiens
agggtggggacagcaaagttgaaggcagtgtttagagatatggaggagaaccttgcagaggaaactgaaaaaaagcaactggggtggaaggtgaaaagccagaagagtgtgatgttgtggaaggcaactgtattagtctgttctcatacaactaataaagacatacccaagactgggtaatttataaaggaaagaggtttaactgactcacagttctgcatggttggggaggcctcacagtcatggcagaagatgaaggaaaatctaaggcacttcttacatggcagtgggcaggagcgagcttgtgcagaggaactcccatttataaaaccatcagatctcatgagacttattcactaccatgagaacagcacgggaaagacccacccccatgattcagttacctcctgctgggtccctaccatgacacatgggaattatgggagctacaattccagatgagatttgggtggggacacagccaaaccatatcagcaacacaagatatgtgtggatgctgccg

SEQ ID NO: 120453 - DNA, 305 bp, Homo sapiens
tggtcttcaactcctgacctcaagtgatccgcctacctcagcctcccaaagtcctgggattacagcttgattatgaagaggacattagacaaacgccagtgaagaagcatcctacaaaatactcgaccagagctcctcaaaactgttatgctcatcaaaaacgtctgagaaactgtcccacccgaaaggacactgaggagatatgacaactacatgtaatatggtatctgggtaagattctgcaacagaagaaggatattcggtaaaaataaggaaatctgaataaactatggatgttggttaat

SEQ ID NO: 120454 - DNA, 1018 bp, Homo sapiens
cagagaggcacagggctgagcaggtgaagggagtacaccgctgtggtttgacctgctcaatatcccttcttcctgaaacagaatctatcttttcttcttggggagccacccctccactacttttagcccttggcttaggttcttcttttaagactcagttctaccaggaggtaacctctggtaaattctcaaatcctagtgccagggttaggcatgcgatcaaggcaatatatccaagaagcggtatgggaggcaatttgagccaatgagatgcaactcaatacctggagcccctgggccagagacttggagtttgtatatctgcaattgttggggttttgccttctctccaagaaagcctgagtgaggatgaagacaacaggataaagcagaaacgagagggagagatggattcctcctgacaccatttgagctcctccttctccagctgagcgtgagctagccctgcattttcccgttgcgtgggctcgtaaattctctttgtgcttgagtgggtttgaggtgggcatctttcacctaaatacaatggcaaactgagagggtaccttctgttatctcttcaccagcagagtggaaaagcaacagagtcctccttgtgacctgaattatagatttcacagctcttttcaagggttagcctctgtgttgacttttggtcttcccaactcaggtgcttgatttaagctctagtctgaaattaattccacattttgtaaaataaggaggaaacaggagctggtgaggaagcatcaacattttacaataagatcgatttatataaaatttgctaaacatctgccagtgtatccactgccgagcctggattatcatctccagcatggagtactgtctttttcttaactgcatgggagccattctgagaaacagtaggaaataactttgttaaaagatggagaagagtcatctggacaatggaaattagtattctattacctttcaagtttgatgagtatgggtttggggtttagtaagtagt

SEQ ID NO: 120455 - DNA, 493 bp, Homo sapiens
aactagcagtgtgattttgggcaattcatgtaaaagctctaggtctcattttctgtatctgcaaaattgtttttaaatatgctttagcactagaagacttttcctcaaataaaaatttcaaaagagtcccatatataaaaaagataaaagcaataatgaggttctcattctactcaattcttcagtgaagaaaatgcccctagaagtaccttcttagagcagggtatgatttgaaaacactaaactagctgacccacagaagttgaatctagcactaatattctatgatttatccatttaataaatactcattaaatgtatactctgtacctggtactgaactaggcactgcacattcagcaataaacaaagcagatgggctccctgagatatttatgctaacatgtagtattcagcccattattaaatattcacttaaaatgaacaaaaaaagattaaaacaccacctctggtccttttatagagtatagaa

SEQ ID NO: 120456 - DNA, 549 bp, Homo sapiens
ttaatcaaataattgtactgctgtttatgtagtttataactgaaatggatactgtgaaagaaaggaataatgtactgtgcgagaataaggcaaaggaccctgatgggctggggaagacattattgaggaaatgctatttgagctgttggtcaactagttgaaagaggttgaaggggccacaggggaaggtgttagagagagagagattattccagacagagtagacattactgtgtaaagtccccatgacagaagggattatggaatgtttaaggaactaaaagaaaggcagtgtggcctaagcactgaaagcagtggtataaaacataactggagaggtatccagaggccagaccaagcagagccttataagccatgttacagattttagtttttatcccaagaatgataggatactgcttaagggttttaagctggaagggaaatctgattgcagggtgaacttactagataaggacaaagtagatgcagggagatcagttaggagattgttgcagtggtttacgcgataattgatgatagctcaga

SEQ ID NO: 120457 - DNA, 572 bp, Homo sapiens
tgtgtgaacaagtgccatacaacagattgagcctcgtataaaggcctgagactgtgcaagggttccccgctgggcctcagctgtgcttgcaattagcaataggcacggagtgattattgttggggtagcggatggcaatgcgaagtgacaagttttatgggggaagttgggagtggggatgctctgcaagtttctctttctttcttttttctttccttttttcttgttctgcaaaatacccttccttgggaggctgcaacctcctgtttcagtgaaagctatttttctttttccctcgtcattcaaaagagtcttaacaaaattgtttgaaagaatatttttctcagtgcttcagaatgcgggttttctaggtcagagcttccttgctgccctatttaatgtcagaaatacccatttgcctcaaattagcagagagcttggagttgagggcaggagattaagcacacaaaattactcagcaggtgacggtggggtggatttgggggttgagaagtctttaaaactgactacaagacattatatacttctgacaaaagaacatagtaatccta

SEQ ID NO: 120458 - DNA, 129 bp, Homo sapiens
gagggcctcctgggtggggggcgggacgccgggtccctaggggctggtggtcactcagggtggggcgtgtcgcccctcccccgtccacctgctctactcttcccccgcgtgccctgggctgacccttgt

SEQ ID NO: 120459 - DNA, 837 bp, Homo sapiens
aatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccaccgcgcccggcagttgagcttattttcatattttcctgcagaatagtcttgttctttctcttcaagagtgtgtcttagctatttttttgccctttggtctttcatattccagagaatatattaaatatcccaagcaggcatggtggttcacacctataatcccagcactttgggaggctgaggtgggaggagtgcacaaggcgaggagtttgagactagcctttgcaacatagctagactccatttctacaaaaaatacaaaaattagccaggtgtggtggcacatgcctgtagtcccagcactagggcggctgagacgcaagactttgtttgaacccgggaggcagaggttgcagtgagccaagatgggcgccactgcattccagccctgggcaacaagagcaagaacctgtcttgtctccaaaaacaaaaaacaaaaccattatattgctagctactttaagaatttctgattctgttactggagctgacttgtggtaaccatttatatttccg

SEQ ID NO: 120460 - DNA, 339 bp, Homo sapiens
gtttattaaagttgttaagaataaagcctactttaagagataccaagtgaaatttagaagacgacgagagggtaaaactggttactatcctcagaaatgcttggtgatacaggataaaaataaatacaacacacccaaatataagatgatagttcgtgtaacaaacagagatatcatttgtcagactgcttatgcccgtatagagggggatatagtctgcgcagcatatgcacacaaactgccaaaatgtggtgtgaaggttggcctgacaaattatgctgcaacttattgtactggcctgctgctggcccgcaggcttcccaataggtttggcatgga

SEQ ID NO: 120461 - DNA, 309 bp, Homo sapiens
taagtggcagggggttgagaattcaggctctgagttaagtctgattcctcatttaccagccatgcgaccttgggatattacttaatcatgaagcctcatgtctttatctttaaaatgagaataccttctaagattgttggaaggattgggataattgaaattatgaatctaaagcacttagtattagagcactagggggtgctttaaaaatagtcatgcccaggctccaccttggaccaactgaattagaaattctgaggtcagggtctggcattgactgattgttgttgttgttgtttttaaatattt

SEQ ID NO: 120462 - DNA, 204 bp, Homo sapiens
tgcctcagccttctaagtatctgtgattatagatgcccaccatcatgcacagctaatttttgtatttttagtagaaacggggtttcaccatgttggccaggctagtctccaactcctgacctcaggtgatccgctttcctcggcctctgaaacttccaggattataggtgcgagccaccatgcctggcccttccatgacttcta

SEQ ID NO: 120463 - DNA, 345 bp, Homo sapiens
gttttcctgtccagctcaccaccactggactttcttccctgtatgtaagctgccaatcaaaccccacctctcatttgctggctctgggtctcttcttcagccccttgaacctggtgccttccctattgaggtgaataggagttcggcacaatagcactccagaacaactctgctgctccatacagcttcacaatggaaaggaaatccagaaatcagtgcattgcgtctttccagtgtgctatggtcaaagagcactacagcaggaatagagaggagagacattacgtctgcggctcacattatgtttaatcttcatttaatctttgcaacaaccctagtaagaga

SEQ ID NO: 120464 - DNA, 254 bp, Homo sapiens
  misc_feature (38)..(38): n is a, c, g, or t
gagacaaagtctcactctgttgcccaaaagctggagtncagtggcgtgatcacagcttactacaacctgcacccccctggatccagtgatcctcccacctcagctccccaagtagctagtgggcgccaccatgctcagctaattactttttgtagagatggggatcgtgctgtgtcgaccaggctcaagcagttctcccaccttggcctagttctaaagcacagggtgggccactgcacctggcgcggatgggt

SEQ ID NO: 120465 - DNA, 301 bp, Homo sapiens
tcagacacgctgagactgaagtacgtactgcacaagcagtgggcatcaggcaacgtcagtctaaagttcagcaaacaggtcatttgctcacgtgggcattcattcagtcactcattcaactacttcctgaggccgggcgcagtggctcatgcctgtctgtaatcccagcaatctgggagccaaaggcggccagatcacttgcagtcaggacttcgagaccagcctggccaaatggtgaaaccccatctctactaaaaatacaaaaattacccagacgtgcttgcttgaacccaggaggtgg

SEQ ID NO: 120466 - DNA, 509 bp, Homo sapiens
aatggagttatactggagtcaagttcctgtattttactaaaattagtattaatctgaagtagatcctgataaattaaaatgcatattgtaatccctggagcaaacactaacaaaataactttaaaatatacacttaaaaagaaaaagggaatttaaatgctacactagaaaatacttaatacaaaagaaggtagtaaaagatgaacagaagaacaaaaaggcataaaacatagaaaacaaattgtgaactgatagatggaaatccaaccacagcaataataacattgaatgggaatagaatgaacatgccaatcaaaaggcagagatcgttagactggattttttttttaagctttgactatatgctgcctgtgagagacatacatactttagaaacaaagatacaaataggtcaaagcaaaaggatagtagatttgctatgcaaacaaccgtaagggagcttgaggagaaatgctaacgtcagactaaataatttttttgtttttttg

SEQ ID NO: 120467 - DNA, 657 bp, Homo sapiens
aatcaattttagaacatttctatcaccctacagacaaatcccatacccattgtcagtcacttccccgtttcactgcaaatctgtcagtcctatgcaaccagttttgcctatatgggtttgcctgttctggaaacctcatataaatggaatcataacgatatatggtcttttgtgactggcttttacttagcataatgttttcaaagttcaactgtgttgtaccatgtaatagtacttcaggtactaataaatgattattattcatttattgctgaatattccatcatatggctataccacattttactcaattgatgggcattttggtggttctactttttggctattatgaataatattgctattaaaatttatttacaagtgtttgtttggacatatacttctatttctcttgggtataaacctaggagtgaaattgctgtgtcatatgcacactatgtttaactttttgaggagctacgtaaactgttttccaaagcaactgtaccattttacatttctgtttgtagcatctcaaaaaaagaaattataaacagctattttaaagagatgcaaattatgctaagtgaaaaaagccagacttaaaggctgtgtaaggcatgattctatttatataacattatacaaaagaaaatt

SEQ ID NO: 120468 - DNA, 331 bp, Homo sapiens
taagacaggccccaactagtacacacgcagatccatgcacacccacacacatgcacatgcagacttattgtcatagcttgtatctcttatggacaagatgcagagtgagtgagccagcagatggacaccctggaggttcggagccatgtcactccctatcagccctctccaaacatccaggcaggatctgggagggactgcccttgagatgggtgggctccatgaatttccagctgaagcaacacgtttctgtccccaagggatgaagaagtttcttcagctgctctgtagatatgtcatgtcgagattgaattcaggtatagttttagct

SEQ ID NO: 120469 - DNA, 244 bp, Homo sapiens
cttcattgattgactcattcaacacatagttatggggcacctactgcatgtgagacactgttctaggcactgaggacacagcaatgagcaaaacacaaaataacatatctgcccacgggcacggtggctcacgcctgtaatcccagcacttcgggaggctgaggcgggcggattacttgaggtcaggagtttgagaccaacctggccaacatggcaaaaccccgtctctactaaaagtacaaaa

SEQ ID NO: 120470 - DNA, 733 bp, Homo sapiens
cacatcttcaaggattcacttttactctctgttgtaaattttctatcccagcgatgtcccaccacttttatataatagtagaatggcttatctattctgtagtagcacaaaagagttggaagacatagaaacaccagatgcattttctctatatcttttggaacagaaaaagtagacaaaatgttaaattttttctttgaaatccatatgactctgcttcaaagaatcaccatttccaagagagaaaattcatgattgcgttacaagcattcagacagaaacactttatgttgtcaaaagctgcatttcaactaccaatatcatcacagtgactgcagtgtcctgttactttcgcatgactaaatcatacaacgaagcaatgatttttaattcttttaattctttttattttttgtaattgattagcccaaaaactctacataaccatatcaaggatgtagatgtggccattcaatgtgacgtgagccttttaataaacatgttttcagtttgcagagttagaaaagtattggctgtgttaaacacttaaccttacactggctaagaaatgccttattagtctttaatttactagtcagattatctgataggatgtctcaggagatggcatgattttcacaaatagtctacaatgtgttgttaactttttcatccttatagcttttctaaagcctatcaacagttttcttttctctctttctcttttttgcag

SEQ ID NO: 120471 - DNA, 196 bp, Homo sapiens
atgtggatgatctagaggagcttatgtgctgatagcctccaccaagtcactgatatcctaagacctacctacccagtggaatagggctttgatctcaggccacttctcccaccagtatggtttccctgggggaagcccctcctctggcagggtcaggttcatttcatgggctctgtgggaagtgagagtgcaggga

SEQ ID NO: 120472 - DNA, 1246 bp, Homo sapiens
tacataaatgtaattatacattttgtacacataaactgctggcgggaatgtcaaaaggtacaattaacttgaaaaagacttttagcagttccttaaaaatttaaatatacacttatcatatgatttagccatcccagtcctaggtatttgcccaagagaaatgaaagcttatgtccacataaagacttgtaaatgaatgctcatagcagctttacataatagcccaaaactggaaccaacaaatgtccatcaacaggtgaatggtataaacaaactgttatattctataccatgcagcactactcagcgataaaaaataatgaatgattgatacataaaacaacatggaagaacctcaaagaagccagggcatctgggtctggagatttcttttatcaggagattttaaattatgaatttaattctttaatggttataggatattcagattatttcatcttggttgagttttaatagtttgtggttttcaagaatcagattatttcttctaagttgtcatgtgtataagccgaaagttacagtatttcctcattatctttttaatgactgcctgatttatagtgatactcttcatttcattcttgataataatgatttgtgttttttctttttgtcagtctttctacaggtttatggattttcttgattgttttttgaagaaccagttttttgtttatgtatttttctatttgcagtttcattgatttctgcttttggttatttcctttcttttgcctgctttgggcttattttgctattctttttcttgtttcttgtggtgggaacttaggttattgtgctgagacctttcctcatttctaatatgctatcttcctaggtattccctgggatgtaggagacagctcttggagacacatggggttggctatctggcttttggagagactttgtctaccacaagaatagagtaaaagcagactctttcaggaagggaagaggatggctgcctctttcatctttataagtagggaaaattaattttccctgtcccttgcctatgcagtatttggccacttacatagccaaaatcccatgagtttcttatcaggttgctctgggggatatggacgagtgcaaaggtgggcaggtgcacttgtttaccctgagtaataagaaatctatctctgactctgaacatcttatgtgcatactcaagataagaaaaataaagatgaatattaaaaagcaaactttttatgagtgg

SEQ ID NO: 120473 - DNA, 268 bp, Homo sapiens
acacaagagatacccactcgacagaattaaatccgcacacaagagatcacgcactcaacaggacccatgcgcagacactctgcgtcactcggagacacgcaaggacgcacacttgcgcgagcaaggctctaggcgggggtcgcaattgcagaaggcgcggccacgcgcgctaggggacgcgcagcccacagacaggggcagtaacacaaaggggggccacctgcaaggccgagagcgcccacgcagccgccagggagcgcggacaccg

SEQ ID NO: 120474 - DNA, 808 bp, Homo sapiens
cccgtgtccaagtgtccaagccatgcctctggagttgagtgccacctcctacctcaccttgttgaatagaaaatgaatgagtgacagtatgaatgaatggacacctgttaaaagagccatctattacagctaaatgaatgaagggcatagacagtcctttggttgtttttccaactagaaatctctccctgtgttctgtgatggcctaagtctggccctgctcaagtgagggacttcctcgatgggctggtctcattcttgtgccctccaggacagcagggcagagggagagggaaatgggaggggctgagggacaacgtggctcttctgggagcctctttaccctgtgaaatttcctctggcagctttcccccttggcctgcagcctgtgccggcccctgcccccaactcattggctttggttacagggacaggcccagagtcaagaacaataaagggaggaggggcctgcttcacagggtcaggggtcagggagggggtttgaagggtgaggagattggctctgtgtagcatccggtttcaaacaactctgtttagaaatagaagagaagccctccggaaaatggaagggctctggcaggcctcccagctggccaaggaacagcaagttcctgccaatatgtgacggaagtgggggatttgtggggagggaggagggaagagggcactggagggagtagacacaacctagcaacattttccctgctaaaaaccttgctctgaagtaaacatggagggttcttattcttcctggctgtgtgcactcgggccagcctacttcctgtgg

SEQ ID NO: 120475 - DNA, 356 bp, Homo sapiens
aaaaaaccctgattaaatcaaatgtaggggccctaagacattctgcgggttattctaaatcacccccttacttttccagagaagaaaattaggccagggaggcccagtgacttgcccaaagtccccgcctgtgactggatgcagttcctaggaagcacggcctccttctgagcaacagaaaagcaggaagcctcaccagggagctttctcacccattcaccggcacgctccagcctcttcctgaccttcttacctgtgacatgacggcagggtctggagtcagtgcaagctgtctgggtgataccagtccacacagtccccaggcaacacacactgctctccaacacctgcagcac

SEQ ID NO: 120476 - DNA, 291 bp, Homo sapiens
gcacgagggaaataattgacaaaagatttcactggtctagcaagatatttgaatatctagatacaaaaggcccaacaaatactaggaaaatacattgcaagatgaaattcaccattacatgtagtcatcagactttctaaagtcaaagtgaaagaagaaaaaccttaaaatcagcaagagaaaaacatttagtccctgtaaaggaaaccaaattaggcttacattgtgattctcagcagaagccttagaaaccagaagagatttgtgccctattttcaaggtgcttaagga

SEQ ID NO: 120477 - DNA, 371 bp, Homo sapiens
gacattcctgtgtcttttcattcttataacccagtgccaggcacaggacctggtgcataggtggtgctcagaagtacctgttacaggaggctgggcacggtggctcacgtctgtaatccaaccactttgggaggccgaggcgggtggatcagctgaggttaggagttcgagaccagcctgggccaacatggcgaaactccgtctctactaaaaatacaaaaattagccaggcgtggtagtgcatgcctgtaatcccagctgctcgagagactgaggcaggagaatggcttgaacccagaaggcgaaggttgcagtgagcctagatcatgccactatactccagcctgggcgacagagtgagactctatctc

SEQ ID NO: 120478 - DNA, 515 bp, Homo sapiens
tccccagtgaaagcagagttgtgtatcctctggtttgtttctcaggagatgtgttttaactaagttaataataataataacaacagctttattgataaatagttcacataccctataatttacccatttaaggtatacaattcagtggtttttaatatagtcacagatatgtgcaaccatccctatggcttatattagagcattttcatcatctcaaaaagaaaccccatacacattagcagtcaatccccatttttccttcccccaatcactggcaaccactaatctattgtttttttctttttcactcaaacagatttctgacagatccactttctatgtctatagctttccctgttctggacagtggatatcaatggaattatacaataatgcggtcttttgtgacttaattctttcacttagcataaactaaggaaatttttttaagtttgtctttgaagccagatggctgagtttgaatcctggctccacatcctactccacttacctaa

SEQ ID NO: 120479 - DNA, 314 bp, Homo sapiens
tttgttaaaatattttatatccttctaatttattgtgcttgttctgatgattactgagaggggtgtatgttaaaatcccacatcatggttgtagatttatgtatttttccttgatttcttcttaactgcctttccccttccttaccctccctcttgtgtctgtctctctctccactccctgatatgttattagatgtatacagacatccagcttttttataactcaatattttatatttaatgttcctctttatctccggcaatacttttttttctctaaaagtctgtttcatttgaatattaatgaaacctac

SEQ ID NO: 120480 - DNA, 475 bp, Homo sapiens
ggtcaggcttaaagaggtcggggtggggggtagaagctgaaggcccctccactgcatccccttctgtaacaacaagctctggggatcagagagcaccatagagcttcaggttcccggaatcatcaacacaggcccaggagggccctggagagcatctaaccctgaatctctgtctcccatggcccctcagggaacaataacatcttcctcataggattgtggtggggccagatgggataattcacttaaagtacctggcagatagtaagcactcaatctgtgctgttatccattatccccattcgactgtaggttccaggcagggaaagcctgtatgtctctttgttcattcccctagctgttgtatttgttgaatgaatgaatgaatgaatgaatgaacaaatgaaccccacactctcagatgacccttgctaagaatgatgtggaaggggcgaatctgataggcctgagtgtt

SEQ ID NO: 120481 - DNA, 296 bp, Homo sapiens
aacatttgtatttattatttcaaagtccactcaaacaaaagtttaacatgcaaggttagaggtaaaattaagctcactatctgtattaggcatcattttaaatgaaggtaaactaaaataattcaaattagtttccatcattcagagtgcaacaccaccccaccccaaaaaaacccgcagcaagagaacagggttatattatgaaaggaagccctcaagctcagtaaaatgtcatctttgtgctcactctggaatggctgacagtggtagctgcagaaccatctctacaatgtatt

SEQ ID NO: 120482 - DNA, 637 bp, Homo sapiens
gtgtttcagtcctggtgttggtgctaaccagttgtattgggcttgttacctacgaagaaaactcacctttgttaaatgcccagtgtgtattgggcacggctttcttttttaatttatgtggttttctttagaagcccatacgtgtccaagggttatgaaggatgctaaagttagactcttccacccatggcccccagcctgtgatcccattcccagtgttatctattgttaccaattttgcataatacttctagagtaccaggaactttaaatatattatgtcagttaagtttcctggttattgctccaatttaatttaatttaatttaatttaatttttttgtctttttcaggatttagggcaggaaaggcaggctagtgtatgtactcagtctgcatatttgctccaatttataaccctattttacagtttctgaaattgagcttagtagctacttgcaaataactaattagtagtggagctaagattaattcaccctttctgtactcactgaataactataatggtaccatgctaggctttgaggatgggatcatgaggcacatagatccttcctgtcagtctagtggaggggttttcttttttttattaattttttttctttaattagggata

SEQ ID NO: 120483 - DNA, 695 bp, Homo sapiens
agggacaggcagaattgccaggtgggggtcagtgtggaaagaaacaaattaacaagccctttggggttcccagagaatgtattgcatgaacaagaattttttttaaagtcttcttgcaaaaattacatagggaaaccaggatttgaaaaacccagtcaacagcttgctaccacagaagagacatttcatccagaataactggagttagatagctttggggatgcctccacaaacatttgtttcatgtggtagcctgtcaacactgctgcctggcacagaaggagaaggcacagtgcaataggacaggaatattgccacccaatttccactgcggatacacagtctctggaggataactggggatcctgctgactctcacttctctaacacgccaatgactgaatacattagaagttcgagaattctaaagggaaatggcttaagcttattgaaaaaagtttcattgtgactcactggcaaaactactttagtgtatttaaaaattccacactcaacaatgatattaaatgtcaaactcagtaatactgaatcctttctggaataaagcagaaaataaataacagtaaatcttggaatacaagtaacagtgaatcttggaatttgaccatatgtatcaatgggcttaaacagctataagtcatgagacccaacaaatctaggaatttattctgagg

SEQ ID NO: 120484 - DNA, 503 bp, Homo sapiens
tggggcatagtagcagagggagcaagagggccaaatgtatgttttaaaaatatgacttatggatgttgggtgaaaagtaccagtggagaaaacagagcctgaagatagtggggggctaggaggaggccgaatgataaggccctagagtttctaggaagagcatcaagaatagagtgcaaagatgagagctgcagttctcatgctatgttgtgtactggaattattgggggtgcttgttgaaatgtgactcctgaggtttgtttctaagactaatattagcatttctgggctgcatctctaacaaatactctggtgattctgtataggtgaactatggagcacactttaagacagagaagtggtatctcatcctttctaagactgaggtttggatgaaaggctaagaggcgagatgcagagacagcctccctctcttttatttcctccctcacttttggcagaaaatatgtacacctactttattaaaaagattgaggccatgg

SEQ ID NO: 120485 - DNA, 640 bp, Homo sapiens
ataaggcagtctgcagttatctgatttcacagcaacacctgcatatttatctactcattaccaattggatgatggaattttttcaagcacatttcaaaaatctgccaacttcaagtataaaaaaataaactttgtggttaatttttcccttaacaaagtacagctgttgagaataattgttcaagatcttaccctgtaatgtcaactgcagcagaacaaagagtatttaattagcaaatctatccagtaattcaacacctattatataaaatgccttcgtgattttattcaggataatttgctaagagggttattactgacattcagatggaatttaaaattcctacgcaagtcgagtcataatagcagtaatgatctccccaatcaggagactcggtgtcacacaaggctctcttgcaatgcagcagccgatttcctgacttcttaattcctgggctcagctcagtgagagcccttcacgccgatatttcagtcagcaatacatctttaatgggactctattaaaataactagaacaaaaatgacttttttttggttaaaaagaatgacagcactgccatcatatcaatcattgcaggctttgcagaacagtgccgttaggggaaaagaggagggggaa

SEQ ID NO: 120486 - DNA, 438 bp, Homo sapiens
atagaaaactagtatcacttaccataaatagaaggtaactataaaaataagtaaagttggccgggcacagtggctcacacctgtaatcccagcactttgggaggccaaggagggtggatcaccttaggtcaggaatttaagaccagtctgaccaacatggtgaaaccccatctctactaaaaatacaaaaattagctgggtatggtgctgcacgcctgtaatcccagctactcaggagactgaggcaggagaatcacttgaacctggaaggcagaggttgcagtgagccaagatcacaccactgcaccctagcctgggcgacagagcaagactgtctcaaaaaaaaacaaaagcggagggggggaagttaaaacattgttagtaaattctgggtgaatggatggtattgcctaccaaaggctctaaatttgaggccta

SEQ ID NO: 120487 - DNA, 517 bp, Homo sapiens
tgcagcctcctttcctgtctcctcatctccacaacctgtaaatcctggagggcccccaaagcccagtccttggtccctttctcctctccatccacactcacttcctaggcgatctcatcctggaggtggaatattttctgtaaatgctctctccaggctgacaaccccgacactgatttttccagcctgggccctggccatgaactccagacttatccatccagctgtttactacttgatgtctctgcgtggaggtctcacagacatctctaacttagcatgcccaaatatggactcctgacttcacatcccctcaccccacacttcccaaccttccagtctttcctcatggcagtaaaagatgaccacatcatccttgattgctctttctcttacatcccacattcaatttgttaactgtcaactctcccattaaattgtattcagaatctgttgacttcaccccacccaagtccaaaccagcgtggtctcttgcctgctgcagtggtctcctcgc

SEQ ID NO: 120488 - DNA, 785 bp, Homo sapiens
agctggaggggaggaggagggcaggattccccactcaccttctctgataccgccctggtagtaggagtcaagaggggtgcctcgttataaccaggtgaaggtgggagtctaggttccccactcagtgtttgctgaccggatgggaatgaggcccgtttttctcatggcctaggttggttattgtctaaaagttttctgtcttcctaggctgccctgttcctgctgtcctaagagagcagcctttacttgggactctttttttttttatccaatagttgtctgcagccattggtgtttctggcttgcagccgagtccaggatatctgagccaaaaataaaactcaagaaactcaccaccatgttgttcctcagatcccaaggcccctagccagtgtgccttcttatctctacctttgagaatctttttgcttgccttatatgtaatatcctctgtttttagctgtacttagcaggcagaatagggagaggcacgtctactccatcttgtccagaaccagacattataccactgtagagttggggttcgcatctcctagtgaacagtaatgccaatccagatgggactatttgatattggtagattatttccaggtgaactcattttctttatttaattgaaaggtgttgtccagttaaggttgtatggctgctgttgcagtgttactggaaagaatttcctgacacttacatgaaaacatcttttcctaatcctaatcagatctcatcagatcccatttaataaatggctagcaatttactctaag

SEQ ID NO: 120489 - DNA, 235 bp, Homo sapiens
ggggtcgcgaggtggggtgatcagagaaggtctctgagggtgtaacattccagctgagtttgcagaagagcgagactgtttctgcagcaggtcaggaggagaatgttcctgggctgagggaacagcaagcacagatgccccaaagtctgtttgatgagcagagaagccttccctctctccaatcatttgttaaatgctgtcagatttatatctgaaaattatactgcttgcctcc

SEQ ID NO: 120490 - DNA, 301 bp, Homo sapiens
ctgggactagtgcatgtggggaaagtcagtaaagactgcctctcaagtacagctaactcattactaatacaggtacaaataataggggtgctggaaggagccaatccatttctaatgcaggtaaaaataacaggggtatgtgtgagggaaatggcagttaaacgtgtcatatgttcgctttaaatctagtcactacagagaacaaagggaggttgtaaattcttcccaccgtgaagaggcccaagggcctctgacccatactcagaaacagtgatggcctgagcacatgcatgtaaaaagc

SEQ ID NO: 120491 - DNA, 423 bp, Homo sapiens
agaaaccacactgtctgtgggctaattattccccattattgaggcaagaggcctctgagtacccaataagctgtacattactacatggttttttaccgtgtggctggtaagaactggcactgttcctggtctgtgtgagtgctaagcactattccttctaatccttcccgacagttctttcccaggtctccagttagtttcctcatacccatgtgtgctaatcagaattctgatgaatatgtgccaggaactttatataaattatttctaatccggccaggcacagtggctcacgcctgtaaacccagcactttgggaggccgaggcgggtggatcatgaggtcaggagttcgagaccagcctggccaacatggtgaaaccccgtctctactaaaaatacaaaaattagccgggcatggtggt

SEQ ID NO: 120492 - DNA, 569 bp, Homo sapiens
agatttctgtagtctgacctaaggaattggtaggaaaggcaatgagaagttggatgggggagagattttggaggcaggagagatgacccctggtgtctagttgaatgaacatgagaaggagagagtatatcagagaactcctccccattttgaacctgtgagatgggatttagttatgccatcaagttaggaaacacaggagcagggaagagatagcagagaggatatggcaggtgaacccataagcatgaatttcaggtccttacagggtaacaggaaatgttgagttgtttgcttgggaggtagttctggcatttagaagagagatctgggctagaaggaaaagtgggcttagctgcccttgtggtcgggccatgagagtggatgtggtgtccctggggtgagcatacatatggccaggagagggagggcccagggaaggggtgcaccattgtggcagtgaggaagggaaccttccttcagtagacccacaggtagctccaactggcaaaaggagccagagagcagagtagcaggaggcaaacccagagcgccctgccacagtggat

SEQ ID NO: 120493 - DNA, 474 bp, Homo sapiens
tagttgggattacacgcacgcaccaccacacctgctaatttttgtatttttagtagagatggggtttcaccatgttggccagcctcatcctgaactcctgacctcaggtgatccacccaccttggcctcccaaagtgctgggattacaggtgtgagccaccacacctggttggtaaatcttttctataaagggccagatagcaaataggttcagctttgtgggccatattgtttctgttgcaaccacacaactctgccattgtagtgcaaaagcagtcatagacaatacctaaatgaatgagcatttaggtattcctgtaaaaccttatttgtaaaaataggcagaaggccagactgagtttgcaggctgtggtttgccagcactggtctagagttcccaaaggatgcatccatctactatgaaaaatcctcttatgacttgagccctgtctaactttctgactttatcttgtt

SEQ ID NO: 120494 - DNA, 389 bp, Homo sapiens
gtccgtgatgagatgtaagtggtacatgacatatcttcattccctcgatataccagtcttttcttcgggctgctttcaagattttctatttctctggtttaagctgttttactctgctgtgcctgggtatggttctcatttgaaagattttacgctatggtttcttttagtggtatttggagacaatcttggcgctaggggtaaatatcgtaatcttaaaacttaaaataattgcccggtgcagtggctcacacctgtaatcccagcactttgggaggcccaggtgggtggatcacctgaggtcaggagttcgagaccagcctggccaacatggtgaaaccccgtctctgctaaaaatacaaaaaattagccaggcatggtggcatgcc

SEQ ID NO: 120495 - DNA, 322 bp, Homo sapiens
ggtagaggatcccatggagatgtgctgaagactcggatcagccggatttgatgaaattattgaggatctcgatttagtgtgttttaggcattaatgggagtagactgtaagagtttaagaactcatagggattaagtttgtggagacaatgaagtatacactaccattttgagcaacttagctctagaggaaaggagaaacatggaatggtggtttaaggagaagttgggttgagagaatgtttggttgattgttcaaagtgaaaggcttgaacatgttttgttttgatgaaatataacacatgtaataagaaagcacatct

SEQ ID NO: 120496 - DNA, 258 bp, Homo sapiens
gcagggaggtatgaggaaggggctcaaggaagcctatgctgtagatcttgatgggggcagtggttcaacaggagtataattatgtcaaaatcaatcaagctgcacaattagattttgtgcactgcatatcacttctaccctaatttttgaaaaggggatcaattgctggcctccaagcagggcctgccacatgcaaagcagagtgatgcagtttcctccttcaccccagagattggacgcagtaatagtagggccatg

SEQ ID NO: 120497 - DNA, 483 bp, Homo sapiens
  misc_feature (424)..(424): n is a, c, g, or t
  misc_feature (427)..(427): n is a, c, g, or t
  misc_feature (429)..(430): n is a, c, g, or t
  misc_feature (435)..(436): n is a, c, g, or t
  misc_feature (444)..(444): n is a, c, g, or t
  misc_feature (447)..(447): n is a, c, g, or t
tgcactggtattttacaggtttatgtagtgtttaattaaacacatgtgacaaacataaccagcacacactagtttgggagcaaatatactgcctcttgtcaggaatacaacttgactggtgagacacttgagtgcattacagagtagagtttgcagaaatgcttgaacatattacagaatagagtttaggaaaaggaggatatctgctccaattaatcagtcaagtgaaggttaaggttaagagagcttccacattaagctgtgtatgcagaagacaaaaatacacaaagataaacaacaaacctggaattggaatggggaaataaaataagatttgattactttttaaaatacaattgtatgttgctaacttccaacaagcatgtattattagattttttttttttttttttttttgggaaanggntnntggcnntttttccnagnctaaggtatagaatggggataatagtccccggggcc

SEQ ID NO: 120498 - DNA, 424 bp, Homo sapiens
gagcctgtgaccaaatgacacacttgatggcttcctgaaggagctttctcaaaagcaatagaatttccttgcatatttgaatctgctcttgcagcagtttgaagctgtgagcccagctctgtgaagcagaaggttagacattaccacagactccaaggcttggaaacactgcaggacattttgtaaacagaagtgcagccttaggaacacatcttcagcatacgggggaagttccagcacatttcacaagagggaaaagtaatgcaaggaaaggataatttcagtcttctgtgttgattacccttctccttgccctctgtacaagggggttagcaagggcagctggtcgcaagactgcagctgttcttaattgttgattttagctttgcagtggtcccttgtgggaaaagatgccacatctgta

SEQ ID NO: 120499 - DNA, 610 bp, Homo sapiens
tgagaaaggatctcactctgtcaaccaagctggagtgcagaggtgccatgatggctcaaccgcagcctcgacctcctgggctcagttgatcttcccaagtagcagggaatggagtcatgtgccaccatgcccagctactttttgtattttttttatagagatgggatttcaccatgttgctcaggctggtggccaacttcttagctcaagttatctgcccacctcggccttccaaagtgctgggattacaggcatgagccactgcacctggccctggactgtcttcttaatgccccagaaggtgactagcagaatagaaatgttcttatgccggctgggcacagtggctcacaccttgtcatcccagcactttgggaggctgaggcaggcggatcatgaagtcaggagatcaagaccatcctggctaacatggtgaaaccccatttctactaaaaatacaaaaaattagctgggcatggtggagggcacctgtagtcccagctactagggaggctgagggaggagaatggcgtgaacctgggaggcggagcttgtagtgagctgagatcgtgccactgcactccagcctgggcgacagagcgagactcca

SEQ ID NO: 120500 - DNA, 792 bp, Homo sapiens
acacagggctttgtaaccagaagaaggaggtggacgtttcttctaagtgggagtcctaagggatctgattgctgatttttaagagatctcaaacattttgtgggccattacaaagctcatgtcccctatgtctgtggggcctaatgattcaaacagccgtgaccaggcctgcctgtgtggcccagcctggctggcattcaagtgaataacatcatctccatctcactgcacagaagtatgaactgcggtgtcagcaggtttccatgacaccaccggtgatgtagagcacacatctctcccacactctgctggttaccaggccctggcagtacagaccaggcctcctgggttgccttcctccttccggctcacaggttcctcttcactcccatgctctgctccccagacctctggcccagaaggagtgacccagagcctgaggcaggagaaattttgaggcggagactggagctgaggatgaggcccaggcccggctagagagaaaacactgagaagggactgaggcccccacatgctggaatcttgtgaaaagaggtgaaggcaaagctggggatgagagagagaagacggagcaggagattagcaaggaaataaggtggggaaacagctgggaagacagacatgcatctggaagattccagaaaaggccatttcatccagccctgctccagcagtttgtatttcagcagcctcacgggacacctggcctttcctttctgacatcgttctccatccatccagcacctcttggagatcacaaggggctctcca

SEQ ID NO: 120501 - DNA, 317 bp, Homo sapiens
cgaaagagaaaaaggctggagctcccgcccccggggctgtcagatggcttgggtttctgcgacgcgattggctcgcggagggcagaaattactcagcaaacatgactattattagctgcttagcaacagctcaccaaagtagagagaccacccaggtaggcaacccagtgtgtgcatcctcggcttcggggcagcctctgagagcgccaaccttctcgcatgcaatacttccattaaggaatgctccccctcctttctctcttattccttttcttttcaacagtgtcttctttttgtgggatgcctttgcgcgcaca

SEQ ID NO: 120502 - DNA, 421 bp, Homo sapiens
  misc_feature (47)..(50): n is a, c, g, or t
atacgcgtagctaggattgcaggcacccaccattgcacccagctaannnngtaattttaatagactaagaagtaaaaatgttcaaatttttcctacggcctcctccatttttcctacaacctcctccattgtaaaagcctatacttacaattctaaaacctctctaaagctaaaagcaagtgtcaaatcaattgtcttttgaaaagaaaactaagcagcctggggggtcactgattttgatccataaacagtttcacatactacttctgttaatgctttcttgctataatgcatcagtgaaaataaaaacaactatgaaatttttttttgagacagagtctcactctgtcactcaggctgcagtacagtggcaccaaccatcatggctcactgcagcctcaacctcccacattccaacaat

SEQ ID NO: 120503 - DNA, 343 bp, Homo sapiens
atggccaggagatactggccaggtggtcattgtcctttcaatattggcacagtgaacacagtgatggagaagccatgatggctgggatggaggctacaaacaggctcccactttaatatcaaggtcgatccagcccttgtcatgactgaatgttcactctatcagcaatagaggtcaatgctgactacctgatatggcaccagttttggaggagatcaactagcaactttctggccagttgattacattggactcctttcacctgtgaaaggctgtgattcactttgaccagaatttacacttgtctacatttgcctttccagcctgcatgacctcagctagc

SEQ ID NO: 120504 - DNA, 574 bp, Homo sapiens
tggctgaattctgctaaatgggaaatgaataatacaagtaataaataataaaagaattttatttttaatgtggattatggtgttaagggaatgctttcttgaaagaagtaatttgaactggtctttgaaaggggaaagatacagatatgtagagaggggggaaggtcatctcacttcatggagtgggcttggagggctggagaaaagacagaagaaatgatgggaatgtgtggcctatatgaagaatagtattaggttggtgcaaaagtgattgcggtttttgttattaaaagtatggcaccaacctaatacaacacccctttctcccctctcaccattcttactgcctctgtttgttgttgtatgttttttgtttttaagcagtggagctcttcaaacaaaatcttcacagatgcataaaataaaaacaaaaagtataactgctttagtttaatgcaggggcaggaccctgggccctgcttctcagctcctttttacttccccaccctctagtcctacctttacaggccttgagatactgtctcagcatccctaggattccacagagcagttt

SEQ ID NO: 120505 - DNA, 211 bp, Homo sapiens
ggaaaacatcatggaatggcccagatcaaagtcccctccaaggccaaaaaaccctgacagacaccatcccaagtcccacagcaaggtaatgactgggcttgggcatggtgacataacaacatgttagtggcatgaaactgagccagatcctctcaagagcacatgacgacagtctacttcaggggccctatctcactcaggctgtcggccc

SEQ ID NO: 120506 - DNA, 793 bp, Homo sapiens
gggacacattgcgcggaaagaacttactggcatgtatttttaaggtatattttagaattttctatgcatctagctataaagctatgaaaacaatcaaactacttaaatctgcttggaaacatttaatgtgttaagcttatgatcagggtgagtaatgaggttttaattttcattaaagtagggtgtgtgtgctttattaggatgctcttaatatacaaaatgctgaatttatttgcatgttgccattccctgttgcccccattaaaaatataaatatattggattttctaagtatataactaacatagggaaatatctaaaatattatcaataggcaatggagtaaataaattatggtttatgtatcttatccctctcagtaaatagcagtatcttttgtcttgttgctcaggccaaacttggaaaaatccttaatccatgtctttctctctcatcctatatctaacctatcagcacatcctggtgacacctcttcataaaatatccctaatccaaacacttctcaacacttctaccacaaccactctggtgtggggatgccaccccatcctctcttgcctgggctctgcagactctcctaactcttttcctggcttccactctcaccctctcttctggtttccagatagtagccagttgtccttttgaaacatgtggaatcgggtcatctctctgctcaaaactctaaaggtttcctgtcctgttcaaagggaagccccagatcctgaccctggcctgctggagcctgcatgatctggcccctctacctctc

SEQ ID NO: 120507 - DNA, 383 bp, Homo sapiens
taggctgtcttctcaacccaattcaaagaagtaagatataaaggtaggctttgaacaaaaaacactgtcagacttggccattcttctccaagggtcctgatcagaaactatcaggattgaaacaccaatgtctaattctcctcagaacacaacattcctccctttactgcttggataggacagggcctccagggtcatctgggatgctcttctttctaaaatgcagaaggaagaatgaatgacagaatgagagcaagaggtggcctggggctttacttttggcaagatgagtttagtcaagagagctccagcaagttggagtggagaagaggggagaaggcccatctcttctgatacgcagtgtatttggtgtagtggactta

SEQ ID NO: 120508 - DNA, 381 bp, Homo sapiens
ctaaggaacttaatgagcaacttggatccaattcttcattgtctgtcagaggaaaggcatccatgcttggtaatgagcctttggatgctctacccggctctgtggccagaacaaagcgccttgttatctccctgacaaggagcctactttatggtgttggacaaaacacctagcacgtcattctcccaaacagcacaaactcatacccaatgaaactgggggagcaacgggtggttctttctactctcagaaacctgtttatttccatcttggtggtgtggagagggtgttgtatgttgcacattgtgcaaaggcctgggacatgatggccgctgctcccactcacccatctcatcagcatgttgtagacatctgcagagt

SEQ ID NO: 120509 - DNA, 337 bp, Homo sapiens
gttaatcttccctagaacctggcatttatttatttgtttgcggaaagaagcgacaaagttagtcaaaactttttaagattataagaatagaataaattatccacaaacattttggacattattattttacttgatttgcacaattagtctttggaaaatgtggatgagaaatgggaagcacatgtagttttttatacattttttattaagaaagtactctgagttccagtacttggatggtgaccttatttttcttttgtttgggaagatatggctatgtattaaatggtcattttcccctacactgaaaaccataaaatcctgtgaaagttctata

SEQ ID NO: 120510 - DNA, 319 bp, Homo sapiens
gacactgtcaagagcctgagttacattttgtttgactcctgatacttatctaaatgctaagcttccctgggggaagaaattcagagatatatgcaaacatagtctaaggggatgggaaatgccatcacacatattaccccaaatttatagcagttttatataggatgtcagtaaaggaaatgagaaaggcaacctaaacccttcaaaactatcttggcttcatcctgctgggaaaagctgaacaggcttcacttgataatatgtccatttgtgtatgctaatttccaaggctttgaaagctaatacaaaatctttttca

SEQ ID NO: 120511 - DNA, 133 bp, Homo sapiens
tccagctaaacaaatgaacgattatcgagacaagtcaccccaaaaccgctgtgcagcttgggaaggaaaagagctaatcacatggagggttctatattcgcttcccaaggcacacactgtccccacatggcca

SEQ ID NO: 120512 - DNA, 275 bp, Homo sapiens
ggtaagcaactttccgtgtctggggttccttgctctgctacatcacaagaggatgccaagaaggaggctttggagagtttatggaaggaggttctctaaaggaagaggaagaaatacttttgtaagcatactgcgccaaggagtgggtcattttagtagttcactttcatttttaaacacaaatccacatttcataattttaaaataaataaaaattaatagaaggtctgttacttcctacctcctgccccataacattcctaattgtttcccag

SEQ ID NO: 120513 - DNA, 456 bp, Homo sapiens
aggtctcattcactacctgcttttttttgggaagacttctgtgatggttaattttatatatcaacttctctgggctaagtacccagatacttggtcaaatacaagtctagacattgccgtgaaggtgtttctttaaatgagattaacgtctacaccagcagacatggagtacagcagaggaccctccaccgtgtgggcgggcctcatccaagcaggtgaaggccttaaaggaaaatgactcaggctcccaaggagaagagtctgcctccagctgcctccaggctgcctttgggctcaagctgccactcccactcccactcccaggggtcttcagcccgccctgcagattgcagacttgcagcccccacagtcacatcagccaattcttcaaaataaaccttgaaaatacatcaaaatctctaggatataaacacatcctactggttctctggagaa

SEQ ID NO: 120514 - DNA, 502 bp, Homo sapiens
ttttccaaccacttcagcagaatctgtgtttaaaactaaacagtgaatatgcttaacacaatctttcttcatacccatccaggaaggctgtcagcaccttgaattggccttcatgattagcccggtttcagtgttttaagagccctgtaaatcataaaaactttattttattaagcaatttgaattttatctctgatttcaaaaagattttgacctattatatgacaaactacaaattcgtgatgtttccactacttctgggaatacaaatattatcacatacctaatacagataataatgtacctccacctccacataccgccctatgaatcactgctgaatggcaaattttcacctatttaaatgaagagagagaagcaataaaataaacaacaaaaaaaacactcttgtgatttattcctcattcgtatgctctggaaaaataacacatattagaaatggggcagagaggccaggcatggtggctcacacttgtaatcc

SEQ ID NO: 120515 - DNA, 380 bp, Homo sapiens
tcaggagaagtaaaaacatatccacacagaaacttacaaatgaatgcttataacagcattattcataatagtcaaaagttgaaaacaatccatgcgtccatcaagcgacaaagcaaaagtaaaatgtggtatatccatacaatggagtatattcagtcctaaaaagaaatgaagtactgatccatgctgcaatatagatgagcaattaaaagaagccagacacaaaagggcacattatttgattccacttatatgaatacagaaatccacagcaacagaaggtaaattaatggttgccaaggactgactggagacaacagggtgtgaccactaatggaaacgtggttttttggggggtgatgaaaatgctctgcaggtga

SEQ ID NO: 120516 - DNA, 2717 bp, Homo sapiens
  misc_feature (801)..(801): n is a, c, g, or t
  misc_feature (948)..(948): n is a, c, g, or t
  misc_feature (998)..(998): n is a, c, g, or t
  misc_feature (1509)..(1509): n is a, c, g, or t
  misc_feature (1700)..(1700): n is a, c, g, or t
ttttttaaaattctgacagttttgttgactttgcactctgatgaaagcgtaaaatcctaggatgaaaagctctacctacatatcaaataataaaatagttataccctagaagaagagaaactcactgtctcctgctaaagaaataccttctgtctatgcaacttttctttccccctttctatacctctcttataagggcaaagcatttatagcctctgagttctaagaaaccatgggagcacggtgatctgctggtgagataaccgagataacagggcccatggtccaggtgccaacaccgaggacccttgttcctttatgtgagcccctgcatctggcccactgctgggtttcaaacatagtattattgaacaacctcaaattgctatatttaaatcaactctttatcaactagtcctgaaaattaaggcctacagacatcaacaaaacgagcgacagaagaaaggcatttccaagtgatgtaactgggtgactcatctcacgaaagggcactcggaggcctaccagtagaccacctttctggcttttggcatgccctgacatcagccttgctccctccattaatcatactacgctcacatagaagccaaaacatgtcacgcttctgtttgaaagctgtctttttgttcttagcaacatgtcatgtttgggggaagttataatatactggccagtggtgtcagtaagtcgggaaggctaaggagctttgatgtcaggtctttaccatttaatgtttttcaaagtattgggaattctgagaatattgtggtcaggtgtaantaagatttgcatgtcggttctttttttgtgatttagatcagcataaacttctccctccaaaaatcctttcagataataccaacttctgttctttcgcctgtccctgctctgggtgcttctccctccatggctagacttttttcagcngctcagggtcccaggagggggtgggggcaggctgggtccatttcacagtngtcagaagttgtacagaatctgttggggttggggttgaggcagcgtaggcttgggagccctacaacttgagagccagaggttcctggttaaagttttcagctgggacacattacttacccattcagaaacctcaaatgagggcagcccgtctgactgttgttttctggttaacttgaatccttgagctaaggtattccttctatttttactttcttaaattatcctggcatggatgtgtttgctagttccaaattttgtttaaataatatgtcttctacttatgttgtgaaactcaaagtgtggttgttcgttggttacgtcttccgatgtcttcagggtgacctaagtcttagagaacattggttactaacaagaaagttgagtttgctttgggaacaagaaagcgctttagggttgactgtccttccattccacctgtttttgccttttgtaagaaattgaagctgtgggctcattactacgtatttggtagctcttcagcaatgtgtngatcagcttttcccaaatgggtaagagtctaaacttttattttctcttctgcattactgttctttcagcttggtaccccaaaaaatggccagtggggtgtcccttatcctcaaaatcagtcattccatttcagaaacaaagtgaaagaactttgctggttgtaagttgggcttcccagggttcttggtggntggatctttattatgtgtttggatttcacagggcccctgcttccaagggagcagcagttccagctcacagctctgatcagggtcaaaacccgacttacatgcatcgtctttatatggtttttttcaagaccaagttcattcatttgctagtctttctttctttcctttctttctttctttctttctctctctttttcttctctttctttctttctctctttctttttcttctttctctttctttttttcttctttctttctttttctttcttttgtagctttgaggatatttaggacttaagtttctgggcagcttatttcctttttcattctctgctcttgtaagtaaaggtaacttctgagtagctcaaacatatgttggaactatggatctttagacctgaaagaagcacggcagctttccaatccagttttcagacattatgtttcatcatggtccccgttcttcaaattaaatttaaccacaaacctcgaaggatgactgataaaatcagagctgcaattagtagtgtgcgtgggtgtcagttctaatggaagcctgctaatccactgatgggaagcctgagaaccagaactaagtgagttagccagtgttactggggcaggacagggagtacagccaggaggagaaattgggctcatttaggtagaaatcagattagtggcagctggggacggggctgtagggagggagtaggcagcaaaggggcccgagggaactttttttgggggtgataggaatgtttctatcatgattgtagtgtggttgaatgactgcctgtttgtccaagctcactgagttgtaccctggaaattggtgacttttaatgtctataaattatgcctcaagagaactgacaaaaagaaaataataaagtggctcaaaagttgtaaggaacctcctaaaacattcaggtctttcattaggggaggggggagcattttctatggttttaaattcagtgtaactgtatgaaatgattccttaaaaaatac

SEQ ID NO: 120517 - DNA, 458 bp, Homo sapiens
gtctcgaactcccgacctcaggtgatctgcccatctcagcctcccaaagtgatgggattacaggcatgagccactgcgcccggattaattggccttttagttaaaaatattttttttaaggggcaagcattaagttcttttagtactcagtaaaatacaggtaggtgtatatcagtatgaagacacttgaactacaaacttctctacccaaagcttcattttgttccagttgtcaaagtggtgatcaaaatctgttagcttgggttacctctggctgttgggtacctgcttttctgtttgaggaagactggaacatgtactaggtgatgagtaaaggtgcgtgttttcagtactgataagtgtccaggtttttaacctgatagtgactgaagatccgaagtcatttccctcctttcggctatcaagaagttaactcatacattcattcattcatttac

SEQ ID NO: 120518 - DNA, 514 bp, Homo sapiens
tcattagctttacaaaggtggctgcgttttagggaagggctattttcatttaaactgtaaactaaatgtctcccaaagttagcttggcccaaatccaggaataattaagggcagcttagaggccaaaggcaagagggggactggctagatcagctctcccccgctgtcctaattctctcactgatacaatttttgcaaaggacatcttacttctctatcaaactatgactctgaggaggagatctttttgctcattgttggccattatgggctgtacaatgtgttccttgttctgaagaaataatggtcggctttccaaatctgtgcactgtctcttgttctactttttcatttttttaaatttaattttgtttttgtgagacagcatctcactctgtcacccaggctggagtgcaatggtgcaatcatagctcactgcagcctcgacctcgcagactcaagcgatcctcccatctcatcctcccaagtagctgggattacaggcatgcacgac

SEQ ID NO: 120519 - DNA, 627 bp, Homo sapiens
ggccccaagcgcgaggagcggggcggggcgagcgcgcgtgctcccggatcctcggcagtgtccggcgcccccttcccttcgccaggcccgtttggcgccttcactcgggaagacgtcggccaggactttgcgctttggagacgtcttacttcggcagcactcgcacactgcgagatccgacacgggcagcggggacctagggagccggggacgctgcctgtcgggtacggttccgcagctaccgcagccccgtgggccatggttagtctccccccgacaccgctccctctagagctccgggcttcggaagcggctgcacgtgggcatggctggagaggttccgctggcttggggcagtcgccgggattccgactggttggtgtggggtgtggcctgtgctatccagctcccagctgatcctaatgtgcggcacagcggaaaccaccggtccacatcagtgcttctcacttaaaggggcttacgaatcgtcgggggtgggggagctggacttggaattttttaagagatgaggtctcactctgtcacccaggctggagtgcagtggcgcgattacggctcactgcagactagacctcctgggctcaactttaatgtaaattgggattg

SEQ ID NO: 120520 - DNA, 777 bp, Homo sapiens
atagtccagatactactcttttgtcagatatgtggtttgcaaatattttatttctgtagtttgtctcttaaagggatcttttacagagcaaaagtttttaatattgatgaggtccagtttatcagtttttcctttaacgtgtcaaacttttatttagtgtgagatctaagaactaggttgggcatggtgttgcgcacctgtaatcccagtgactcgagaggctgaggcaggaggattacttgagtccaggagttcaagaccagcctgtgcaacatatcaagacttcatgtcatattaaaagaataataataataataatcaaaaacactttgcctagtcctagattccaaagttctttttctaaaagttttatagttttctgttttacatttaagtccatgattcatcattagttagtttttatatgtggcatgacatttaggtcaaggtttatgttttgcctatgaatgtcccaagtaattcacttttattttttatttattattatttttagacagggtcttgctctgtcacccaggctggagtgcagtggcacgatctcagcttattgcaacctccacctcccaggttcaagtgatcctcttgcctcagcctcccgagaagctgggaccacaggcatgtgccaccatgcctggctatatatatgtatatgtatataaatatatatgtgtgtattttgtagagacagggttttgccatgttgcccaggctggcattgagctcctgggctcaagcaatctgcctgtctcagcctcc

SEQ ID NO: 120521 - DNA, 225 bp, Homo sapiens
cagagacacaaaccaatcctagtctgtgtttccaatgtcattggtcaatgtcacctacatatatcctctgctgatgtgacagaccagcagagtctgttggtatgtgtgaccatctttctccagtagtctgcattcctatacacttcttaccacatgtacattgactgcaggattgctgtaagtgttataaataccactggtaatagctcttatccaatgacaaat

SEQ ID NO: 120522 - DNA, 251 bp, Homo sapiens
ctcagcctcccgagtagcgggattacagatgcccaccaccacgctcggctactttctgtatttttcgtagagacagggttttgccatgttggccaggctggtctcaaactcttgaccccaggtgatccacctgccttggcctcccaaagtgctgggattacaggtgtgagccaccgtggccgaccaaaaaatactttattactaacaagtgcttctgatcatctgagccttcagtaaatcataatcttttt

SEQ ID NO: 120523 - DNA, 482 bp, Homo sapiens
acatcagtgactgcccttgaccacttcggcacactggtgagagtcaagcttcaagcttattcccctgtcaaatgagaagaacactagagtcgtgtctcctgcttctgacccacctgggctgcacctccacactcggtggcgttaagatgcaccacactcaggggagtcattagggaggaaacagccacatcgccttgagtttctgaaaaccaaatgaatggcagtgctttcactgacaatgacaattcagtgcagtaaagataaaatacaaagagttggagcttccaaactctccccacagttccaagctctccccacagtcttagtggaattgcgatgggcctttggtctgctggtccagttaatatgctccaagtagcataggcagcagtctgaacccaaacccacttggctgccgtccttcccagaatgcctgttccgcaagcctgccatttggcttgttctccctgctgtgcggtgcc

SEQ ID NO: 120524 - DNA, 227 bp, Homo sapiens
atgagctgtaagccaaccttttccttcctaacttaattttccaaagaatagtaacttacccaccaccactgcagtcactgggccgggaagacaagcactcttgccttgaatccatgccttgagccagtagccttgacccagggtaaagcagttatgtgcttgggtcacctgggtcatgtttttgaaattgcctcaagcctaccttacaaatccttcctggaaccctg

SEQ ID NO: 120525 - DNA, 256 bp, Homo sapiens
caactgctgtgtttcagaaatcagagctctgagatggaaccggctgtgcactaaccttatagccctgattaattccctccctttgtttgcctcattatcatgattaggttctgcccgtagcatagcaacggctaattgtaggctggttgcagagtgcataattcctgctattaaaattttatcgaggcttaattgtgctcctttttgctgcggcgaagcttcaaagtttcagaagagaggggatgtggttagtggg

SEQ ID NO: 120526 - DNA, 308 bp, Homo sapiens
agtgtaattagcaaggaatcatggagcatgaacatctattgtgtaaaggagcaactatttacaaaatcaagataaaagaacccactaatggctactaccgacagagcccaggtctgataacatctcccagcataaaggcacactgatttaccccttgttttaaagaagcagccagagcttgccaacaaaaatatgtgattgatctaattagctcactgaactgaggaaaacagtgtgccaaaatcatgtgtactcacagattactccttccaggacaaagcagtgttgcataaaagcctatccttcaa

SEQ ID NO: 120527 - DNA, 847 bp, Homo sapiens
agcggttggagaccagccaggccaacacggtgaaactccgtctctacaaaaaatacaaaaattagctgggcatggtggcacatgcctgtaattccagctatttgggaggctgaggcaagaaaactgcttgaaccaggacccaggaggcattgccgtgaactgagatcatagccactgcactccagcctgggcaacgtagtgagaccatgtctcaaaaaaataaaaaagattccatatgatcctgttgacttctagctatgtccatgatgagggcaaaattcttaatctactcaaagatctatagtcctgacccaagacatgacatagcacattgtgtgaagcattgaaaccatttaggttttctgtaatctgctgagttgtattgaactcctgaaatgctggagttggaaaaaccctaaaaatagcaaactgtttcacaaaattatgcagaattaactgcaggagcttttgaaaatcaaagattcttgggtctcatcccaggcctgttgaatcagaatcttcaggagaataaggcatttttccagtgttctgccaagatgtatatacggggctgggcacagcagctcacgcctgtaatcccagcactttgagaggctgaggcaggaagattgcttgagcccaggagttcgagaccagcctgggcagcatagcaagagtccatctccactatttaaaaaagaaaaaaaaaaaaacctggccgggcatggtggctcaggcctgtaatcccagcactttgggaaggctgaggtgggtgaatcacttgaggccaggagttcaagaccagcctggccaacatggtgaaatcccatctctactaaaaatacaa

SEQ ID NO: 120528 - DNA, 942 bp, Homo sapiens
cctaaacattgacatgccaaaggaatttaggacttcctgatctccatctccatcctcccagacttggcaaaactttacttctaaacacataaacactgtccacctccaaggaaacatattccagagacttctacctcaaaagtcagtataagccagatgcggtggtatgcacatgtagtcccagctactcaagagactgaggcaggaggatcacttgaaatcaggagtttgagactatagtaaactaaaattgcacctgtgaatagccactgcactccagcctgggcaacgtagtgagaccatgtctcaaaaaaataaaaaagattccatatgatcctgttgacttctagctatgtccatgatgagggcaaaattcttaatctactcaaagatctatagtcctgacccaagacatgacatagcacattgtgtgaagcattgaaaccatttaggttttctgtaatctgctgagttgtattgaactcctgaaatgctggagttggaaaaaccctaaaaatagcaaactgtttcacaaaattatgcagaattaactgcaggagcttttgaaaatcaaagattcttgggtctcatcccaggcctgttgaatcagaatcttcaggagaataaggcatttttccagtgttctgccaagatgtatatacggggctgggcacagcagctcacgcctgtaatcccagcactttgagaggctgaggcaggaagattgcttgagcccaggagttcgagaccagcctgggcagcatagcaagagtccatctccactatttaaaaaagaaaaaaaaaaaaacctggccgggcatggtggctcaggcctgtaatcccagcactttgggaaggctgaggtgggtgaatcacttgaggccaggagttcaagaccagcctggccaacatggtgaaatcccatctctactaaaaatacaa

SEQ ID NO: 120529 - DNA, 170 bp, Homo sapiens
ggtctgtgtccccactcaaatctcatgtcaaattgtaatccccaatgttggaggtggggcctggtaggaggtggttggatcatggggatggatttcccttttggtgttgttttcatgatagtaggtgaattatcataagatctggttgtttcaaagtgtatagtacctct

SEQ ID NO: 120530 - DNA, 577 bp, Homo sapiens
tttaggaatttacactcagacagatccatataaacactaaatgatatatatttacaacactactcactatagcattatttgtaataccccaaaataaattatggtatgccactcaatgggatacaaggcaccagtaaaaaagaatcaaggtattttatatgtcgtgaactgaacaattgccgagagataatactgggaaagcaagtgtgctcatgctgtattactgattgtgtaaaaaaagaggaatacaattcgcctttgtaagcataaaaatgtctctagaaggatacactaataactggtaaaattagctgcttcatggaaccattagaatagaatgtcaaggatcagaggggagagaggcttcacttatactaatttatatcttttaaaacagaactgcaggaatgatttccctgttaaaatttgtttatataacataaggctattactagcccttctcggggctgttgtaaggatcgagtcagaaagcagatgtaaagctctgcacacagcaccagtgctcgcttattgctattttacaagggggagaagttcagcaagaccagcctgggta

SEQ ID NO: 120531 - DNA, 375 bp, Homo sapiens
ggcaggaggagggaatggcgggagcagatgtacagagacagtgacacccaaggcatggttggtaattgcaggccgactgtgactggatcgtgtgatatgtcaggatgcaaagagactgaaaaggtaagttggggccagatggtggagagggttgaatttaagctatgttaaagggatcagatttatctatagtaggatgatctcatgttcccatttcccagggtagttttgcctgttgtcccagggtgattattcatggtggcccctttcatgctcaagtatccctgtttggataagttatgtggtcctgcaaccctaaaggctttgtggaacccccaaaggtttcacagagggacagggtcaggctagccttga

SEQ ID NO: 120532 - DNA, 214 bp, Homo sapiens
ctcaacctgtcatatattaccccataaatatgtcttaatattatccatctttagaaagaaaaaaacactctgatacatcctacctccatctctacttttttatcccccattctctgtcaacctgtctggttgattttctccccaccatatcactgaagtgagacttataacatttctagtgacctacttcttgccagtggtctgagggttcttt

SEQ ID NO: 120533 - DNA, 238 bp, Homo sapiens
catgtgtcctgtcctccgggagttgcaatctagttggagaggtgagacccacctgcagggaggttgagctgtgaccactaggagtgggagggacaggatgtgcccaggggttgacagcagggcctgggtgcttccctgtaggatctggggaggtggcatctgggggtggctgccgtcttgcgggggctgccggcagcccccgcaagacgaggaaatagaaaccgtcttgcgggggctg

SEQ ID NO: 120534 - DNA, 1074 bp, Homo sapiens
gggctggtgtattccaggtgcccaggagccactgagaacagaagacttgttgctgctctagaggacctatggtagggcagacagaggatgatacagctcagcagcttgtccctacgtgtggcatgaaaggtgttggagagagaatagtggagtatgtgtccaacattccagcacttcagagagctacccccaagggactggcttctgtttcacctgacttggagcacaggcaggagtggacatactctaaaagcccactgatgggaaagggcaccaggttggaggcctctgaaaacaagagagctgggtggcttgcagcagctccagagaacctgaagtaccacagacagatagcacagggagcaaaagattatgagatcctgaaaaaggaaacgaacaagttcatcttgagaatttatacacactggtcgagaagaagcatcctcaggaaaggttcaaaaggcatgcagaatctctagtcaggccgatcagtgaggatctttctctgtacagagccagaccacaaagactgggaggggtgatattttttcaaatgcttggatcccaacatgatgttaaaagacacacaaagaaatagggaaacatggcacaatcaaagagtcaaaatatccaggaacctactttaaggaaacacagatatcttcattatctcagaaggaattcagactaaccaccataaacatgttcagtgacccaaggaaaatgctgcatgaacaaaatggtatcaacatagagattgaaaacgtaaaaaggaaccaaacaaacattgtaacagatgcaatatgcttctttgaccaaattgaaagatttactagaggagtttagcagcagtgtttttcaaggagaagaattagtgaacttgaagccaggtcatttgaaattatccagtcagagaagcaaaaagaaaaaaaataaaaaaagaatgaagacagcctagagtactaatgggacagcatcaattttatcaatgtagattgtatggaagttccatatgttggaaagagaaaggagcaaaaagcttatttgaagaaatactggccaaaacttcccaaa

SEQ ID NO: 120535 - DNA, 556 bp, Homo sapiens
gggctggtgtattccaggtgcccaggagccactgagaacagaagacttgttgctgctctagaggacctatggtagggcagacagaggatgatacagctcagcagcttgtccctacgtgtggcatgaaaggtgttggagagagaatagtggagtatgtgtccaacattccagcacttcagagagctacccccaagggactggcttctgtttcacctgacttggagcacaggcaggagtggacatactctaaaagcccactgatgggaaagggcaccaggttggaggcctctgaaaacaagagagctgggtggcttgcagcagctccagagaacctgaagtaccacagacagatagcacagggagcaaaagattatgagatcctgaaaaaggaaacgaacaagttcatcttgagaatttatacacactggtcacacattccaactcttttgtctccccaaggagaagccaagagttgaggattttctcctgctggtttcatgctgagggagggggagggatcgatggtgagtgcctgctaatctaaactgtgtcgagc

SEQ ID NO: 120536 - DNA, 422 bp, Homo sapiens
aaccgagctcttaccccgggtgccgaggccgaggctgtgcccgtgcagcctcttcaggcgcagatcttgatctccagtcggcctttgcagccccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagccccttggccttgtggctcaggataagtttgattagcttgaaagatccaactggacacagggcaccaaatcactaccaatgaactaaacacacatgcttgcacac

SEQ ID NO: 120537 - DNA, 406 bp, Homo sapiens
taggaaaaaattatagtatggtacatagttcccgacccatttctttctgtcttctgcttccttgaaatgggcttttgcattaatttggtatagatgaatttttcttttctccctttcagaattacctagggattgttttccttccctagctcctgtttgagagccaggtatttcaagtgcattatgttctgagcccctatgaggaaaggaagagcacagctgggatttgggcagcagtgatgaaaggatctgagctctgtactttctcaggttattcttcacatattttgtgtcaggatcactccctcttgtcatgggaagtattctttttcaaagaggatatccctgaaatttgaatgattgctcccatttcagctacaggacctgatgcaccattgctatcaga

SEQ ID NO: 120538 - DNA, 638 bp, Homo sapiens
ccgacgcctttgaaatgttgatttttcggcagaaattcctcatgcttcacattactcagataactcaggactcttttagacatcagcagtgactttgaaagatcggttcactggctttagatcacctctgcttctaacagccttggaggtatagcttttcttcctatccagatgttctgagaccacagaaaacagggtatgttattgatggttcgttttttttttcacactttcaatggagttttgttttgtttgagcgacgcattacactttgtatacagaaatatgcatcattgaataatatttatcttactgcaaatgttgccatctgtttatcatggaaagtgttaaaatagataaataaaagtagaaataatatacgtaggtatagatatgtttgtaatatgaattctaatatatctatgtattcactttccttccggtcttttcatactttagacgttctcttcagtttatcaattcattttttaaaaatcttccagaagggtgggtggtcaaaggcttgctatttttcacctaggaagccagccatggcgtaagttcttatttactggtgactgttcaagtttgattcatggttttaatagaagaggaaatttggtggcttgagttaaagc

SEQ ID NO: 120539 - DNA, 408 bp, Homo sapiens
cgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattag

SEQ ID NO: 120540 - DNA, 434 bp, Homo sapiens
gaatcaactggaatgtggtgaagtggagaacagaggggtggaatggaattgaatgcagtggagtgcactggttttgaatggagtggaatggaaagagaagaaatataattgaatggagttgagtggagtggagaggaattgaaaagcaatggaatggaatagaatggaattgattaaaaccgagtggaatggaacggaatggaatggaatggaatggaatggaaacgaatggcatcgaataaaatgtggtgaagtggagtagagaggagtggaatggacgggaatggaatggtgtggaatggaattgaatggagtggagtggattggagtggaatggagtagagtggaatgataatgaatggaatttaacggagtgcagaggagtggagaggaatggagtggaatggaatggaatgggaaggaatggaattgaa

SEQ ID NO: 120541 - DNA, 338 bp, Homo sapiens
gattaggaagtagggctttaaggtagtgattcagtcatgaagggagagtgttcacgaatgagtttaggatccttacacaaggactggatggagtgggcttcccctgttttgcccttccaccttctgccatgtgaggacacagtgcatctcctcctgaagacacagtgcacaagataccatcttggatgcagagaccagaccctcaccagacaccaatcctgctggcaccttgatcttggacttctagcctatggaactgtgagaaatacatttctgttcttcagaaattacccagcctagtgtattttctatatagtagtacaaactcattaaggcac

SEQ ID NO: 120542 - DNA, 489 bp, Homo sapiens
ggagaccttgaatcaggatggccaaagatttttccaacctgggccagtggttcacaggagcctttgggtatcgaatgtccatgtcattttttggccttgcttttttagctttgcagttcaaaggggatcccgttttcaaaaataaaattaggttaaacccccatttatggaacctttggttatgggtcccaatcccagtgaaatttttataactcctcacagggaactcctcacaagacgccaatgtgcaaacagggttggcaaacggtattttagctgattttgtcccccagctatgactgtgtgagagtgaagacccagattttcatgtatcctgaagttaaaatttatccaatcctgtttacccaactggaaattacaaactgaaaaaaattgtccctttgaaggattttttttttttttcagaatcagaaatgtttcaaaaaaaaaaaaaggaaagcctgataaaaaaaaagccttgaaagggta

SEQ ID NO: 120543 - DNA, 797 bp, Homo sapiens
aaagggtccatagctttcactagcctcctaaatggggttgatgatgctaaaaagttgaaagccagtactttagagttgaaaagttggattcaatgatgggaatagattgattgtttccaaaagggttctcttaatatgtctgaatagtaattgctgtgcttctttgtgtagtaaaattcttaatgtggcctgatagctgtacagaacatttgagattgggactgaaaatcttggacatatgtccctcggtagccattagattatctaattgccattagtgttaaggtgagcataaagcaaattattaactgcatggccctaagaaagtcaccttatctcatgggatctgttacctcatttataagacatttttaaaaggaggaatgtgaccttgaagatttccaaaactcctagtttggattctctagaaaagtgagatcaatgctggacttggatggagcccttttgtggcagaaatgaaccaggctttgcatagaaggaaaaagacagagtgtccaaatgaggaagaggcccagaggatccaagaagcctcttcctccataaatgggaaacacaagcctgctgtggcaaagagccagtgtaatcagggcaggatgagggctactgtgacactttttaacatccaggactctgagggaacagaggctcaacctctacttttcaccctgggactgacttgccagaacacaagttgtccctcagtgagtgaatacaccatctcgcctgcactaagaacttctgattctcataggagaaaatgctttgggtcttcccac

SEQ ID NO: 120544 - DNA, 328 bp, Homo sapiens
ggatgggaaggacctttctccaggcggatgctggctgtggtgtctacccaaggccgagctctgacccgtctttggggctgtcggtctgagttttccccgtgcaggtcggcatggctcaagtgcacagcccctccatactcatcagcaactcgatagaagctacttaggttgttgcttaaggggcccatggtctctccttgaaggtattctaagtggtcctcctaggctgagccaggttgccaggtgcccagagccaatccgtgtggctcttgacagaactcctgttctctgtgtgaagctccgggcggggaatcccggtctgacccag

SEQ ID NO: 120545 - DNA, 389 bp, Homo sapiens
gcctcccactggtggggcctcactcaggtccagcagtgagtttgggcacatggagaggaagtttcaactctgtacctgtcctggtgacatgggaaaggagcgtttcattcctgttaaatatgaaccattaagcccaataagctcattagaccatgggtgataatcttcttcatactttcctctgttatctgaatcgtaaaacaaccctactaattataatattaggcagaggcacttataacccagtaagcatatggaaactcttctactggggagacaggcaaacagcgaaaacttgcatggctaatatctttgcatgggaaacttcagatctcaaatcatgtctgcctcagtctagagtaaccaccccaaagcagagatagagacaa

SEQ ID NO: 120546 - DNA, 929 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagacgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacaggtgtgtcattggctctgccatcatgacaga

SEQ ID NO: 120547 - DNA, 444 bp, Homo sapiens
gccaggccagaacacagagacagcgtggtgttcagaaactctcacaagaaggaccattaccagcgccttcccactaaggatcattaactcacttcctctttctggcttcctgaattaggtatgggagaatttgcccacaccaggggcaaaaatgaagatggatcgaaggtggattttgctgggtaaaatgagaggcagttcccttctcacacagtcacataaagtggttccagggtcttcccaccaggaaagcaacaagggagatcaaggaggatctggcctggccactggaaggcccagttccagcctcagtccactgagcagcctccatttcctcatctgtaagatggaccaaatgcctctggaatgagatgtgaagtctgttccagctccaaccttctatgtccctgtctcttcctctccccagcgtgctgcaggaagata

SEQ ID NO: 120548 - DNA, 769 bp, Homo sapiens
agcggactctctgcatcatgctgctgctgctacaggatgggagaatggtggtatcagtgattcaagactgtttttcctacatcttcagtgcctttttcaatgctgtggagttaaaaccagcataggtctttctctgtgcttacctgctgggatccactatgatgtctaccactgaggctgttcctcctctcaagactcaagaccctctttacttcttttaactccactagaggaaggacagcagtaaaatgttcaatgccgtttgtgtctgttcttggcagtgacattcagttctctttataaaacaagggagtagaaagagagtagaagtgacatcttcacacacacataccgtttgctagatttgtcaaacagctgatttcaaactgttaatatgacacagaatcaatttttttgagtcaaacttttcattatacaatagaattgaaaagttaatatcagaataactgtctgttagtaagattttatttaaaaaatttggttgcatacacacctaaacattcacttacattgttatagcatatgacattgtgatgtaaaatatatttcttactctagtcacggtcataaacgatcgaaagccatgacttaagggcattatttagtgctgagctgtctaatatggtagctattttatttaaatgtaaatgaattaaaattacataaaattaaaatcagtgtcttaaccaaagcggccacatttaattgctcaataattacttgtggcaactttattgtatatcttggg

SEQ ID NO: 120549 - DNA, 301 bp, Homo sapiens
ctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatgga

SEQ ID NO: 120550 - DNA, 355 bp, Homo sapiens
ggtagggccctctccagcaccctaaggacagtgcgttgaaccccaggccagtcagcccagcgggaagagctgagaagggaccagaggccagtgagggaggaaagacccacagtcctgcagggcgcagagaacccctaagggctggctcctccagacctgcaggagaacaggaaggagagaggcaggagacgtgagcctgcaacagagctgactcaggcaggggcgggatcctcccggtcaaggggaggagaggagggctcctcagaagggggaagtagcgtcagtaaaggagaggcggggacgggatggaggctcttctgaagcaagcagcagatccatgctggaagggtagggt

SEQ ID NO: 120551 - DNA, 396 bp, Homo sapiens
agttctgactctggacagaggtgggaggctgggtagacagagggtggcaccgggtcacctgagccccagagcagctttgcttgagcccaaagtcacattaaatccctttgaggagttcccttggcttctgtctctgacttctctctccccaggggctcagaacccaccaggggaacctggggacatccacacccccctccccacatatttctttcactatctctgcccccattcctcacctaaaattccctcccccttgaaaattaccttgtaggctgggggcagaggcttacgcctgtaattgtagcatcttagtaggttgaggcaagaggatcgcttgagcccagaagtctgagaccagcctaggcaacatagttttctctattttttctctac

SEQ ID NO: 120552 - DNA, 322 bp, Homo sapiens
ccgtgtagtgaggcaggcatttcacaccttaattgctttaacgtcttgaaaggtgaaaggtgacctgtgagtctaaacagttggaaaatttagtgtgcatatttgaaatgctttacataaagttgaaacacttcacagtctccttgattaatttctttgttgccgtgctgctttgtattaatttaatttagtgacttttatgtgaaagtaaatatgtaagtcagtggcattatgtttattagattattttcctttaatattttaagcagactaaatgcggcttctgtcaaatgagtctttaataaataaattgctgtctgtg

SEQ ID NO: 120553 - DNA, 98 bp, Homo sapiens
cgcgcgcggcggccgcggcgccggctccgccgggagcgcacgtgcaggcgccgggcggaggagagggaggcgggagccgggccgcgggaggaggggag

SEQ ID NO: 120554 - DNA, 235 bp, Homo sapiens
tgcagccttaacctcctctgctcaagcgatcctccctcttcagcctccttcagcaggcaggagcagaggaattacggaggcggttgctaattttttacatcggggttagggaaggcctccctggtaacaggagatttgagcagagaccggaaggaaggggagtcaactgtgtcgatcgtatctgagatgagaaagttctaggcagagggaacagcaagtacaaatgattgcaatg

SEQ ID NO: 120555 - DNA, 498 bp, Homo sapiens
tgcctgagcctcccaaagtgttggaattacaggtgtgagccactgcgcccggccaggaaaacatctttaaggagggatgtgaacttggctttgaagaatgggtgggatttggaaaggtaaaaggaaatagggatggctttacgtaagagaatgaatgagagcagaaacataaaaggggagaatttagtatagttattcttgggacagtgagtttaacaggttggccctccttcccatgtgggaggtaagatttgttaggactttctaggaagggtgttaaaattaccagttgctgtagtttgaggtttaaatactgagtaaaagagagtgaaattgaagttttgatttaaaaaaattgtgtcatagaaattaatttgtaatatggagtggagaaagatataaagagtttgggaatccagtaagaaaagtgttgcatgaatacaggttcaagttatataagacctggtgatgtgataccatgaagaccaaaaaaaaaaa

SEQ ID NO: 120556 - DNA, 204 bp, Homo sapiens
gaatgtgcagcgtcactggagagactggtggtggaaagtgcttgccacaacaagcgagccacttgcgggagacaggatgaaactggtgggggatgagagctgtatcctactgacttgcagaagcagctgcaggcctgctgggcagactgccaaaggcaggcaacagcagcagtggaaggccaggtctggtcactgccccatcat

SEQ ID NO: 120557 - DNA, 245 bp, Homo sapiens
gtctccagcctcatcctgtgaatagctcctcttctgtttccctctgactaggccttcagctgacttctttgctggaattttctaatcttgtgacagcagggaaaagctggatgtggtccatctcttaacacagacactcctccctgtcttgaccagctacgtattccactgaccagcctcatcatctctgccctcaacagtggaaatgatctctttcccacagatgttctccctccctccttcct

SEQ ID NO: 120558 - DNA, 267 bp, Homo sapiens
aaagaaataaggtattttacataaagattaaaaagaaattaaaaccattatttgaagataatggcttaaacagaaactctgcaaatccttagaataagaaagttcaggccaggtgtagtggcttgtgcctgtaatcccagtgcattgggaggctaaggtcggaggattgcttgagcccaggagtttgagacaagccgggtcaacataatgagatcgcatctctacaaaaaattgaaaaatgagccaggtgtggcagtgcatgcctgt

SEQ ID NO: 120559 - DNA, 455 bp, Homo sapiens
attattattcccatttcacaggtaacaaaacaggttaaatttattattcatacacttaacaaatattgaacatcttgtatgagctaggctttattctagaaatttggtattactaattttaaaatggataaaattcctatcctcgtggactgacattctaataagaaacttctcatttattacaagacataagaaattagtaattaaaattatatgttagaacttgatacattctttagaaaaaaagaaaaggtagaacagtgtaaggaagatctgactgctggagtgacagcagggaaagtgtagcaatattactcatgtcatgtttctggcttaaattctactttatctgcaacaggattccatccctgccttcctgtgtattatcttgtctgttaaacctttgctcattcctttatgtttagctttttgaatcattgtgttccaagtttgtc

SEQ ID NO: 120560 - DNA, 454 bp, Homo sapiens
tgttgaaagggctgtgagagattagctagtccaatcccattgatttacaaaggaagaaataaagttcagggaggcttacccaaagttatataattaatggaggaaccagaagtagaatccaaggtcttctgctgctacaatgtaatactttctccataataccagtctgtccccgcttagacccccctagacttttactctaagagctccattaggattttgcaaacacgtagtgaacctaaattggatagcaatttctggctgccaatcctgctacattttaggtgcatgcacatgcgtgcagggggagtgcatttcatgtcattatcattcaggaagaaaggctttggctgtcaagaggtgctcagtgatgcaggccctttctgttttggcctttaagggcctgattgctcccagctcccagctggttatgagagtgtgaattctgccatcc

SEQ ID NO: 120561 - DNA, 633 bp, Homo sapiens
agcgggaagggctcatctgacttctggaaacctatgttaaaatacagtgctttgaaccttgatcatgggctaattaggttggaaatgaaactagagaccagatacacccaaggaaacttttggtagttattttactttataagtcacaggaaatgcttgtgtactttcctgtgttccttaaatagttgcacttaaattacctctttgaaactgaatgaagagacagagagtattttttttctttccagaaataatacttgtttatacctgtaatagcaatgaaattttgtttcttttgagacagagttttgctctgtctcccagtctggagtatagtggcaggatctcagctcactgcaacctccacctcccaggttcaagtgattctcctgcctcagcctcccaagtagctgggactataggtgcactaccatgcccggctaatttttgtatttttagtagagaaggggtttcgccatgttggccaggctgatctcgaactcctgacctcaggtgatctgcccgcctcggcctcccaaagtgctgggattacaggcgtgagccactgctcctggccagcaatgaaacttgaggctatgcgaatgaaggattgttctaagagtgtaaactata

SEQ ID NO: 120562 - DNA, 5768 bp, Homo sapiens
  misc_feature (179)..(179): n is a, c, g, or t
  misc_feature (339)..(339): n is a, c, g, or t
  misc_feature (4757)..(4757): n is a, c, g, or t
cccagacccgcccccacttcccccctcaccctcccctccggcagcctctcccatggccactgctgcgggctgtgagcagagccccgtccttgagcagattgacctcatctttcagtcctgcagctgggctgagcggggagtcagctcagaagacactggcctggggatgagactcgggncatgcttcagagggaagaaagagcttctgaacagacaatgctgtcttaaaggtggcatcttggtgctttctcatgccttgttttctttcatcctcagaatgtgtctgggggtgagaggacgggtgtgactgctgaaacttcctttcttggtgattccacntcactcctttctgatccctgagcctgtgccacgccctgtgtgatgtgccggggacaccagggtgaatacttacaggccctgttccccttccttcatgaaacagcctccttcgggctgggtcactgggcactggggcctccctggtcttccaggattgcaacttcacagaatcccttttccataaggcacatgaaagtgactgtgacccgcaacgggagccttgacaaccagccaattcagaacacagaccttgacatcggaaggccccgagttcaaatcctgccttgctccctttcagctggaaagctgtggtcaaattacttagcctctccaagccagttttcccttctgcaaaatgaggttacacaagctgccacctcacagaatgagtgtgagaattaattcttattttccacaccctcatttgacagggggagaaacagaagcccagagagggaaagggcttggttaggatcacaccatgagttgggggttaagtcaggatggggtaggtcccctctttctctgggtgttcctctcccccatcccttatctcaacataaatcctccccagttgcccaggttgtccaggcgattcctggcacacgtcctggggcctgccctccacctttagccctgctctggcttctgcagcagcagagtcctgggtgaccagcagtggcccctggccctctgagtggtggtggagggtgggggtgcactgcagcaagctcccagcccagagcagcctggccatataagggaaggagctcagggaggcctcctggctcaggcctggcgagaaaacccagacagccactgtttattttctcctccccagctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtggggtaagtggaatggggtggggggggggcggggtggccatagacccctcttctcagtaaggccctcatgtgaaggaggcaggggttgggacaagtgctaagtatgcaagactcaagggaagagctgctggagccaggagaagcacctccctcccggcccctctgcccctcctcatagcccagctgcactgactcctcctccaggaagccttctcagcttccccaggggtgggaacctttttgtcctccaggtgtgcttggctgtcctttcttgggctctctctctctctctctcctcatcccacttgagtctgccccctattcaccttgtgaggggaattttccttctactcaatctgaccgaggtcctccaggtcaaggacagcgaggctctcagtcccacttccccttggcacatagaagaggcagtgcgctgaagggacaggtgaaatgattagaccctgcccccaaaccaaggcctggccaattggacagggcatgagacattcagcgtagaggttaaaacgagggccctgggttaggaaccccagctcagttctcagctctgtacccttggaaaattcccttcccatggagctttgtggatgcacaaggacttgcacaaagaaaacattcaatatccaggactataaaattccacaaatgattgtgcttattacattcattatcacgatgattattccagacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcccagcagagactacaaactccccaaaaccacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaatagaccagctgtctgtgacctgcgagggagtccaatgtcggaatcactccccagccaaatgcacggttttaaaaaatctatttatttatttatgtagagaccaggctatgagactggctaatttttcgtatttttggatagagacaggatttcatcgtgttgcccaggctggtcttgaactcctgggctcaagcgatccacctgcctcggcttcccaaagtgctcaggattacaggcgtgagccactgtgcccagccaccaaatgcagttgaaaagagtttctgcaagataattccacagaagaggaaagcagttatctggctgggaataccttagacagaggctgtcctctacacaggctgtcagaactgacctactgacctgcctgctggcatgatagaccagagggaaacactctttccactcttcccagactgagtgtaagagacagacttttttttttttttttgagacggagtctcactctgtcacccaggctggagtgcaatggcaagatctcggctcactgcaacctccacctccccgggttcaaaccattctcctgcctcagcctcccaggtagctgggattacaggctcccgccaccacgcctggctaatttttgtatttttagtagagacagggtttcaccatgttggccgggctggtctcgaactcccaacctcaggtgatccgcctaccttggcctcccaaagggttgggattacaggtgtaagccactgctcccagccttttttttttttttattagagacaagggctccccatgttgcccaggctgatcttgaactctaggctcaagcgatcctcctgcctgagcctcccaaagtgctaggattacaggcatgagcactgctcccagctctgtttttgtttttttaaggaggtatattttttctgttctctctcagccctgaagaaaggctacccatccccttcagacattcctgaaaatatatgtcatccaacatcaaggccaccacagtgaccactaagcaatgcaagaaggtcctctggggtgccctgagatcttggcagggcaggaagagtgagaaggggctttgcctgctcacctgaaagttcccacccaagccgggcccagaaaacaaaatgaattatctacatggtcatccaatcagccaccaaatggcattacctaggtccatcatcatgtaccaagccacaggtcagacccagggccccccaaattaacaagacacaggcactgtcctcaggaagtggagatctagccaggtcagacccacacacaaataacactgatactagagataatgagattgggaattatgattcagccattcaacctgggcttatgtggcatctacaccacctggccctgatttcagtagtgagcacagttgacagggtcccttcccttcacaggtgagccatgtagtccacaagtggaggtggtcgtaagtgaaaaccacattaccagcatggtaaagggttagaaagagggcaccgggtgggngagaacatgaagcagggggtgctgatggctaaagaagtaaaggaggggctgggcactgtggttcatgcctataatcccagcactttgggagaccaaggcgggtggatcacctgaggtcaggagttctagaccagcctgggcaacgtggtgaaaccctgtctctactaaaaatacaaaaattagccaggcatggtggtgcacgcctgtagtcccagctacttgggaggctggggcatgagaattgctttaacccggaaggtggagtttgcagtgagccgagatcgtgtcactgcactccagcctgggcgacagagggagacctgtctcaaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgaggacaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcac

SEQ ID NO: 120563 - DNA, 3659 bp, Homo sapiens
  misc_feature (179)..(179): n is a, c, g, or t
  misc_feature (339)..(339): n is a, c, g, or t
cccagacccgcccccacttcccccctcaccctcccctccggcagcctctcccatggccactgctgcgggctgtgagcagagccccgtccttgagcagattgacctcatctttcagtcctgcagctgggctgagcggggagtcagctcagaagacactggcctggggatgagactcgggncatgcttcagagggaagaaagagcttctgaacagacaatgctgtcttaaaggtggcatcttggtgctttctcatgccttgttttctttcatcctcagaatgtgtctgggggtgagaggacgggtgtgactgctgaaacttcctttcttggtgattccacntcactcctttctgatccctgagcctgtgccacgccctgtgtgatgtgccggggacaccagggtgaatacttacaggccctgttccccttccttcatgaaacagcctccttcgggctgggtcactgggcactggggcctccctggtcttccaggattgcaacttcacagaatcccttttccataaggcacatgaaagtgactgtgacccgcaacgggagccttgacaaccagccaattcagaacacagaccttgacatcggaaggccccgagttcaaatcctgccttgctccctttcagctggaaagctgtggtcaaattacttagcctctccaagccagttttcccttctgcaaaatgaggttacacaagctgccacctcacagaatgagtgtgagaattaattcttattttccacaccctcatttgacagggggagaaacagaagcccagagagggaaagggcttggttaggatcacaccatgagttgggggttaagtcaggatggggtaggtcccctctttctctgggtgttcctctcccccatcccttatctcaacataaatcctccccagttgcccaggttgtccaggcgattcctggcacacgtcctggggcctgccctccacctttagccctgctctggcttctgcagcagcagagtcctgggtgaccagcagtggcccctggccctctgagtggtggtggagggtgggggtgcactgcagcaagctcccagcccagagcagcctggccatataagggaaggagctcagggaggcctcctggctcaggcctggcgagaaaacccagacagccactgtttattttctcctccccagctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtgggacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcaaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgaggacaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaatgtcctccttctaaattaagctgttcttgacaagaaaaggaaagaaacaaagaaaagaagagaaaaaaggtcaaggtttggtcctgggtgctcaaatggcaggccacagacaggaaacacagttgtgaggaattacaacagcctcccggccagagctggagaggtggagcccaggtcccctctaacaccccttctcctggccaggttggagtcccgccacaggccaccagagcggagcagcgcagcgccctgtctcccagcctgaggtgcagtgctgcatctctggtcagttgggagtctgagatgaagcactgtagctcaggaagagagaagttgttctgcagccatcagcctggaagtggtaagtgctggggggttgtggggggccataacaggaaggacagagtgtttccagactccatactatcagccacttgtgatgctggggaagttcctctacacaagttcccctggtgccacgatctgcttcacgagtctgggcatgtcctgactcctctgtgtaccccagtgtgtccatcttagcatgaggcgttagcatttccccagcaccctgcctctgctttctctttctgagcccatggcagacacagctaatcagtaaaggcatatattctttttttttttgagacacagtctcactccatcacccaggctggagtgcagtg

SEQ ID NO: 120564 - DNA, 2421 bp, Homo sapiens
ctcggctctaccttgtctcatgcctggccaattggacagggcatgagacattcagcgtagaggttaaaacgagggccctgggttaggaaccccagctcagttctcagctctgtacccttggaaaattcccttcccatggagctttgtggatgcacaaggacttgcacaaagaaaacattcaatatccaggactataaaattccacaaatgattgtgcttattacattcattatcacgatgattattccagacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcaaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgaggacaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaatgtcctccttctaaattaagctgttcttgacaagaaaaggaaagaaacaaagaaaagaagagaaaaaaggtcaaggtttggtcctgggtgctcaaatggcaggccacagacaggaaacacagttgtgaggaattacaacagcctcccggccagagctggagaggtggagcccaggtcccctctaacaccccttctcctggccaggttggagtcccgccacaggccaccagagcggagcagcgcagcgccctgtctcccagcctgaggtgcagtgctgcatctctggtcagttgggagtctgagatgaagcactgtagctcaggaagagagaagttgttctgcagccatcagcctggaagtggtaagtgctggggggttgtggggggccataacaggaaggacagagtgtttccagactccatactatcagccacttgtgatgctggggaagttcctctacacaagttcccctggtgccacgatctgcttcacgagtctgggcatgtcctgactcctctgtgtaccccagtgtgtccatcttagcatgaggcgttagcatttccccagcaccctgcctctgctttctctttctgagcccatggcagacacagctaatcagtaaaggcatatattctttttttttttgagacacagtctcactccatcacccaggctggagtgcagtg

SEQ ID NO: 120565 - DNA, 3746 bp, Homo sapiens
  misc_feature (179)..(179): n is a, c, g, or t
  misc_feature (339)..(339): n is a, c, g, or t
cccagacccgcccccacttcccccctcaccctcccctccggcagcctctcccatggccactgctgcgggctgtgagcagagccccgtccttgagcagattgacctcatctttcagtcctgcagctgggctgagcggggagtcagctcagaagacactggcctggggatgagactcgggncatgcttcagagggaagaaagagcttctgaacagacaatgctgtcttaaaggtggcatcttggtgctttctcatgccttgttttctttcatcctcagaatgtgtctgggggtgagaggacgggtgtgactgctgaaacttcctttcttggtgattccacntcactcctttctgatccctgagcctgtgccacgccctgtgtgatgtgccggggacaccagggtgaatacttacaggccctgttccccttccttcatgaaacagcctccttcgggctgggtcactgggcactggggcctccctggtcttccaggattgcaacttcacagaatcccttttccataaggcacatgaaagtgactgtgacccgcaacgggagccttgacaaccagccaattcagaacacagaccttgacatcggaaggccccgagttcaaatcctgccttgctccctttcagctggaaagctgtggtcaaattacttagcctctccaagccagttttcccttctgcaaaatgaggttacacaagctgccacctcacagaatgagtgtgagaattaattcttattttccacaccctcatttgacagggggagaaacagaagcccagagagggaaagggcttggttaggatcacaccatgagttgggggttaagtcaggatggggtaggtcccctctttctctgggtgttcctctcccccatcccttatctcaacataaatcctccccagttgcccaggttgtccaggcgattcctggcacacgtcctggggcctgccctccacctttagccctgctctggcttctgcagcagcagagtcctgggtgaccagcagtggcccctggccctctgagtggtggtggagggtgggggtgcactgcagcaagctcccagcccagagcagcctggccatataagggaaggagctcagggaggcctcctggctcaggcctggcgagaaaacccagacagccactgtttattttctcctccccagctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtgggacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcccagcagagactacaaactccccaaaaccacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaatagaccagctgtctgtgacctgcgagggagtccaatgtcggaatcactccccagccaaatgcacggttttaaaaaatctatttatttatttatgtagagaccaggctatgagactggctaatttttcgtatttttggatagagacaggatttcatcgtgttgcccaggctggtcttgaactcctgggctcaagcgatccacctgcctcggcttcccaaagtgctcaggattacaggcgtgagccactgtgcccagccaccaaatgcagttgaaaagagtttctgcaagataattccacagaagaggaaagcagttatctggctgggaataccttagacagaggctgtcctctacacaggctgtcagaactgacctactgacctgcctgctggcatgatagaccagagggaaacactctttccactcttcccagactgagtgtaagagacagacttttttttttttttttgagacggagtctcactctgtcacccaggctggagtgcaatggcaagatctcggctcactgcaacctccacctccccgggttcaaaccattctcctgcctcagcctcccaggtagctgggattacaggctcccgccaccacgcctggctaatttttgtatttttagtagagacagggtttcaccatgttggccgggctggtctcgaactcccaacctcaggtgatccgcctaccttggcctcccaaagggttgggattacaggtgtaagccactgctcccagccttttttttttttttattagagacaagggctccccatgttgcccaggctgatcttgaactctaggctcaagcgatcctcctgcctgagcctcccaaagtgctaggattacaggcatgagcactgctcccagctctgtttttgtttttttaaggaggtatattttttctgttctctctcagccctgaagaaaggctacccatccccttcagacattcctgaaaatatatgtcatccaacatcaaggccaccacagtgaccactaagcaatgcaagaaggtcctctggggtgccctgagatcttggcagggcaggaagagtgagaaggggctttgcctgctcacctgaaagttcccacccaagccgggcccagaaaacaaaatgaattatctacatggtcatccaatcagccaccaaatggcattacctagcgcctataataggcgtctaggtttgct

SEQ ID NO: 120566 - DNA, 2563 bp, Homo sapiens
  misc_feature (179)..(179): n is a, c, g, or t
  misc_feature (339)..(339): n is a, c, g, or t
cccagacccgcccccacttcccccctcaccctcccctccggcagcctctcccatggccactgctgcgggctgtgagcagagccccgtccttgagcagattgacctcatctttcagtcctgcagctgggctgagcggggagtcagctcagaagacactggcctggggatgagactcgggncatgcttcagagggaagaaagagcttctgaacagacaatgctgtcttaaaggtggcatcttggtgctttctcatgccttgttttctttcatcctcagaatgtgtctgggggtgagaggacgggtgtgactgctgaaacttcctttcttggtgattccacntcactcctttctgatccctgagcctgtgccacgccctgtgtgatgtgccggggacaccagggtgaatacttacaggccctgttccccttccttcatgaaacagcctccttcgggctgggtcactgggcactggggcctccctggtcttccaggattgcaacttcacagaatcccttttccataaggcacatgaaagtgactgtgacccgcaacgggagccttgacaaccagccaattcagaacacagaccttgacatcggaaggccccgagttcaaatcctgccttgctccctttcagctggaaagctgtggtcaaattacttagcctctccaagccagttttcccttctgcaaaatgaggttacacaagctgccacctcacagaatgagtgtgagaattaattcttattttccacaccctcatttgacagggggagaaacagaagcccagagagggaaagggcttggttaggatcacaccatgagttgggggttaagtcaggatggggtaggtcccctctttctctgggtgttcctctcccccatcccttatctcaacataaatcctccccagttgcccaggttgtccaggcgattcctggcacacgtcctggggcctgccctccacctttagccctgctctggcttctgcagcagcagagtcctgggtgaccagcagtggcccctggccctctgagtggtggtggagggtgggggtgcactgcagcaagctcccagcccagagcagcctggccatataagggaaggagctcagggaggcctcctggctcaggcctggcgagaaaacccagacagccactgtttattttctcctccccagctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtgggacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcccagcagagactacaaactccccaaaaccacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaagatcgtgagagaggaagatgtccg

SEQ ID NO: 120567 - DNA, 3037 bp, Homo sapiens
  misc_feature (1336)..(1336): n is a, c, g, or t
acttgaggatcccggcaggaagactaattgtatccagtgtcaaatcaggattacaggcgtgagccactgtgcccagccaccaaatgcagttgaaaagagtttctgcaagataattccacagaagaggaaagcagttatctggctgggaataccttagacagaggctgtcctctacacaggctgtcagaactgacctactgacctgcctgctggcatgatagaccagagggaaacactctttccactcttcccagactgagtgtaagagacagacttttttttttttttttgagacggagtctcactctgtcacccaggctggagtgcaatggcaagatctcggctcactgcaacctccacctccccgggttcaaaccattctcctgcctcagcctcccaggtagctgggattacaggctcccgccaccacgcctggctaatttttgtatttttagtagagacagggtttcaccatgttggccgggctggtctcgaactcccaacctcaggtgatccgcctaccttggcctcccaaagggttgggattacaggtgtaagccactgctcccagccttttttttttttttattagagacaagggctccccatgttgcccaggctgatcttgaactctaggctcaagcgatcctcctgcctgagcctcccaaagtgctaggattacaggcatgagcactgctcccagctctgtttttgtttttttaaggaggtatattttttctgttctctctcagccctgaagaaaggctacccatccccttcagacattcctgaaaatatatgtcatccaacatcaaggccaccacagtgaccactaagcaatgcaagaaggtcctctggggtgccctgagatcttggcagggcaggaagagtgagaaggggctttgcctgctcacctgaaagttcccacccaagccgggcccagaaaacaaaatgaattatctacatggtcatccaatcagccaccaaatggcattacctaggtccatcatcatgtaccaagccacaggtcagacccagggccccccaaattaacaagacacaggcactgtcctcaggaagtggagatctagccaggtcagacccacacacaaataacactgatactagagataatgagattgggaattatgattcagccattcaacctgggcttatgtggcatctacaccacctggccctgatttcagtagtgagcacagttgacagggtcccttcccttcacaggtgagccatgtagtccacaagtggaggtggtcgtaagtgaaaaccacattaccagcatggtaaagggttagaaagagggcaccgggtgggngagaacatgaagcagggggtgctgatggctaaagaagtaaaggaggggctgggcactgtggttcatgcctataatcccagcactttgggagaccaaggcgggtggatcacctgaggtcaggagttctagaccagcctgggcaacgtggtgaaaccctgtctctactaaaaatacaaaaattagccaggcatggtggtgcacgcctgtagtcccagctacttgggaggctggggcatgagaattgctttaacccggaaggtggagtttgcagtgagccgagatcgtgtcactgcactccagcctgggcgacagagggagacctgtctcaaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgaggacaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaatgtcctccttctaaattaagctgttcttgacaagaaaaggaaagaaacaaagaaaagaagagaaaaaaggtcaaggtttggtcctgggtgctcaaatggcaggccacagacaggaaacacagttgtgaggaattacaacagcctcccggccagagctggagaggtggagcccaggtcccctctaacaccccttctcctggccaggttggagtcccgccacaggccaccagagcggagcagcgcagcgccctgtctcccagcctgaggtgcagtgctgcatctctggtcagttgggagtctgagatgaagcactgtagctcaggaagagagaagttgttctgcagccatcagcctggaagtggtaagtgctggggggttgtggggggccataacaggaaggacagagtgtttccagactccatactatcagccacttgtgatgctggggaagttcctctacacaagttcccctggtgccacgatctgcttcacgagtctgggcatgtcctgactcctctgtgtaccccagtgtgtccatcttagcatgaggcgttagcatttccccagcaccctgcctctgctttctctttctgagcccatggcagacacagctaatcagtaaaggcatatattctttttttttttgagacacagtctcactccatcacccaggctggagtgcagtg

SEQ ID NO: 120568 - DNA, 533 bp, Homo sapiens
gaccccatctgcaactcaaggcacctcacaaacacttcaggtgctgggaaagaccattccatgacacagctcaggcctatccacctctcacggaatcctcctccactccctgcaatcctctcatcactccaacgggagcctttgtgctttctccggtgtctgggccttggcagaggctgcccctcggttcgcttggcttactcctacaggtttcctaattccactcaactgcaccaagcctccctggggtgggttcctgggccactttcactagcgcccctcgctgtgtgctgccagtctcttagctggcatccagacagatgtctgcggcctccaaaaaccactcacaccaaaccaaaaaccactcacaccacaccaattatgttaacttgcattcagcagcttggcacgtactttagtgttcttttcctataattaacccgcactcaaaggaaaagctgcaagttttcctacagccaatcacctgtctaaagatcagaaattacatatttaatcagaaaatattaatgagg

SEQ ID NO: 120569 - DNA, 4510 bp, Homo sapiens
  misc_feature (353)..(353): n is a, c, g, or t
  misc_feature (689)..(689): n is a, c, g, or t
  misc_feature (744)..(744): n is a, c, g, or t
  misc_feature (1216)..(1216): n is a, c, g, or t
  misc_feature (1809)..(1809): n is a, c, g, or t
  misc_feature (3078)..(3078): n is a, c, g, or t
ctgattgatacctggtatttaaaataacatgtttaaaaaagattcctgaattttgttgtatctgtgagagataccctagggaggatcataagtctactatgatcataattgtgttcctggtctagtctatccctttaatgttgggagttgagaatgggagaatataaaagaattcttttggttcaggtaaaaaagacatttttagaaagttagcatgggatagtgaggaaaaaaaaacaaaacaggcttttatttagaagatttgtgttcaaattctggctctacatctaattagttatataactttattaactttaccaaggctcactttactcatttgtaaaatgtggatnataataataaattcctaccttacaacacagctttgtatttggtgagctaatgtatgggacatatagtaggcatttaatagctgatagtgaaatctgaacctggggttcattggaccttcttaagaaaattttggtagatagatatataaatataagtatcatgtttatgtaatatatgtattcctctcccccctttatatctgcatcccatgtcttgtttccagtaggatttaactggtatgtggttgataagttaacttttaaatgtatgtaatagccagagccttttaaagttatcttaaaatgttcactgtaaagcttcgttaatagctgctntaaatctgtttgtcaagtgctttccactctcttccagtttctgctaatgctactnctattgcttactacattatccaagttggaaaccttggtatgatctttcctgctttctcttttctttgtaattctgctgtctagcaggctatttctatgcaaaactaatactgcataaaatattgtcaatgccaatgtaaggtagacagcttagcaagtacatggacttgaaacaccagagtatgctaagcagcactctatagctgtaatgtattaccctttgtcaacagatttctgagacatcaatgaaactcctaatcatgtccgtttatacgatataataccaattttacagtttttttctgcttaattctcattcttattttcgaatggtagtagtatcaatggcagacttctgtaaaactaggactgacatacttagatgatgagatcttgttattccataagcggtaggataccagatgtggtaaacaaataacctctagcagcctgaatggaaggatgtggtaggntggattattgttcagcaaatattcattccctaacctaccccactcccaatagccccccacccaacctatgagagcagtctgtttcgtcatccaattgctattggacttggtcgtgtgacttgatataaccaatggaatgttagcaaatatgccactagcaaaggcttgaaatatgcttgtgcagttggacttggtctttgcacttctattgtttgccgtgagaagaacatgcttctagtagctgctaattcaagaaggatgaaaagcactggctctggacctgatctgcagcttggtaccaagcccagtgtagtccagcctacagccaagtcccagataatgagcatatatgtgagcaaggaagatatacttgttgtatgctgctgaattttgaggtggtttgttactcagtattgtggcggtagctgacaaatacagaaggatactcatttcttttaaagaccttctttaggcactgttttggaagctgcagctttccatgtagcatcaagaactttattgttcaatggcacctattttaatgccagttttgtctctggttactggcaaaactgttcaggattgaaagctcnctttaaagaaatgcttacaattcagatgggaagaagagtgctggttgaccctggctatctccacaaacctgtctgtacttggaagttgtttctaggaaaatataatggccagtggctcctttttttgttgttggatcagctagttgtatgtccttagtggtacaaagggcagtgaatacacaaagatagtatctttaattatggaaggagcctattaaaattccattttatcttaagaagtaaacatgtaaaggaatctggaggaggccaaacacctctttaaaataatgattgtcttgggctaattcctttactgtgccttcagcatcattagatgccaatcctactgtgtaggttcatttgcaaacaaaactgattagagactggaggctgtgtgcatgagacctccctaaagcagaggtttcagaaacctgcacattgtttaaactggttaccctcagcactacttttatttattttctctctacatgggggggaaaaagaaggttgtttatttcaaagggtattagaacccattcttcaaaagagaataccgaaaaagagaaaaaaagatattgtgtaaaagctcagaaggttttcagaatttcccttttttgcccattgtaaacatgatctttccctttgctctgagctcccccctctggcattaatggtatatttctctttctgttactacaaacttcaaagctcccctccaagtcattttgcaaactgtaaagtaatggtgggggctgcttttatttcccagagtttgtggtgggggtggactgagaaatgtagaggaactgttggcaacatttattaacttttaatttggtgcagaaaaaatcggaaaccaagtaccatacaccattgatgttgcttcaaagatactttgagcttgtttaaccaattttttaaagcttgtgtgccggactgaaatgaggtgccttttatacagacctcaggattgtgctgtcataatagataaatccatatgtctctttgtttttgtaattaaagctttatccttcctcttttttgtcttcaatggctatctttgttctgatagagaccgattgctttattgtaagtaaactcctaactattgtgtgatattctctttaaaaagaagactggtgatgcctaatttatttagcaccatctaggaatctgattttcagtgtggcttaattttccagaaaatagtctctccccttttagcattaaagattgtattttaacatctttaatggaaattttataaantacatttctcagatttggtccttttgtcacaatatactgagcacattcagactttttctggtgactgaaggactgtcattttgaacctggttaatcgatgctttggttgcacttttgcacactaccctttattgaatgtattgtgatacgtcagaggtcatcttgtcacatgtgaaggcacggacaacgttccatcgtgctgaaccagtcccagacttccattaaaaaaaaaatcatacttgttcactcttcataccctctgtcttttttttccttgctttttgggggtaggttatcatgtctagctattgatcgtgtctgtttcagacaagctcctcttgctaagttgctcaactattgtggtataagctgcaaaggcagagaaccaaggtggttagaattgtgtgtagaataagcgaccagaaagcactctgtggcatcatgcacatgaattctcagctatggattgtataacataaggacattttgcccctggaaatgtcccttttttcttaattctctcttccttagtttctgctattcttagtggtccaggctgccaggtaaattaggtattcttctgttaacaatggcagtcaaatgatacctaaaacacctttattgtagaattctctatcctagtcccatccatctgtatttgtgttacttaagttttagctattccatgaagatccatttctgggaaaaatgctccgttatctagtgatctgttaatttctagaagtatctaggttgagggtaaagtttttgccgtttattttgccacctagattgtgctgaatggataagtgaatgaatatgtttcttttgatactgaagcaagtgggttttttcttttattttttgtgattaaatatttggttagtttcttttttcctcttaatttgttcttacttgtcctttattccttagagccacataaggaagggcagggggaaagaatttgaattatctcagtgtttttttttttttgtttttttaaaggagatagaatttgctcttgctattcatttcaagaaattggtgatcttgcatcagccggcttgtttttgaaagatgtttttcttggcatccatgcaaactaacgatatgaactgtatcaaacccagagtggcgtgggccttccttgtactgccttctgacttcttcagctgctatgtctgtacttgccctcctatgtgccctgagctctgccctctgactgagaagatctagaatttgactgtcctctttaggccagagctatcattactcatataaatgatattctttttgagatagctttctcctttcctcttcatttggcatcaaaactaataaatgatgaaactaacttcctttccagtaattagaacctttctctttttctcttttttgtctctcttttcctgagtgaaggcagtgtggtgtt

SEQ ID NO: 120570 - DNA, 358 bp, Homo sapiens
ttgctgggaacaaacaaatcctacccaaaccatagcagctgccaatgacaaaatgaaaccaagtttcatagggccctctctgctccacatgtaggcaactctgcaggcatttggagcacctgttagcatggactagaagtctaattggccctttcttcctgtgcagagatcctggtgcaggtggctctccctgcttcacccctaggcatatcttcaggcatttggagcacctgctctcttggttcagcagcctgagccacccccacccttcctgtgcatagactgtggtacagtagggccccctccactgcaagcagatctccagacattcaaatcaccttcttgcttggttcagcag

SEQ ID NO: 120571 - DNA, 294 bp, Homo sapiens
tccagcacaaccaatgccaaggccaatcatggccaaagcttttcacctgactctgaagattctgaatgcattttctcactcagtcactcccctctccccacctccccttccaatccttcctacactcctacaagaggacagacagggactgggacgctgggagtatctcctatgtgccagctactggccctagttttcacaccactgcatttctgttcttttgttaagagacagggcgttgctctgtcacctaggatggagtgcagtgttgtgatcatagctcactgcagcctc

SEQ ID NO: 120572 - DNA, 411 bp, Homo sapiens
aaacagagcacgaggtgaagattcataatattgtaaaaatgtttaataaatgcccaatggtagaatagttaaacaaattatgggatacttgtaatctaagttatacagccttaaaaatgatgtttttggccgggtgcggtggctcacgcctgtaatcccagcactttgggaagccgaagcgggcggatcacctgaggtcaggagttggagaccagtctggccaacatggcgaaaccacatctctactaaaaatacaaaaattagccgggcatggtggcgggcacctgcaatcccagctacttgggaggctgagtcagggagatttgcttgaacccgggaggcagtggttacagtgagccaaggtcacgccattgcactccagcctgggcgacagagtgagactctgtctca

SEQ ID NO: 120573 - DNA, 266 bp, Homo sapiens
ttctccccccaggcataattttttctcagaatttaaagattttttattatcatttatgcagttagatagtttttttaaaattattaatgcagttagttgagtttaagactggagtctcagaatgttttgttattttttggacttgcagatatgagcaaattagtcagcttcattaagccttagtttttactttttttttttttttttttttgaaatggtgtctcgctctctcaaccaggggtggagtgcagtggtacaatctcagc

SEQ ID NO: 120574 - DNA, 607 bp, Homo sapiens
gagacctcctgtctgggctaagtcagcctcagggcccaccagggtcaaacaggctcatccccagccttcttaccaaggagactgtttgggataactcaagaaccctttttcacctatttcattcacatgtagaagataggtctctaaatgaaggcacaaagtctctaatgtacctcagccccagactcttaaaagattctcatcacccctgctaccacacattcttaacccctgattgcaccacagcctgttggccaccactgagtgcattacatgacatgtcacagggaaaagtagccacagaagacttcacacagttctgggagttagaacttgcaggggctcctcccctctgccaatggctcttttgagcctccagcaatcattaaaatctcagttaggcccagtttcacaatctgtaaaatgcaaccaatactaacctgctgacaaggaggccaagtacagtacccacctaggataagcagatttcagccttggccagccaggtctcatgcttcactgagaccactcttctcttccctcggtgacagaatgtaccttcgacaaactcaacctacgcttcacacaggaccactttacaggagga

SEQ ID NO: 120575 - DNA, 166 bp, Homo sapiens
aatgctggatgggggccaaagccctcgtacacactggactttggagatttacagtacaagggctggctgaaggaacactctgaaactcaggcagccaacccaaagttatacatgaccaataacagacaggggatgaggactctaggaaaagaggcaaatggctaag

SEQ ID NO: 120576 - DNA, 150 bp, Homo sapiens
ttgtcttaactcttactctcctgatgatccctttattcttaaatgttgctcttactttcagtgacattgtgttgtgttagtggttgtttttcctgaaaccactcttactctaattactggcttttatttctattagccatgaccaaccaa

SEQ ID NO: 120577 - DNA, 423 bp, Homo sapiens
ttttcgttctgcagtttcactagaacacatttccaccctacctggtgaaaaaatagaggcacagggcagggagagctctccccgaagtcagccgcgctctagagacagcaaggagggcagggcacagccgatggggctgggaagtcgattccatcttccgacctgccagcatcatgatttcataaccaggcacagaatgcctcagaacgcagattgagcacagtggctcatgcctgtaaacccagcaccttgggaggccaaggtgggttgattacttgagttcaggagtttgagaccagcctggacaacatggtgaaaccccatctctactaaaaatacaaaaattagctgggcgtggtggcacacgcctgtaattccagttactcaagaggctgaggcagaagaatcacttgaacccgggag

SEQ ID NO: 120578 - DNA, 347 bp, Homo sapiens
ggggtctttcctatgcaggtgggggttgatgacttacccaagagtcacctctggaacccagttatcttaagttgatagcagtctatctttgctttgcagaagatgtggggaacacttgtcctgcaagcccaggttcgtagcagtgttggcttccccagaaccttggcttcagagcactgtgcctcctttaggaggcacaagaaaactcccacacggttcttccctctgtcccttcctgagccccctgagtgtttggctcttgtggagttgctgctattactaagttgatcccactgccctcctgagtctcctcagggaaggaggggctgtattgtagcccgcattct

SEQ ID NO: 120579 - DNA, 300 bp, Homo sapiens
tcagctcggtaccagtgctactccacaaacagtccacaaacagagtgctacctcacaaacaggacccttcgaagcacagttttctgtgtgatgccaaagaagctggacccacctgctggatagacccaatctacctacaataaaataatggctaatatgtattatgccagacattgttctaagcactttacatgtattaactcattaatcctcaaagaccttaatgtatatgccatcattatccccattttacagctgaagtaactgatacccaagatcactgtgtggtaaagcgcacat

SEQ ID NO: 120580 - DNA, 683 bp, Homo sapiens
aagtgggtgaaggggtgaaaaatgaaataaatattgaataaagcgcctgtactctggaaccagattgtgcgtttttagtttctgcctcactctgtcatactattgtgtaagcttgagcaaataagttatctctgaatgcttcagtttcctcatgtgtaaaatgggaataataatagtatttacctcatcgtgtaaacagccagtaagtagcagcatctctgcactggacaatttttcttttgtcaattgctctttttattcggtacctacagtgtcatctaaatagcctgtcccttagtgtatggagtcaggagactaagaagaaatttagggaaaataaggaaggataaaggaataataagcaaggatgaaggattgcctgcatttgagacccttgtcaatgtgtgttttctccaaagaaaatgtgtctcttttccaaagaaacatagatgtgtctctttggagaacttgtttccaaccttagatgatttttcagattcagtctgtgtgctaaactcaaatcttctcattttctaagtacatctgttcatgacttataatatgttaggaaggtattttgccctggtgaagaaggacttagttcttattcctacttaactaagggatagagaagaaaaaccttcaaattacaatgaaattgattgacctcaattctttttaga

SEQ ID NO: 120581 - DNA, 978 bp, Homo sapiens
gcacttggggaggctgaggcgggaggattgcttgagcccaagagttcaacaccagcctgagcaatatagtgagaccccccacatctcttaaagtaaaataaaatttaaaaaaaggataatgatgagtattgagatgctgctagtgtttagagtctactggaaacattttaaagagtagtaaaaacttttattatttcaatgtctacatttacaatatggtagaaattacattctttgcaataattaaatgtatgataaaaaatttagattaaacatagacagaggagggaaaacagcttttcaaaattgtttttgaacgtatacacaacagaaaatttgaagatgggcactcaagcacataggacatttctacacaaatggtggctccagatagctgaagaagcttaagcagctgtaggagagatctccaaatccagggacagtggctgccatcagagtggtccgtttgtgggaaaatgggtcacagacatagaccatatcaggctatatttcacagaaaatcttcttctttttgttactttctgatgaactatatgctatatggaaggtaccattgagactccttgtgatgaaaataactctacttgaattgggggtaaactaaaattagaagggaaagcagaccccttgtccagccaggttgaagaaaatctaagccggtacagggtgaggttgagagagatggcagcgagaatctggaacacaggcctttcctaaatcaaactttcagcacaggtcattcaagggcgaatttcaaatctatgctatgtttataaattgtgtactctacgtaattgccgggtccctggaattccctactctgtgcgaaactaatctcttactctctaaaacaaacccaagtcctaagcccacaacccctgtttgctctttccttcctagtcatcagaaccctcatgactcagactctccaaggaggcatttaaaaaaatgttctcg

SEQ ID NO: 120582 - DNA, 125 bp, Homo sapiens
cagaatgtggtgtaacaaacccaatgcccagctcaatctcaccactgccaaaaagttcaggcgatttagccacaataggaaataccctcattgttcttacatgatggaacactatttctacgttc

SEQ ID NO: 120583 - DNA, 350 bp, Homo sapiens
ttcatctcttttggttcctctccccagaataaacaaacaaacaaacaaacacttctcatagtttatcaatggtaacaaatggatattagtatgtggagagtggagggtagacagggagctcattacactagctgcagccaacacaagagttcccattatactttagccatagtaaaatattcgtagtcttttgatttaattgatccttccttaaaatggtgtgtgtgttgggtggggttgcagtcgcaaatacagacataccttgcagatattgtgggttcagtgccagagcaccacagtaaagtgaatgttgcaataaagtaagtgacaaaaattttttggtttcctag

SEQ ID NO: 120584 - DNA, 329 bp, Homo sapiens
aggcagtctcgagctgagcaatctgcactttcagctgttgctcctttaacttccattgctcttcatgggcagcactgaaggcactgtcataaagtttatcatggcttattttcaagttcctagttaattaagctaattttcagttgcatttctgccaagctaggccttcctgtatgtaagaattacatttctccttttacactttacttatttggttttggagtgacaagttcaccaaatccttgttctgtctgacacatataatgaagtttcttcacataaaatcgtgaattaatatttttgactaggatactgctgagaatacagct

SEQ ID NO: 120585 - DNA, 265 bp, Homo sapiens
ccaaatgccaggaagaggctgaaaagagccatcccccgtgaccttggtgagggctttttaggaggcagaagtgaggctgcagaatcaataagagagtttgtgaaatacagtcactaaaacccccaaatcttttaatccaggtttggtcaacatttcaaagaaaatagtaagtaacaattttaaaattgtgaggaaaatctttaaggggtaaaggctgttgacacaagtgcttttgagaatggtagtattggctagtattattttg

SEQ ID NO: 120586 - DNA, 383 bp, Homo sapiens
tgtatctggatgatgagatttgttaaagaaaaattattcaatcgttctaggtatagggaccactacaatgggattttgcagtgtctgagagagattgggttcaacagcatgggcaagtgggaattaatagccaaggagcagattagaaagtcagtaaattactaagaaaattactaagaaacatcaggagtaagggagattctggctacaccctctttaaacttattttaaagatcatgttgttgttactctgcgttttgtgatattttggcttaaaacagtgaaaatctgacctgaaattaatactgagcctagataacaaaataaattgaagaagagcatttaggttaattgcaaaacaaaaagtttagctagataaatac

SEQ ID NO: 120587 - DNA, 187 bp, Homo sapiens
cccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtgg

SEQ ID NO: 120588 - DNA, 696 bp, Homo sapiens
taattattatatttttttttgtagagacgaggtgtggctatgttgcccaggctgatctagaactgctgggctcaagtgatctcctaccttggcctcccaaagcactgggttcctgaataggtgtgagccccctgcccggccgggtttctgattttatgactgcggtcacctccacatctgtaactcttagaaaacactcagtctctgctcagttccttaggtagttcctgggaacggcctagggatcgtgttgagttttccggggctgccataccaagcggccacagaatgggtggtttgcaacaacagaaagatattccctcccagttctgggagtcttgatttcagccagaagtctgaaatcaaggcgttgatgggattggctccctccaggggctgtcaggtgagctcatcctgtgtctcccccacctgctggtggctgctggtggcccttggcgttccttggctcatggccgtgtccctccattctctgcccgtcctcacgtggcctcctccctggctgtctcgttattgaaatttcctgcatcaggctcagcacggtggctcatgtttgttatgccagcactttgggaggctgaggcgggtggatcacgaggtcagtagttcaataccatcctggccaagacggtgaaaccctgtctctactaaaaatacaaaaaaaatagccaggtgtgg

SEQ ID NO: 120589 - DNA, 507 bp, Homo sapiens
actagtccacggtttggctactagtccacggtgggctactagtccacggtggctactagtccacggttggctgactttcactttctgttccttcttccttatttcctttttaaatgaaagaggaactgcttagatagtgaaagtcagccatagtcatccaccgaatactactgcacctgtcttgctgtggatacagagcttcaccaagctgattttcatgtctgaaagtgctaagagtaattttcaacaatttacaaattttcttgttaatgatgatgaaactttatattttacattgctgatgactctcctgtgcttcattctttatagcagtgagagaatgtaacactaagatgttctgctttcttcataatcaaaatattggttttggtatcttaactaggtgccattattgcccaggtctgtgggcaattattgggatataagacaggttaactttgaaaatccattgcttaaaaaaaaaaaacaaaaaactaggccgggcat

SEQ ID NO: 120590 - DNA, 343 bp, Homo sapiens
caaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatag

SEQ ID NO: 120591 - DNA, 612 bp, Homo sapiens
tggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcac

SEQ ID NO: 120592 - DNA, 858 bp, Homo sapiens
gattagtttgtaagtctgagtggactgagtggggaagatctgccttcaatgttggtgggtaccatccaacaggcgggggcccagagagaacaaatacagaaggcaaattggtctctaagaggtaggatagatttttcttcttttttaagattgagttttgctcttgttgcccaggctggagtgcaatggctccatctcagctcacgacaacctccgcctcccgggttcaagctattctctgcctcagcctcccaagtagctgggagtacaggcaagcgccaccacgcctggctaattttgtatttgtagtagagatggggtttctccattttggtcaggctggtcttgagctcccgacctcaggtgatctgcccgcctcagcatcccaaagtgctgggattacaggcatgagccaccatgcccagcctaggacagatttttcttctggtgccttggacattaaaaatttgactccatgaccgcaatgttgactctgtgtgtaagcattatatgtgtgcataaaaatgttgaaagttcctcaataaacgaagagacatctgttttttgtacacgtgcatttgtgaaggataaaatttctcaagacctcgtctctttgggagacaatgcagtggtaacgcaacagtttttgaaccatctcatcaagacttaggttttctgtcacagtattacagatgaccagttatataaagctaggtgcccacaattaccaagcatagtgacaaagcatttatacatttcactttttgacctatttctttatgaatgtttcatctgctcatcaccgttatatccgtgcaactgtcattggtatacctgagtgtttatcttgcaaaaatg

SEQ ID NO: 120593 - DNA, 1218 bp, Homo sapiens
  misc_feature (1)..(3): n is a, c, g, or t
nnnattccaaagaagaaactggttcccattcccctgtgtgtcttcagcttcattataagcattctgagaatagagggccccaggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcaagaaagaggaccatggtttaagaagtcacttcagaaggagatcctttatttagccttcacagatctagaatttaagactgaatttataggaggatcaaccccagaacaaattaaattggaacttacctttagagaactaattggatcgttccaggaagagaaaggagatccatctattaagtttttccatgtgtctagtggagtagatggagatacaacatcgtcagatgactttgactggccacgaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacagatggtgatgccaggagaccctgtagaaatgacagaatttcaggataaagcaatcagcaattctcactatgtgctggaacttacgttaccaaatatttatgtaacactacctaataagagcttttatgagaagctttataataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatgatgaggaaagtggatctgaggaggagactttgcagtatttttccactgttgatcccaactatcgttctcgcag

SEQ ID NO: 120594 - DNA, 300 bp, Homo sapiens
ctctacacagttcagtcaattcggatcataaaaattgtcaccttgttattttaaatttgtaatgccagatctttttgtttattcagcaaatacttattgagcacttactctgtaggaggcactgttcctttatgtaagttttgtgtgcagacaactttagcataaccctttgtttcaaacaatttatgtattattaaattctgaaaccagggaagcattttaatgaagcgttattcgtcattatattggtttgatttcctgtgttcagtaaatttatagtcattaaattggcgatttatc

SEQ ID NO: 120595 - DNA, 366 bp, Homo sapiens
tgattgctgtctcaaggaaaaatcacttgagagtcacaggctacattacttgataaaacaaactatgattatttagacttgaatatttggcagaccttttctagaaaatgaatgaagtgaccctggcacttcaaagaacacaacagacagtattgatttccaatgatcaaattcaagctttcaagcaaaagttaaatatgggggaacctggctaactctgggtgtactgcctatgagttagctctgctgtgcaaggagaagaaaaataattttaaaaaatacaaaaaaaggaagaaaaaatttgggggcaacctgcatttatcaccacaagcttgactgcttgtcagtgattaaaggcttttctca

SEQ ID NO: 120596 - DNA, 645 bp, Homo sapiens
aagaacagcgagacaaaagcatcaggtaacctattaaggaaaacctagcagactaacagcagacttctcagcagaacaaaccagaagagattggggtcattttttagtcttcttaaacagaataactgtcaggcaagaattttgtatccagcaaaactaagtttcataaatgaaggagaaataacgtctttctcagacaagcaaatgctgagggaatttgtcaatactagaccaatgttacaagaaatgctaaaaggagttctaaatcttgaaagaaaagattgatacacaccaggatagaaacctctgaaaacataaaattcacacggcttataaaacaataacacagtgaagaaaagaaagtatctaggtaacaatcaacattatgactggaatagtatctcacaatactaacattgaatggagatggtctaagtgctccattaaaagatacagattggcaaaatgaataaaatcgtcacaaaccaaatatctgctgtcttcaggagacacatctaacacaaggattcttatagacccaagggaaaagggtggaaaaagatatttcatgcaatcagaaaccaaaagcaagcaggaggaactattcttatatcagataaaacagacattaaggcaacaatagta

SEQ ID NO: 120597 - DNA, 445 bp, Homo sapiens
tggtgttctgcttaaacatgtttcagtccatattttttggtagagaagtggaaggcaaggtattggagttgagtaaatttatgagcctactcagttcctatccctgattgttttcctcaccttcttaaggcagaagccagttctggcttgataacaactttgaaaatgttttggctcatcagaacattctattcttgggtaactaagtcaactttaggttaacattacaattaaatttcatcttcagttttatctaggcaagtttataaagctagcttctttcaggtaaaatgagaccatttggcttcttagctagttctcattttgggagggtgtgtgtgtctcttttattctgtatgttcagggttctaattacctagcagcttttaaataattggacaatgccagtttatgatttacaaagcagcaacattataggaggtaa

SEQ ID NO: 120598 - DNA, 270 bp, Homo sapiens
ttgcttttcctaaatgaagtgacttcacaagacaaattgataatttgggggtcacagttcagatgaaaaaaagtaagttaaatggcttacaaccacttttcctgtactacttccttccttcactacttccttcctatacttcttccttcctgcactacttccttcctgtaccacttccttcctgtaccacttccttcctgcactacttccttcctgtattacttcctttctgtactacttcctttctgtactacttcctttctgtactac

SEQ ID NO: 120599 - DNA, 287 bp, Homo sapiens
cagcactatctctcagaagctgttggatcccatcctgaaacctggttcatttgaagctcaagctaactgggatctggctgttttgcttttgagaagtaaaactacggaggttgaagtaaacaggtttggttttaagtatcagataggttggaaataaacctagatcacatttctcaatctggaatcaccatactatactgttagtgttccagaatttctcaagtttgagaaaccttggcctaaaggagtttgccagttatctcttctctgtatttctttgtgttttg

SEQ ID NO: 120600 - DNA, 856 bp, Homo sapiens
cgagctccggagtgactttcccttcctgtgaaggcaatccggccctttccggtggaggacccttccccctgggttgatcttgaggaacttaagagacggtgttttgactcgactcctttcccctttttcctcccggtaccaaagcggttttgtttgctgtttatactctaccccgtggaaaggcggctagctggctaaagggttttatgcctgggggaggatgagtcgctatttggtcgtgacttgtttctgtttaaaattattattatttaccaaatgaaaatgttgtacttaccagtccaaagtgcggggcttatattgttagaagaccacttaaaatgctcctggattctgacaaatattgcatgagaaatttgcaatcagccgtgaagcatgtttccccttctgaaagtttaacacgtgccgtatctacggctgggatctaacacatcccattcctacagggtaatttcctattgtgttttcaaatactactaaagtactttaaccaagagttttcaataatctttatgtattattgcctatctctatgcaaggtatcaatagttttctacaggttcgggactacactgtttaatatataaccccaacccttggtaccgcactgaccttcagtatttggttgctgaaatcttcaatgatgaaaggggtggtatgataattgacacagattagtaaaccgggtccttttcttccctactttcccgtaacatcctgtccccacccactccctcacctaaaccttgatgagaccagaaatgcattttaagttgcatgtattatttacattgaaatattacaatttgaaggttcatctaaatttaaggctatattc

SEQ ID NO: 120601 - DNA, 511 bp, Homo sapiens
ctgccctctggcagctgaggtgccagtgaccactgcttcactatccgcctcctagctctccaggtgtgcaccccacaggaccagcccttcaggcctccaacaccactcacactccagacaacagccccacattgcccagggtatcaacattccaacttcctatttctccctcttcccaggagagactccctgcacctgctgtgggacttgtgtcactgcttagtctctaattgttatatttatgtttacctgtgcaccatctgcctcctccagactgtaagctctgctctgagggcagagacctattttgctgacgttgtatccatttcacgttgggtgttccagtccaactccacactcattcattcactccctctacatcccctgagctggtccctatcaaacagtctgattggcactggagattcaaataataccaagccatccttgccttcaaaaatcacccagtctaatggtgcaacaagcaactgcgacccagcatgctgtaata

SEQ ID NO: 120602 - DNA, 400 bp, Homo sapiens
tttcaattaaaaattgtccatgatgggtcattggatgtgaatgcaaaaagaaaaaaaatgtccagtgatagcttttgtaaaattccgagtaaatcatgtgtctttttgaggataaacatttgttattgaagttccctcatttaaatagctttttggggggcataatttggatttgtagcataattctaatttgatttgacgtacaagatacaaatcttctttatgtgaaagtatatgacatcttaaagtgatatttttacagagtgattttccaaaagatttatttagaccaggtccatcatttccaagtgaagtgaaatctttattcattaactgtaaagtttctgtgggcttccacaattgctaacatgtataattaattcaaaacccatgcttttca

SEQ ID NO: 120603 - DNA, 277 bp, Homo sapiens
ctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagag

SEQ ID NO: 120604 - DNA, 415 bp, Homo sapiens
ctcttttaattctgcagaacctaggataggttctagtatatggaggcacttagtaaggaatgcatgcattcatgcatgaatgaatatgcctgtgttctcccgtgtaaatgttaatgttggatagatttccagaaatttgaattgctttatctaaagttagggacattctaattttatgatgtaccatctaactatccttcaaatggattttactaatggacattttcatcaaatatgtatgagaatgcacatttctataaattcttaccaatacatgaccttagttgtattatcagtcaatatgtgaaaaatatttctattgatttaatttgtatatccttgatgattggtaaatttgagcatttaaaaaatatatatattttttatatgtatatatatgtatacacacacacat

SEQ ID NO: 120605 - DNA, 255 bp, Homo sapiens
gcaggagaatcacttgaacctggaaggcggaaactgcagtgagccgagatcgcaccaatgcactccagcctggacaacagagtgagactccatctcaaaaaacagaaaataaaaagtagaatattgaaaccctcatacgttaatcatggagtataaaatggttaagctactgtgaaaaacaatttaatggttcctcaaaaagttaagcacagaccaggcacagtggctcacatctgtaatcccagcactttgaga

SEQ ID NO: 120606 - DNA, 311 bp, Homo sapiens
taaaaacccacacaacacacacaccatacaagctgcttagcattgttctcttttcatttaataaaacagcttagaaatttaaaaaaaagaagaatgattactgcaatacactagaaaataaatgttattaaactctttgctgttgcgacgatactaacagcaacaaaaaggaactcatattgattatactggaggttttagggtaacaactcatcagaaaacttaagaagtcaaattctctcctgcttttcttataaaaaggtacttacgtatgaccaaacagttgatggatataattcttaagaattcta

SEQ ID NO: 120607 - DNA, 464 bp, Homo sapiens
ccatgctgggagaacgactctctcttcagagctgtcagacagggacgttaaggtctgccaaagctgtctgctgccattttttctgatatgccctgcccagagaggttggatctagagaggcagtaggccttgctgagatgtggtggactccacccatttcgagcttccaggcctctttgtttacactgtcagcacaaaaccgcctcctcaagcctcagcaattgcggatacccctccacctgccaagctgcagctcatggcaggtcaatctcagactgctgcgctagcagtgagcaaggctccgttggcttgggacctgctcagccaggcacgggaggatatttcctggtctgccgattgcaaagacttggggaaaagcgcagtatttaggcaggagtgtaccactcctccaggtacagactgtcacgacttcccttggctaggaaaggaaaatcccccgatcc

SEQ ID NO: 120608 - DNA, 416 bp, Homo sapiens
aaatgggttgcgtaaaggggaaacgtttccaccaatctgggctaattattatacccaggtttacacatatctgaattagatcattagctgtaagctcagttcctggatacagatatagagatggtaaaaacaataggagaaaaacatccttgcttgaatgaaaaggaaaataatcaaaaatgccaggaatgtttatcagtgacttaatgaaatatgtttggtgaaatataatgacaatttaaatttagcagcatctctaactagatgtttacaaggctccatggagacaggtacagagagggcaggtaccacggcacacaggtacagatagggcagcccctgaatggtccactcccagcctggctctcatgggctgtgagcgcttgggcaagttattaggctgggcacttggaggc

SEQ ID NO: 120609 - DNA, 449 bp, Homo sapiens
tggctcaggtcatgtgcttctgtgagctccccctacggccttgccccgaatcccgtgatgcagcgtgacctgcctaggtgccggcggcactttcatgtgcggctgggaaagtcagatttcagcactaatcactggctgccgcctgcaatgagcccacggcttgagctctggggcccacccagctccttaaacacgcagaacctttgccagctgagccaggatcccagctgtggggggttgggggtggaggggtgcagggatcccaaaacccaacccggggccaggttttacacaggcctggactgagaagtggggctacaggctacaggtgcttgataccccaggggggccctggaacaggcctggactgagaagcggggctacaggttacaggtgctggataccccagcggttgggggggtggtgctggacacccagggggcagatag

SEQ ID NO: 120610 - DNA, 820 bp, Homo sapiens
caaataattattaagtgctgaattatgagcatagctctcttctagaaaaacggaggaataatctgtggtttatgtcctcaggcagcttgcagtctatctgagaaaacaagacataccctcaagcagataattgccatttacagtcattcctatgatctcagcactatgtgggtttaatcagccttctgctaaaaggaaccaggtccaagacattcagcatggcatggtagctaagcaagatccagtgtcttcattcagcactgacagagtcactgtctctgagcagtacttagctacagaaactttgaagccttctgcaatttattatgctgagtgcatctaatcaacatgtagaataaagatggagctccagagaagttagcacgcaatctgggtgacaggtgctgagcaaggacagcctcttcccaatactctccaagcggcctgctgtttccagggaatgatattatcattcttggcatctagaacaggactcaatgtaagattgtctaaggcagtcactggctacagttcatggaagcttcaggacggcacttggcatgagctctcagtgctatggaaaaaagaagctcttaggtggaatatttctagctaaaaaatgtatagttttttttgttgttgtttctgttcctttcatttttatttttagaaataggatttcaaagggcatttgtcctggtccctcaggaaagaacattttctaaagtgttcccatcaacaatgcctcaggtgttacaggtccctactcttggccatccagctctgccaccgtgcctggattctgcattttcaaagggac

SEQ ID NO: 120611 - DNA, 1235 bp, Homo sapiens
tggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctcattttgtctttgaggctcttcaaaattgctttgaatgctatggtttgcagaaaaagggtgagcatgatggctgtcctatatgtatgtaatgattttaatatgaatccttgtgtctggactctta

SEQ ID NO: 120612 - DNA, 191 bp, Homo sapiens
gcactctagcctgggcgacagaacgagactcagtctaaaaaaaaaaaaagaaaaaaagaattatttgttgtgaaaaacttattttaacaagttctccaaagttttatttatttctaaaataaaagattagaacaaaattcttattatgggccgttcttacagaactttttagagtgccatttgctataatg

SEQ ID NO: 120613 - DNA, 492 bp, Homo sapiens
catcccacattgctgggattacaggcatgtgccatgatgcccggctaatttttgtatttttagtagagacggggtttctccatgttggtcaggctggtctcgaactcccaacctcaggtgatccacccacctcggcctcccaaagtgctgagattacaggcgtgagccaccacgccctgcctaaagagacatcttaaatacgcctttatttttagacaatagaaaaataagcttcccattatgcaagagtcctatggcctttgtgctttcctaccctgtgaactaagagtctaaatctgtgaaaagatgtccatgaggtagagttgaattaaaatagcaggttgcagaacaatatttgtacctcctcactttcttcttttctgcctctctcccttccttctctacttccacaaaagttgactgagcacctattgtgtgctaatatatgctaagttactggaaatgcaatggagagcaaagcgacaccagtgt

SEQ ID NO: 120614 - DNA, 662 bp, Homo sapiens
ggcattaaggcagcttctcggctttcaccccaaaaggcttcctcagtgttagaggcttgtccatttcagatagttataaatatgaagccatctaatacaatccacatgattttaaaaaatattttggttcatccaagttctaattagatcattaaatgctcagtggagctaacccatttcactgccccacccgtagccttacacaaaacttccagacaatgacatgtcacccttccctcagaatcacctagaaaccatcgcagttgcttcaggactggacaaagagcttctagagaataagcagaaagaagagaggtgaaaatactgaattcagggaaagaaaaagactagggagccaggaaggaggatggtggcagtgacctgtgccccagctcctttcaaggaaggcagaggcaacgctcatttatctgaggggcaaggctcttggatttgcagatttaggtgctaccctaacactgtttctctgggatgagagcaaagagtgaaataatttacagccacagacaaccctgctttctgcagtgcgctccatcaggagacgcttcaccaccctgtttccatagtctacaggagtctctgaagtcacatcagctgtaggaactcttgtgaggaaaacagcctttgtagccctcccctgaaag

SEQ ID NO: 120615 - DNA, 272 bp, Homo sapiens
catgagtaaggcaatatgcaaagatagacaaagctctgtcctctctacctccccaggtgcctgggattctcaaaccatggcctaggacatgaccaggcaagtctctcaacctcttgtcccttgtcgttccttgttccctcatcacaattctttctagttacctgcctcactcatgaaatcatggcatcatgagagatcagaggcaaagggcctttacaaaccagactacctaagaaatcagtaagaatgaagctgtgtgatacaggccaaga

SEQ ID NO: 120616 - DNA, 283 bp, Homo sapiens
atacaatttcccagctttccttgcagaaaagggtagttatgtaacatggttctggaaaatgagctgcaggccgacatcttaaagggggacttcccttgccagattaaaagagagagcctcactaagagaaactcagtttttccctttagtcctttagtccctcctattctctatgtctaaaatatagacatgaagcccagagttctagtagccactttgtaaccttgagttaagaagcaagagtaggggtcgggcacagtggctcacgcctgtaatcccagca

SEQ ID NO: 120617 - DNA, 335 bp, Homo sapiens
gagatagtatgtcctctgttgtttttccatatgtcatgcacttttgacccaaataatgataaaaagcaactgtgtgaatgtctgcatttgaagatactactcttgggaaatgggtcttctttctctcagcactgaatcttccatcatcctggctctaagctgtgctaatttgaaaataagggagaacaaagaagcttggtctggagatgaatcacagtatgaaagaacacacaatcaaatggcaaagaaaaggtggacatgcttaggctgattcataccctggtaaattaatggcacagttgcctcctgattacaaagatctacttccaaagaag

SEQ ID NO: 120618 - DNA, 770 bp, Homo sapiens
atgccaaccatgtggactccagctgtggtcaccgtgctccgttcgcccatggttctcctacaagtatggtctttgcccctcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatgg

SEQ ID NO: 120619 - DNA, 596 bp, Homo sapiens
gacagcccattccctttgtacataactaatttcgaaaaggacttgtgactcaacgttggtcaatgagatgacagggaaagtagacagaaggcccctgggaaagctgctttgcctctaaaaaaaaggcactgaaacaaagcctggacacactgtagccaccttgtgcccatttgtgctacttttcataatacagacattacatccatcttgtatggattatgtacgtattctaggtgcaaggcactactctgagtattaactcatttagttctcacaagaaccctacaggcagacaatacagttatccctgtattctagaggaggacgctcaggcacagagaggctaagtcgcccaaggctactcactcgtaactggcaaagctggaaactgaacccaggcagtctggctccagcatacattctcttagccacgatgacaggtcagctctccatggaagctgctccaacccctcagtatgctaccttccttaaaagtattattctttactgatggccaccaaccctttccactttttaaaatgtccttcaagaaaatagactcctggtcaggcgtggtgcctcacatctgcaatctc

SEQ ID NO: 120620 - DNA, 825 bp, Homo sapiens
agcggagatgttccttccaaaaggctgagctggagttgggggttctctcatggcttctcttggctcccgtcacaagaactattctagcttaagggtataaaacaggatgtttgtcgccaggcgcggtggctcacgcctgtaatcccagcactttgggaggccgaggcgggcggatcatgaggtcaggagattgagaccatcctggctaacatggtgaaaccccgtctctactaaaaatacaaaaagaaattagccgggcgtagtggcgggcgcctgtagtcccagctactcgggaggctgaggcagaagaatggcgtgaacccagaaggcagagcttgcagtgagcggagatcgcgccactgcactccagcctgggccacagagcgagactccgtctcaacaaaaacaaaaacaaaaaacaacgggatgtttgtcaaaagctgccttttctaagaacagagagcgtgtgactcttctctcaccccaccatggctacttgttactgtgatctaaatttaattgtctccattagccacagggagctattgtctgaagagctgggggagcttatttacagttttatttcagagcaagataaatggtgtcccctaaataataatgtgacttaatggtagaggcaggactaaatcccaatttctttccagtttatgttttactactaaagttgaaaacaagattctctttttagagtgtaactatgctgttatgaacattatgaatactccaagaattagctcataatgttgtctttttttatttttttttatattttgattactgcctttctcttgttagaagaaggaa

SEQ ID NO: 120621 - DNA, 192 bp, Homo sapiens
agtcccctgagttctcaggaattcgaggtagagctatatctgtcccaggccacagtccccagagttaaagctgtagaaggtagaagaaatggggttttgtatgtaggcttctcagggacccagcaggagatgaaaagatacctgaggcttttgatcaggatcagctggaaaaggtagctgagcctctcaatg

SEQ ID NO: 120622 - DNA, 827 bp, Homo sapiens
ctgtgcttgggcaggactggatgaaggaataagctctaccctctttgtcattattaccgttgcccttggagtgggtgtcatcaccatagcactgtatttgagctatcggccctgcaaagtggacaggaggaaattgctctataggcagaaagaggaggacaaagaggaggaaagccagtttgctgttcaggaagagaaaagtacaactcatataattgacaactgtttgattgaatgagacttctgctactgtggtttcccagggagggaagaagggatagaggagaaaggaagaaacacaatggcaggctgcattcccctttgtgtacgtctgtcctgtaaaacggtgtttcaggcccccatgccccatgtcctgtgtgtccaatatgtccacaagctcaccattctctctctctctctcttttcttttctttttctttttctttttttttttttttgagatggagtcttgctgttgtcgcctaggctggagtgcaatgatgcgatcctggctcactgcaactgcagcctcccgggttcaggtgattctcttgcctcagcctccctggcagctgggattacaggtgcacaccaccatgcctgtctaatttttgtacttttcgtagagatggggtttcaccatgttggctgggctggtctcaaactcctgacctcaagtgatccggccaccttggcctcccaaagtgctgggattacaggtgtgagccaccgcgcccagccacctttctctttagagctcactctattcattaggaatctcagtctcaatgtttgatttgtaagaaggcctcttgctccttgccagg

SEQ ID NO: 120623 - DNA, 459 bp, Homo sapiens
ctgttctagctaatggcaccgctatgcaatagccatcagagctcccggatcctcaccaggtgatggctactgttttaagaactttacctaataccttcaacaaccgcatgagtaggtagcattaaccctatttgattaatggggaaagtaaggcttagaagttatgctgatttgcccatgatcctacagccagcaagcagttaagcttgctgtagaatccagggtgcgtgtcaaaagtcaacctcttcccatgtcacttcccagcctctccaaacttagaagctctgcagtctagattgttctcagagattaagctttacaactttattgtctctcaaatctatttccttctcttaattcccatagctacctgctgtttgggtgatgttttgcttttattagggcctccaaatcagcatagcacaacaactccagaattttactttgtttgaattccca

SEQ ID NO: 120624 - DNA, 476 bp, Homo sapiens
caagaggattgcttaagaccagcaagtctgggctgaagtgtgctatgccagtcaggtgtccacattaagttgggcataagtatggtgacctcttaggaacagaggaccaccagattgcctaaggagacgtgaaccagacaaggttggaaacagagcaggtcaaaactcctgtgctagtcaatagtgagataacacctgtgaatagccactgcatcccagccttgacaacatagtgaaacccaatctctttaaaaaataaaatctttagtataaaagctgccatcctctttaagtagcatttagtgttttgaatgaacgtggtttaattattgatgatctgttggaagatccttaacagaaaagttagtcaacggtatgaacaattcacatgattattctacatagtaaggcctgagtccttatgaatgaatatatgaatatttacatagccacattaactatgtcttactgatttg

SEQ ID NO: 120625 - DNA, 418 bp, Homo sapiens
gcaaccattaccagcacagcttctccagaactttttcacctttcaaaacagaaatggtaccattaaacgctaacttgccacccccagcccttggcaggtgcctttgtactttctgatccttgtgaagttgactactctgggcaccccttggagatagaaccacatgtatttgtcctttcatgactggcctagttcgcccagcgtagtgtcttcaagttcatctgtgttgtagcgtgtgtcaattgtatgtcaccccatgttttatttttccactcatctgttagacatctggactattttggccttttgtttgctgttagcatgggtgtgcaaatgtgtgttccaggctctacttttcagttcttcagcgtaatacccaaaagctgaattctaggtcaaatggtagttctaggtttaa

SEQ ID NO: 120626 - DNA, 368 bp, Homo sapiens
aatttaaccacacactactctgatctccttgagggtaagggctatcttttaactcttgtctttccagtgttcaacactgtgcctggcacatagcaactactcaaaaccatttaatggatgaaacatcatttctgctacttgcatgcagtcgagtgctaacggaatcacagaaaatggatctttcttggctcatttgacacataggaaaaccgaggcccagaggcttcaggcttagtaagttggcaaaaccaagactaaaacccaaggttcctgttttggaacaggtcaattttttcccattaaattttggaaggttaggaagctaggcaagtgctgccctcttgctggtggtgtttgggagacaggtc

SEQ ID NO: 120627 - DNA, 435 bp, Homo sapiens
cactctcttagctttaacccccatccacttatgtcttttattatacatatataacaattattattttctgagacaggtgtcgccctgttgtcttggctggagtacagtggtccaggctggagtgcagtggcacaatcatagctcactgcagcctctacctcctgggctccagcagtcctcttgcctcagtcttccaagtagctgggactagaggcacatgccactgggcccagcctatttgcaaaacttttgtagagacagaatctcaatatgttgcccaggctggtctcaaactcctcatctctaacagccctcccggcttggtctcctaaagtgctaggattacaggcatgacccactgcaccttgactgctttgtggtttttaacaatctgtgaatctacatagtctatgaattaggaatattgttttggag

SEQ ID NO: 120628 - DNA, 764 bp, Homo sapiens
gtgaatatgcaagtaataattgtcttactatgaaatattttctgtcatgtccaaatcttcttttatagatgcttgtaataaaaatttatttttcctttgttggaacctcttaagcctataaagtaatcaatagaattttaaatcttaacaaatattttttggaacttttaacatgacattttaaagcataaagggcagttttcattttggggcctagagtagttgtgtgggaacatcattttgtcaagttgcctcatacaggtaaaagttcaaactgcatttcagtatcacaaattaatggtgattggtagaagaaattaaaaagagaagttttagaaaaactttagagattgtacagtccaggcatcttcaggatacaggtgttatctatgactaatccctaaaaggtaattattcatccttagggaatacttacagaaacaaggttccttaaatagccctttttattattgggcagctcaaattgtcagaaaattcctctatttagaagtaaattttgcctcctataggttcttctcaattatcgaagttctgtctttaaaaggcaatgcataattaacctaatcctgtgtctacatgataaatcttagcattttgaaagcaattatcagatctcccctacaaactatctgtctgtcttctaatcttttggcagtttgaatcaacacatatttattaaatacctaattggtggtgccctgtgctgtgtactccgtaggcattgaggaatgcattagacattg

SEQ ID NO: 120629 - DNA, 152 bp, Homo sapiens
cctccaggaacccagggggctggctggtcttggctgggttcgggtaggagacccctgatgaataaacttgggaatcactggggtggctgtaagggaatttaggggagctccgaaggggcccttaggctcgaggagatgctcctctcttttcc

SEQ ID NO: 120630 - DNA, 362 bp, Homo sapiens
ctccaacttgggctgacaatggtcacacgaaaaaacaggtcttcatatttttatcttacagactgggaaacaaactcagagaagtaaagcaactaattccaaattatatttaattccaaattatatgtaaatagcaaatgaactatacaatacaggtttgtcttactacaaagcatgtgctctttccacgcagccacagcgcctctcacttggacagtggatacagctgtttcaactcttcctaaccacactcaggaatacccggcccaggggccagggttccttccctcccatcactcaaatgctccttcctgtgaagtcccccagctaacacggagaactgaccccaccccatcatgcat

SEQ ID NO: 120631 - DNA, 494 bp, Homo sapiens
tgtgtgatgcagtgtgaagcgagcgggtggggcgggggggaaagaattcaccctggatggctcaatggaagagacttaaatgaatgacttcttacagccatgtggtcaggggcagacagggacgttggagtgcccagaggctcccggtgagaagggatggaaggaattgctggagcccaagatgaggggctgtcatcgtggatcatggaggaaatgctctgacctcccccttggctatacctgtgttctgctctagccttcccctggtgaacccagctggaagccagccagcacaggagccctagagtttctcagggacacacatggacctggaggggcaaagaagaaccagtactgtggccaagagctggctgtgaaataaaaatgcctgccgccaaatcctggttctgtcatttactagctgtgtgacttaaggcaagctgtttaacctctctgtgtctcagtttcctcctctgtaataacaatacctacct

SEQ ID NO: 120632 - DNA, 282 bp, Homo sapiens
tctcagtttttatctattagctgtgtaatcttgatttttagattccttggctaaaaaaattgagaattagggtccttacctctggtaattgttaggagtttgtaggaaatgactgtgaaaccatgtaactggcagtgttgtagggtaccttcagtattaagttctcttcgcctctactctcacccagccagtttgtctctactaagactgtatttccttgttgaaagaaaggtcccagagtttttgagaggcttacattcacatttatgagaataaaattga

SEQ ID NO: 120633 - DNA, 398 bp, Homo sapiens
tttccttcatcttcctgtcttcttccaagtcctccaaactctccgacctctggctgttagccacttctgaacctgcttttatattttcagctatctttgtcacaacctggcaatgtagaaggaaaaaaagtccattttcaggggcaaacttcaagaaggcttcagatatttgcattaaaaggaagaccagtattaatagccaatgtgatggggaaaagtcattgaagacatttaatagcttcaattcgcatagtaattttctgtaagatcataacaaaaaggggtttaattggcttatagttctgcagtaggctgtaaagaaagcatagtaacttctgtttctgggaggactcaggaggcctctcaattataccagaaggacaagcagcaataaaatg

SEQ ID NO: 120634 - DNA, 257 bp, Homo sapiens
actgaataacaagttaaaaagtccttctggaatcgacaagcctttttgccctggaaggtggcatagttgcttcttaggggaatatccgtggtcagggacagaggccttgagaggctgggcaaaggtcctttcagccctggtttcattcgtctaaccagcattccactctaacagcctcctccattcaagcgcttactccattaacaaacattaatgggcacttactcgatgccaggcatggcactagccactgtgca

SEQ ID NO: 120635 - DNA, 366 bp, Homo sapiens
acaaggacaggccgctccagccacagtgtttcctctccccgccggcatcctgattccacgcatgcagactctccatactgtcccttgccctggcagccccaaagccccgcagtgcgctctgctggcagcccctgtgggctctctctcgctgctcctcctcccatgagctgctgtcacacacaatggccgcatccccccaggctctgagcccaggtcaaacccagccaccacctgagtcccagcgcagctctgcttcctctgtgactcgggccactccaacctctcccatcgcgaagccccctcgtgccctcctacgtgcacaccgtgagctccaacgctttcgtgcacgttagtcctgcccacttc

SEQ ID NO: 120636 - DNA, 142 bp, Homo sapiens
agctgtcctcaagcctcacccagtcatgcatcccacacagcaccccatggctgccatagctcgtgccacttacaaatggcattgagtcaaaacacaaaacgtccaccagccctcagagtcgagaaaccgagttccaatcctg

SEQ ID NO: 120637 - DNA, 516 bp, Homo sapiens
aactgtctctttacagggaagagggtgggaggagacaggccctgaaaatccctggtccctgctaactggggagtggctgcagcccctgtgttgggcagcccttgaggtcagtagtgggtgagacttgcccctccctccctccatggagtcctctaggcagcagtgttcctcatttctaccttccccacaatgggtcctgaggctttggctgggaagaaggggaaagaggtcggggcatggggaggatggaagttggaaattgcaggaagcctctctactgtctaggcctaaactagtatcctctccagaatataccagaagcctcttttttggcagtcattaagctgatgctgtattttgatcttcatctgactctgtggatcatctccactggggaagcaactgaaagctagattaattggcacccccaaatctccagaagcatcaagcacatgttgcttttataattagaaaaatggtgacttttcttttaacccagcagttcccttcccccat

SEQ ID NO: 120638 - DNA, 1039 bp, Homo sapiens
  misc_feature (976)..(976): n is a, c, g, or t
  misc_feature (981)..(981): n is a, c, g, or t
  misc_feature (996)..(996): n is a, c, g, or t
  misc_feature (1000)..(1001): n is a, c, g, or t
  misc_feature (1005)..(1006): n is a, c, g, or t
  misc_feature (1009)..(1010): n is a, c, g, or t
  misc_feature (1012)..(1012): n is a, c, g, or t
  misc_feature (1017)..(1017): n is a, c, g, or t
  misc_feature (1020)..(1020): n is a, c, g, or t
  misc_feature (1023)..(1023): n is a, c, g, or t
caacaggaggctgtctggacacactgattactcactcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttggtcgcatgagctgccagaaaccatggacgtctcaacatcagcacctgccactgccactgtccccctggctacacgggcagatactgccaagtgaggtgcagcctgcagtgtngtgcncgggcgggtccgggnaggnngganngcnnangggtntgngancatcggaacgggggga

SEQ ID NO: 120639 - DNA, 514 bp, Homo sapiens
acgcttctctttctggtcaaaatggctggtaagcaggccggtaagtaactgggggtcttcttggccggcatcgtcgcgcttcaccgtttatttttgctgcagcttgctccgttttctctcttctttgtaagtggccaagtttgtcgcggaagggaaattggctgcttcagtccagtgaaaaggatgtgcttccccactcgtttgctgtccccagggcgggcttgcctgtatagggttgggatgttaacccgctgtttgtgaaggtgcccgcggtggctctgacagccctggagttccagctgcccgtgctcggaagtccttccccttggccttagaaaagttaaagggcacaagaggataactagtggatgactttcaacccgaatgagctcagtgctttctatgacccaagtgctctatcgtgtgcattggccctataaattttcttgccattgcgacgagggagatattaatttcccttttacgctgataagataactgaggcaaagtgacc

SEQ ID NO: 120640 - DNA, 396 bp, Homo sapiens
cgaactcctgacctcgtgatatgcccgccttagtctcccaaagtgctgggattacagacgtgagccaccgcgcccggcctccacttctctttctaaacattacgtgcctcctgcacacagagtgccctgggcttcagagataggactgagagctgtaagaaaggaatcgtgacaatccttccccaaggaagactctagcctgaacctttggagttgagttgaattcaacgtaaatgaatcaagttgaactgaactgaactgaacaggggcagctgctggagactcacatagaaacccactccatcgttctgcttctcctagaccagtatttggggttggggaggtctgagctctccaaccagcaaggctggacacaggccaagttgccaatcctga

SEQ ID NO: 120641 - DNA, 662 bp, Homo sapiens
tgtctcagaggctgcgctccttccagggcccaaggactcacagcttcctccgctgccttcccggaccaacaaccccccaaaagttgtgatgcttttctttacccagtgctttggggctgtattagatctcattcatctccggtttcagcactacaaggctaaacgggttttctccgctgccgggcaacttgtctgtgtcgtcaaccccacacacaacctaaagtatgtgtccagtcggcgcgccgtcactcagagcgctccagagcaaggcagcttccaccctcaccatctctcccaccaccactgccaccaccgccaccaccaccacctccgccaccacgcccacccccaccaccttcaccaccaggaggcggggctgcacgccaacccggtgacgccctgcctgtgcatgtgtcccttgttctcctgccagtgggaaggccgcctggaggtggtggtgccccacctgcggcagatccatagggttgacatcctccagggagccgagatcgtcttcctggccacggacatgcacctccccgcgccggctgattggatcatcatgcactcctgccttggccaccactttctgttggtgctgaggaaacaggagaggcatgaagggcacccccagttctttgccaccatgatgctgattggga

SEQ ID NO: 120642 - DNA, 196 bp, Homo sapiens
tgaagcaatggagagcaaaacaccaccactcttaggaaccccctgtgaacatcttgaaacatttgtcaaaacaaacaaacaaacaacaccccagcaagaagggaaaaaaaaaatctatgatgatcaggtatcacagcactgagaaagttatactgtgtctggctttaataaaaccatgtaactttgaattattttt

SEQ ID NO: 120643 - DNA, 647 bp, Homo sapiens
aacaaaacaaaaaacagcaaaaagtaggtctcctccaaccggattacttaaagtctaaaatttatgtagtagtaccatctagtggcaaaagaggacactgctttgctatttgattatatgtgtctttgtagcagccagggaaataagtgtttatgggttagggaaatgtgaacactgtatattaaggaaatatttatttttaagtataatgatattattgtgtttgtgtttagaaagaatccttgtttaaatatacatattgaaatatttacaaagaagttgtatgatgcctgagctttattttaaaaataagtctgaggcagaggggtggaaatagaggaagtggatatgggtgtagatgagataaaactgaccatgaattgataaaaaaaaaaatcttccaggcttgtgtgttgtttcttccctctgtggtattttaacatctgagtcccgggtccagttcttccgtgtctgttcactactcttattccttacaaatgttcctatgctaatccaagttttatttcctatgcatttcaagggtttcccttattctccagacttttgtgtgtcactgaggtaactgttactgggttatctatataacctttataatcaggtatcatccacaggtgcaacctttgggc

SEQ ID NO: 120644 - DNA, 289 bp, Homo sapiens
actgcccacgctgtgggagctgagactggatgctgttctggagatcccaggatttactgagcatccatgctctgccatccgtctagttggagggagctgcctcccgttgaaagagtctgcccttctttagggaccagggctctgctcttcctgggaatttaccacatcctcttccaggttcccttcacccatcctgcggggtgggaggaatatatcattgttccccttgaggtgcccccctgcgtgggtcacttctcccgctcaccaggcaacacgggcatcttcttgg

SEQ ID NO: 120645 - DNA, 411 bp, Homo sapiens
gcttgcagtgagccaagatctcaccactgcactccagcctgggcgacagagcaagactccgtctcaaaaagaaaaaaaaagaaagagtcccattatttatgcagtcaatggtatcttattctattgcttagcctcactaacatgaaatgttttatcttaaaaaattctggccgggcacggtggcatacgcctacaatcccaacacttggggagcccgaggcaggaggatcatctgaggtcagcagttcgagaacagcctgaccaacatggtaaaaccctgtctctactaaaaatacaaaattagccgggtatggtggccagcgcctgtagtcccagctactcaggaggctgaggcaggagaatggtgtgaactcaggaggcggagcttgcagtgagccgagatcgtgccac

SEQ ID NO: 120646 - DNA, 403 bp, Homo sapiens
cagtctcgtactcctgacctcaacgtgatccacccgccttggccacccaaagtgctgggattacaggcgtgagccaccgcgcccggacactttacttaaaatgttctttattaaacatttttcaaagctgtgggtttttttaattttttttttattttttacaaaaagtagagactgggtttcactgtggtctccatctcctgacctcatgatccgcccgcctcggcctcccaaagtgctgggattacaggcgtgagccaccgcgtccggcttagttttttggtttttgacagtctagcctcactcttgtccaggctggagtgcaccagcatattcatagctcacagtaacttgaacacctgagctccgtctcagcctcctaagtggctaggactacaggcat

SEQ ID NO: 120647 - DNA, 131 bp, Homo sapiens
cacaccatctttagtcccacctccttgggaggctgaggcaggactgcttgagcccaggaattcaaggctgcagggagctatgatcacacctgtcgacagccactgcactccaacctgggtaagagtgtgac

SEQ ID NO: 120648 - DNA, 378 bp, Homo sapiens
tatgagtaagcattgaggcctcaatagttggcaaaaagcagatcttcctgtgggaaaaatactttgaataaggaagaaaaaggagatttgtattatataagtttggctgtctctaatttaaagaaagttaaactttattgcacaacgactactagttctttcttcttcttcttccttctccttctcttccttctcctttttctgtctcctcctacttctccttgtcctttttctcctcctcctcctccttcccttctccttcccttctcctcctcctcctctttctccttcccttctcctccttctcctccttcctctttttctcctcctccttcttctctttcctttctccttcttctcctcctccttctccccccc

SEQ ID NO: 120649 - DNA, 464 bp, Homo sapiens
aagataaaagtaataatggtacctaactcatagattgctctgaaaattaagtaaaatgatccgtgaaaaattctcagtgtctggtacatggttagtgcccgataaatgtaagcgattattactgttactattataatcttctaaacacttcaagacatctgaggaaagtgttcaaagccacaacagagtctgaagctgaggcagttagaaaaggaagaggacatttttgcagtaagatgtccattcctggttgaaggaagactaccctggattggaggtagagggaggtggcaaggatatgaccaagtggctcaaagatacctgtctgtcctcaacttgaacaagttatacatactaaactttcttcacctgtgctgagcaaaggtctctcctccagacatctttttacatttttagttgaaaagataggccagacgcagtggctcacacctataatcccagct

SEQ ID NO: 120650 - DNA, 321 bp, Homo sapiens
atatcaacaaagactggtagagctaaccccaaccatatgaacaaagactggtagagctaaccccaaccatatcaacaaagactgggagagctaaccccaaccatatcaacaaagactggtagagctaacctcaaccatatcaacaaagactggtagagctaaccccaaccatatgaacaaagactggtagagctaaccccaaccatatcaacaaagactgggagagctaatcaacaaagactggtagagctaaccccaaccatatcaacaaagactggtagagctaaccccaaccatatcaacaaagactggtagagctaa

SEQ ID NO: 120651 - DNA, 152 bp, Homo sapiens
tggtgttgagctcctgggcccaagtgatcttcctgccttggcgtctcaaagtgctggtgttactggcatgggccactatggtcggcccagcttgtcaacctttctttttcatgcctatttcttttgtattagctgtgtccctcttgttttgg

SEQ ID NO: 120652 - DNA, 380 bp, Homo sapiens
taggctgtattggccatatggtcttggtcacatctactcgaccttgctcttgtagcacagcagccctagacaatgtgtaaacaaatgggcatggctgttttccaatgaaacttatctaagacaagtggttggctgaatttggcccacaggaggctgtttgccaacccttggtatagagtagtgagcattttagggaagacacttcagatgtgacagtggaggagggggggccattcaacgcctccgggccattcaacgcctccgggccattcaacgcctccgggccattcaacgcctccgccattcaacgcctccgggcattcaacgcctccgggccattcaacgcctccgggccattcaacgcctccggccattcaacg

SEQ ID NO: 120653 - DNA, 492 bp, Homo sapiens
gcctgactgcctctgtcctagtactaccatgccccatctctaactactacattttttcctattgaattctccagtccatgtagcataagtcccttcctgaactcagtttatttttctaaccctggctgcacgttaggatcacctgcgaacttctaaaagaattccaaagcctgagccaagcacctagaagttctgactcattgccctggggtaggactttggcatcattattgttttaaaagatccccagatgattccgatgtggaaccatgttgagaaacactaatctagcctaacccagtgaggttacaaatgaagaatttcaccagagaggtcaaagtacttgatttcccacagcaaagaaattccatttactgggttgaaaactcccatctgttgactttaaatccagcataacaaatatgagcaaggttttagaaggttttggaaactcatctgcagaacagagcaaatacaggcctatctaaaagc

SEQ ID NO: 120654 - DNA, 208 bp, Homo sapiens
ctgagcccatttctgaacttcactgcttaatgaaccacatacgtctaaaaggatggttcagttccttaagtttagcgacctagtcagctagctttcaaacttttaactatttgaaaagcatgaatccaatagctacagaagataatttacaatgaccaaataacaacttaaactaaaacattctgcacaaaagcaagttgcctttgga

SEQ ID NO: 120655 - DNA, 213 bp, Homo sapiens
catcaccctaggtcatgagcatagtacctgataggtagccttcctaaagattcctccagaatctgtattatttgcactcattttataatgaccatgtattatttggtaattttaaaacaatctaaatgagtgctttagctaatatgtggtcattgtttggtttttaaatagagtaaaaaatcctgtttttttccacatcagcaactcaccttc

SEQ ID NO: 120656 - DNA, 181 bp, Homo sapiens
cattccagcccacggggcagcccacggggcaacccactcaggcccccttccaccctgtggaacctttgtccttttgctcttaacaataaaccttgctaccactcagtctttgggtccacaccgtctttaagagctgaaaccttgctactgctcagccctggggccatgccatctttaagag

SEQ ID NO: 120657 - DNA, 167 bp, Homo sapiens
taaaagtctcatccagatggattcccagagtgtgtgctgatagcctgtctcctacaccacccagtggctggtagtgactgtgggtgggatgagttgtgggggaagtctgtgatccttggcagatactctctgacttcagtccaaggtctttagaatactattgtgag

SEQ ID NO: 120658 - DNA, 310 bp, Homo sapiens
tagctgggaccaaagttgtgcgccaccccatacgtggctaattttttattttctgtagagatgggatctcacaccacattgccaaggctggtctcaaattcctgggctcaaagtgatactcccaaagtgctaggattataggcgtggaccatcgtgcctggccctactgtttgtttttgttgttgtttttgttgttgttgttgttttgttttttaaagacaggattgcactctcttgcccaggttggactgcagtggtatggtcatggctcactgcagccttgacctcccagctgaagcaatcctcctac

SEQ ID NO: 120659 - DNA, 318 bp, Homo sapiens
taagaagagtgttctgggcagaggaggagccatgagagggcaccagggtgggagaagcacagcccagcagggcacccggaggaaagctcgtgccacctggagccctgggggtaggagaagggccagcgagggtggtggggccagttgcagggccgggcagaccagtctgattctcagagcagtgggaaccattggaggtttttaagtagtctcaatttaaaaacaagatcactctgctgccacgtggagagcagaatggagcaggtaggagaggacagagggaggctttctggcagggatttgggtgagggtgaggac

SEQ ID NO: 120660 - DNA, 359 bp, Homo sapiens
ctggaattccacatggggtgagggcaaacttaaagaggctagaccccagctgagaggtttaaaggaatgtcttgatgttcagcacatcaccatactgatgtgctcagtgagctttgtcacccattcatttatttatataggcattcactcattcaacaaccatttattgcatgcctctatgcaccaggccctgtgctatgctctggggacgcacgacacttaagagacggttcctcccctgtgatcatgaggggctcatgaaccagcaggggagacagacaggtaaacaggaagtatggctagggggtaagtaccatagtagagggcgacatgggagtgcagaggaggggctccaactc

SEQ ID NO: 120661 - DNA, 680 bp, Homo sapiens
caggcatgaccctccaagccacagcaccagaggaactaagatttgggcctagctgtgctcctccaagcagctgtagtcctctgcctatgatttccctttgacttcctagacctgtgtgacctgtgtgcctccctaaaaaaaatgaatctcaagaaaaactaagtaattgggcaaggcccctttaatggggggtatgctagattgaaccctatattctgctattatggcccatgctaaagcatttactcttagaaaaacggttcccgttaacctctgaaactaaaatcctcttattaattaagtactgttctaattggaaacagactaagtttcttaaaagaatgtagggactgaatggccgttttcctgctgttgggacagcatcagaactaaaatttggctatggaggacattttactcctaactgctgaaggcagaactttcctgttcacagagggggcttagagcctgatttctggtggcgcaaaaggaaggtgcactgtaaggcaaaggaaggacccgcaacatgcctcatgaagaggatttctatttctactaggaggcgctttttggcttagaaataccatgtgctcaccagataaatggtagagagagatgcttactaagttactgcctgccacgtttgccgatcttttctaacagacctgtttctctgaact

SEQ ID NO: 120662 - DNA, 170 bp, Homo sapiens
cttttccccttccttggaacagtgtgatcctggccagcaagagcctgagaaggaagccttgcattttctttttgctaatgatgttttgagttttctctaagtagggaaagggattcattcctccttgttttcccatgggcacattcaagaagcatgagccctatctgtgt

SEQ ID NO: 120663 - DNA, 763 bp, Homo sapiens
tattttttttaagtggagagagcattttttaaaaagtggtcagaagcacggagggtagttttctggattcttctaagcttttgaaaaaggttacaacttctctgtttcaaaagtgcttgtccatcttatttctgcagatacagaaataaggaggaaggctattgggcttgttccttccttcattcagggtttacttagttttattttattcatctttccttttagtaatgaaggtttaaaatagccttggtaggctttttctctgagcacattcctaagttttctgcattgtatttttatttgtgagtctcttttaaacatcatccatgcagaaaatgtgagggactcctacatgctttctacctgtatttatagaccccagtagtagacttactttttaagaaaaattcaggctagactcttagccaaagctccctgcattgtttttgttcttatgtgtgaacacaaacttttcccatctcatatttatgttttgttgtcttttcaagatgcccactaattagtgaggtatttaattagtcaggacagctgaagagtacttcttttttggctgacagtagtgagcagataaccgttaactttctctctgtgccattcaacttgcagcttgttcttggttcgtttgttttaacggtttcccccattgaatcttcccgtcctctgaggggctgggagctctctacacctgggacccttgtcttccttcagcggtgcaagtgggacccatctcctggacctccaa

SEQ ID NO: 120664 - DNA, 249 bp, Homo sapiens
ggaaatgaaatccatgtttattatgtttattaccaaaaatgggaataatattaaagttataaaagcctgctgcaaatataagtgtagtttacatacaggaaacatttcagaagaaactgtatttgagcacattttgtaatttttctttcccaagaaaatgttcagctacttttctatgtcacatgtccaagaaaaaaaaactgaattcatgaaatatattgaatattttatgagcaagtttgagagatg

SEQ ID NO: 120665 - DNA, 260 bp, Homo sapiens
attagcctaagtcaacacagggtaaggatcatcagcatcactgtcttccacctccacaaggattttttcctactggaaggtcttcaggggtagtaacaggtatagagctatcatctccagtgacaacactgccttcttctggaatacctcccgaaggagttgcctgaggctactttacagttaactttttaaaaaaataaataccatactctaaggatagatagcataataaatacataaaccagtaacatagtcatttc

SEQ ID NO: 120666 - DNA, 543 bp, Homo sapiens
cgctgcagtgcgcaggagaccgcggtccgcgcccgagcgcgcccgagccggagcgggaccggggtcggtgcacctagcggatgtgcccggctgcgcgcgccagcgcagcagcccgagcagcggccgccgcccgcgcggcggggatgcccggacgccgggcacacggggctgggccccacggacggtaaccggagcgggggggccgcgccccccctcctcccccctcgccggtcccagagccgcagctgctgcgcccgcgcgctcccggggacattctaaccgccgccaggtcccgccgcctctcgcccccgctattaataccggcggccgggaggggggcgcagacacgcgccgcgcagccataaggaggctgactggccttagtaggtcaggcgcggcactggtgtcctcagcctgcagggggctgcgatggagagtggactcggagaccgagggccgtgtatgggatgaccttacaaaactcctttgcattctcctgcaagcagaccgcgagaagagaccaacgactgaagaaccttcacc

SEQ ID NO: 120667 - DNA, 821 bp, Homo sapiens
  misc_feature (413)..(413): n is a, c, g, or t
cctttttatcaatacaaaatatccttctttgtctctggtaacagtttttgtcttagggtgtattttgtctgaaattatcggagcagctttagttccctttgggttactgtttgcatcatatattcctttccatccttttactgccaacctaattgggtctttaaatctacagtgtgtcacttatatctagtgcttggatagcatttttcctttttttttttttttttttttttggaaagggggccccccttgtggtgccccgggggggggggggggggcccaacccgggccacctcttgcaggccggcggcgccgccgccgggcggctttcgacgaaatctcctctcccggcctttatcgcctttcttgagttgcgcttgggacccccgcggtggtttgcttgcgccccctcngttcgccgtgggctatattttttctcaacaactttttttggctaccagggccgggacattcctccccctgttgtgcgccaaaggtgatattcccctaatatacctccgtgggggcttcaaggcaggctccctcctcgctttggcgcctctccccaaaggcgtgctggggcgtgtaccggggcggtgaccgccttttgccccctggcgggggataacccattttccttatcctctctttattaaatcctctgggcccttttgggttagcgactgttgtttacccccccttcggccttggttattatattcccggggtcgcggtacttccaccccttttccctttgctttttgttttccccccttttctctttctctcacacgtgttctcccttttggttttcctgttcc

SEQ ID NO: 120668 - DNA, 345 bp, Homo sapiens
caagaagggtgggagaaagtggaattgggacacacaaagagaattgctaacagcgcggaggccccagttatcattggtgctactgcaaattcatagactccagtccgcatcagcctaggtgtcagagtagagaaatgaaatggctagactgaccagggacccagaaggagaaggaagcaaaagaaaggtaatagtaggagtaataatactaatgggagtcatagtagagagcaaatgaactgatggtttagaggctcctaatgaaataggaaaggcagagtggaactgatatatcagtgaaaacagaatggtcaggagactggaaagagaggtcctgataaggct

SEQ ID NO: 120669 - DNA, 341 bp, Homo sapiens
cctacctcagggttgttgtgaggattcaagagtcggttcatgtaaaatgctcagaacattccttggaacataataagtgctcaattagctattgttattattcactatatcccactcaagtcgacaaatacttgctcagttgaagtgtggaggttttcctggttgtcattctactaggggaaaaaaacagcacagtaacacccacatattgcaaaccatgattttagagaaataaaagcaggccaaattgggaggatggtaacagatcgttcctctctgccttggtctctgggtgagtttttcaagtacaccctggtttccacagaaaagcgcctgactcc

SEQ ID NO: 120670 - DNA, 212 bp, Homo sapiens
gctggttgtataacttcagtctccttttgcattctggaataacttattaattgtgcattctttccctttgcttgtgttaatcttggtagagagtacccaggtttatgaattctttcagatatttcgcttgaaaaatctacactatttcttgcatgttttctgttccactaattctgttagatatttatatagttacatcagcttgattttcc

SEQ ID NO: 120671 - DNA, 298 bp, Homo sapiens
tggtgtacccttttctcagttttgccaaggtgggtatatggaggggaaattgcttgcttcgctgttgttgctgctaaaggtaaatgagccttgttagattttcaagagagtagaaactcctactgtgataggcaggtgacaacatcctcaattagtctatacccacatcaaactgatagcaccaatctttgtaattttcaacatttatatataggataatgaacttttatttttatttatttacttatttttgagatggagtctcgctctgtcgctcaggctggagtacggtggtgcg

SEQ ID NO: 120672 - DNA, 912 bp, Homo sapiens
cgcccaccaccacgcccggctaattttttgtattttttagtagagacggggtttcaccgtgttagccaggatggtctcgatctcctgacctcgtgatccgcccgcctcggcctcccaaagtgctgggattacaggcgtgagccaccgcgcccggccctattgttttcatttaaagcactaaaatgtttcaatgtttgttaatcagtatagctatctttatcattcttcaccctccccctacatccttatcttttttgcttatgagttttatatcatgcctaacagattataaaactatttacctatgatttaatctagtacttttaatggttttattccttgcattgatatctttgttcatctggaatttattttgctgaaggaaatgaggcaatagacttaatgataaaattaacattaactgggtttgctgtatgtaggttctcataagcccatttaatcctcatgccaatgctataaggtaggttattttattcttctccttctacagaaaaggacattgaaacctagaggggttaaatcacttgtcattggccatatggtttttaagtaccaaagtaggaatttgaccctaagcattttatgtcagagtccatggtacttaattattaatattacagcttccttttcccacaagtctgcgtgctattgttccagtaccattttggggaatgatttctgtgatctcaaaagtgatttaaaatatcacctttagcatatgtacatattttttggattcagaatacccttggattccagtttttcatttttttatttggcttcatttaccttttagagactcagctttaatcctagctgatgtcacaaattgcagaaatcttgaactgaatgttgcgtttttaaaaaatcagttattcatcagctaattca

SEQ ID NO: 120673 - DNA, 197 bp, Homo sapiens
ggaaaggagggaagtgtttttctcaaaaacacattgtagtgttctgtggaaggcagcaagaaatgaagctgaaatggaaggcagaatatagactgtgaacagtcctgaaatcttaaccaacacaggtatttgaactttctgtgtttaatgcagggagaattcagagttaagaccacaaccttttgtgtgcatcctgg

SEQ ID NO: 120674 - DNA, 534 bp, Homo sapiens
acttgtgtgggacctcttgcgtctttcttttggccaatttctcccttttggaacaggagtatatacgcaatgcatgtacccccatagtatcttgggaataattaacttgtttttgactttacaggctcataggtggaagggactagacttgtcacagataagactggacttttgagttaatgctagaatgagttaagactttggggactgttgggaagacgcaattgtatttagcaatgtgagaaggacaagagacttgggaggggctggggtggaatagtatggtttggatctgtgtccctgcccaaatttcatattcaactgtaaaccccaatgttggagatgcggcctggtgggaggtaattggatcatgggggtggtatttcataaatgatttagcacaatccgttctggttgcaacagtgagttcttgtgagatctggttgtttaaaagtgtgtggcacctcttccccaacccctcttgttcctgctccagccatgtgagacaagcgtgcttccccttttccttctgtc

SEQ ID NO: 120675 - DNA, 732 bp, Homo sapiens
ggtgttaggaatgagagaaaatcaatatttctcacatctgcaatgataggggatctgctatggtctgggtcccaaagcccaaagtttctctttctatttatttcctccagtggtaatggtcttcaccctataccctgagtatggtaacgtttaccatcctaccccagtgtcttcaggcttttgttcagaaggaaaaataagagagtgggtctcggatccctccagtcaattcatcctgcagtggctgttccttggctctcctaagcctgccatgtgtgcgaagctttctctagtcccctgccttgtgaccaatctttctagtgagcgcctgtgagatgtattgctaaaagatgtaggtgggtgtaatttcccttgttttttatgctccagtatcagtatactctcagcctatcccacattcagctttgaaacattcattaaatattttacctgaattattattactagtttgtatagcgcccagaatctgcctcaggtaacaagagcttacattcacatctctccctggtagtgtctctcttgtcttaggtttaatgctagttttttgctgtgtgacctcaggtatctgatgggatgaagaaaaactatggttacatagattatatcgcttttcttcttgtcatagtgattggaggtatgttcctttcagatttttctatcttaagtagaagttgggagaaaaatgtacattatcatgtaaaataatatatt

SEQ ID NO: 120676 - DNA, 928 bp, Homo sapiens
atttctggtgctgggaaattctgatattttctcctcatctccattgtacattttagggattcttgaaacttgtgatgcacaaacatccacaccttccacataagtaaaatattttacttagatattttctagcagacactgagttctcatgagaaatcctcagtctctttatttggaacacccccaccccagtattccatatggagtagtcatgtgtagaatgtgattacttcattaatatgtcgaagtatgggtacattttgaacacatttgtgaacttgtaatccctttcttgatgaatagtacctgcggatgagcagatttgatattttctttggagcagtaagttagcactggtagaatctgttctgtaatcccaggtccctgggctccagtgtcaatgcttcctccttagatcctccctgaccctgtaaatttacctcagtctctatttcttaatccaatagctatttcaattgatcttcaattactttgcatgtggccagatattatttatgggttatattctaattcacatttttctgatgtaatttcagagagcctagaaaatataataaactccttctgacaggcaaacgaccccgtccacaacaacaacaaccagtttgtggcagggcaataggcccgcccaggaaaacacctcgcaacacgggcacactatgggacggcgcacgtgcccacaccagggaatccactcaacccaggggcaacagtacagtggaccacaacgaacgcgcaacccccgggccaaggacaaagtggtacggtaggagttctccagcgaaaacaagaagcccgtggggaaccggacggggttccaaacccccacgatgggtgctccagcggcaaccacgacgaccgcaacaacggagcccccaagcacacgacctaaactcgccggcagtgg

SEQ ID NO: 120677 - DNA, 368 bp, Homo sapiens
aaataaatgttcatttagaactgtctacattcttcagaatgtctacatactttagggacctaatgagatgcctttaagggtatatctcaatccgtatttgtgtagaggcagcactttcttctaaaacgtttaatagaatcaggcaaagccataagctaaaattcattttctacttcaatacacagcaggtagactctctccacacactttcgcctatttggaagatgaggcctagtaataatttgaaatgaccaaaggagaggcagaactcttacaccagagccaagatttctgcctgagtatcgaccatttcctccaccttgaatccagcatccccctcccaacattccgctaccatcacttctcct

SEQ ID NO: 120678 - DNA, 537 bp, Homo sapiens
atatttgtgtttcttatgtcttgaattttttttcctgataatgaagtagctcttaatatagcagagttcacaaaataagcaggcagttgctgcaaggtatccaagcaaccattggaaacacacaaacctcagggtgaagttaaaaacatgcactttaaagtcacattgcctagatttgagtcctagttctaccataataccaacttgggtaactttctcaacctctctgtgccttagttgcctcatttattcttgcaggttgataatattacctggtaagtggttgtatcaaatgaactgatatatgtaaagtgattgaatagtatctaggaagtattcagtaaatgttaattgctatttttatgcaaatgtcttcattttggttttactctcattagacatcactcagtccagggcctgaactgggaaactgggaagggtgacaataagaatatggtgaggaatgcacacacaaggaacaataaatcctctttgagcagctataatgtcaagggcaaatggatgtatagggaaaat

SEQ ID NO: 120679 - DNA, 402 bp, Homo sapiens
attcccatcatcctctcatggcctccaggtccagttcactctcctctgcttggcaccaaggactcccggcccaaggtgacctccagcttcacgttcaccaacttctgcctgatcacatgggacttctcactgcctccagatctcccaatatttcacccatatgtttgcaggagggcttccctctgctggaaatgtgcttccctggcctcttcatctagccaactgtccctgtgaaactcactttaagagctacctcctcctagaagtcttcctggattacccccacacaccagtcccctccccagctgggttctgtgcctcctctggcccctgtcatcactgatttgtggccctcactagtctgagagtgtcatgagggcagagaccacactccctaaacac

SEQ ID NO: 120680 - DNA, 314 bp, Homo sapiens
ctggtgttggggtggtgaggaaggtagagggttgagcagaggccagatcacgaagggccttgacatttgaactgtatcctgagcgtgatagggagccctgaaaggttgtaaaaaagaagtgacttacctggtccgggccaccctcgtgaactctagtcccacacttctgccagaccctgtgtctgtgttatttactacgtattcctagcctccagtgcagagtctggcacatgatgccttttcacgtcctttccttgtccctttcttcctatcagccactctgtcttgtccccggcctccatctccttgccttt

SEQ ID NO: 120681 - DNA, 525 bp, Homo sapiens
gtcagcaccataacaatcactattaccatcaccatcattcaccatcattaccatcaccatcactatcaccattatcaccaacaccatcactattaccaccaccatcatcaccatttttaccattaccgtcatcatcataaccatcaccgtcatcatcgtaaccatcaccattatcaccatcaccgttatcgtcatcaccatcattatctgcacagccaccatggagacaggcccgtggaaaagcaacaccccttagtgggatttgctcatcatgatgttggggggttatcttaactgcccccactgcaccaaggtcaggaatgagcagtttagggtgggcctggtggaaggggctccctggcccccaggcaagcaggctctcttgcttaagctgtataggtcccggctgtagccgaaaaatcaactccaagtgtggcatggtcgttggcccaacacggtgcgttggcccaacacggtgcgttggcccaacacggtgcgttggcccaacacggtgcgttggcccaa

SEQ ID NO: 120682 - DNA, 457 bp, Homo sapiens
cgaagctccctttatttaaaacattgatgttggctgggtgtggtggctcacacctataatcccagcactttgggaggccaaagcgggcagatcacttgagcccaggagtttgagaccagcctgggcaacatggcgaaactctgtctctaccaagaatacaaagataagccggtgtggtggtgtgcaccttcagcctcctgagtagctgggactataggcgcctgccaccacacccggctaatttttgtatttttagtagagatggagtttcaccatgttggccaggttggtctcgaactgctgacctcaagtgataaagtgctgggattacaggcatgagccaccacgcccagcccgtaccctgtatttcttgaagtgaagaatataaagtctgtatgggtgcagttcctgagtgttctgctcttccctaaagtttatatatttttttagcttaagt

SEQ ID NO: 120683 - DNA, 365 bp, Homo sapiens
gagacagagtcttgctctcttgcccaggctggaatacagtggggtgatcttggctcactgcaacctttgcctcctgggttcaagtgatcctcctgcctcagcctcctgagtagctgggactataggcgcctgccaccacacccggctaatttttgtatttttagtagagatggagtttcaccatgttggccaggttggtctcgaactgctgacctcaagtgataaagtgctgggattacaggcatgagccaccacgcccagcccgtaccctgtatttcttgaagtgaagaatataaagtctgtatgggtgcagttcctgagtgttctgctcttccctaaagtttatatatttttttagcttaagt

SEQ ID NO: 120684 - DNA, 439 bp, Homo sapiens
tacaacagggaaacccctccacagcctcggctgggcaaagcagtatttactgatgggctcactgggtcagtttctccagctcccaggtcatctgccagaaagcagcccgtggcccaaaactcccagctctgggcctgcccccatgccctctctcagtccaagttttccctgggacttctttctttccccacatccctggcacagtcccacctctgcctgagcactccatgaaataatacgcaactcatatccaggttgctgggagaccacagtgcactgtgaagtgtcggtgctcctggctaagcggcctcaattatccagaagccgtgcctgggaggcagcatgtgctctgcacttgtgccagcaccaaggcgtccccagaagctaccctctttgtgcttgtgcaactgagccagagggaataatggattttgctgga

SEQ ID NO: 120685 - DNA, 627 bp, Homo sapiens
tccctaaattagaacgtatatgaagtttttctcatgattaaaccaaggccgtatgtttttaagagttagaccacaaagttaatgtgacattctcatcacattatcccaaggttaatacctaccttcaatttgactcagcactgttgatgttaatcttgattaactggctgaggcagagtttgataggttcctccattgtaaaactaatctttcttcctccctttccatattatactctgtgaaagaaaatgaaaacgtgtagcctacacttaagaagggcaaagtattgatgcatgtcatcaagggtagagtatctacaggatttatttggaattattccatgtgataaatttgtctcttctctttcatttatttatctattcaatgatttattgattcctctattggttcacatatatttactttatacatttggttaaaacccagtactactttattttatcactcaaattgttctattagtggccattgcaagctctttcattttgctcctatgtcttctgacatacccttatcattgtgtgtgtgtgtgttttttgctgttttttctttaacatattcttatactctaatactacaggatgttccaggcttaccttgtatcta

SEQ ID NO: 120686 - DNA, 447 bp, Homo sapiens
catggagagatggggtttttgtcttttggtttagctttaggaagtttgtgttaatcagccttaggtttcctgcccccagaccccggtattttccttttgatccagctttgggaagtcagagtgaattggccttagatttcctgcctccagaccctggtgttttctcttttaggaagttagcacagagtggccttaagttccctgtttctagaccctattttcctgtctcaataggagctcacaataattgttctgttatcactgttctaatgtggagccatgtccaaggatgctaaaccccactgagctcctggtgacatagaacttgcctcatccaacatgtattgagggccacatttgcactgtggtctccgccatcctcatgggcctcttagtccagaggggagatggctcatcaacatgcccaacctcataggagttcaggat

SEQ ID NO: 120687 - DNA, 387 bp, Homo sapiens
ctaatgtagtgtggcacaccatcactggtgatggcagattgatggagggcagcgattgagccttccccttgaagtgtccattcttgcttgccgactctgcacctttgaacatagacctgttttccctttggatttatttttgtcagtgggaccatgattatcacagtcacataggattgaaaccatgaaactcatagtccctccctcccccttttagcacaatgtcctttattgtccagtcactttatcctcaccccagcctctgttatcatcattgctacacagactattgctaaaatttaacagacttctctcttgctgtctcttcctgtataccactgtcataaaaaaccttcctaaaatgttgctttgcacactgatctcaga

SEQ ID NO: 120688 - DNA, 420 bp, Homo sapiens
tgagtagctgggattacaggcatgtaacaccacgcctggctgatttttgtatttttagtagagatggggtttcaccatgttggtcaggctggtcttgaactcctgacctcgtgatccgcctgcgttggccttccaaagtgttgggattacaggtgtcagccaccacacccggccctgtgttccttttgtccatgaaatcattacttactcatatcgagaaacctagagaacagaggcttctgctcactggccgtggctccctccacagttttcagtcctggttcccagagccaccatcgctccagcagcaatgtttccctgggtgctagcagagagggctgagctgagcttggtccgttttcgtcagtcttggattatgctggagtctgcagaggtggctttcctggctaaatttgtgga

SEQ ID NO: 120689 - DNA, 141 bp, Homo sapiens
tgccatttacctgtgactcccatccccaggtaacagtaaataggttccgagagtttattttttagcataaaggaccaactacaaccttcctagcatctgaaaactgatggtcatgagacttggttctaagagacaataaaa

SEQ ID NO: 120690 - DNA, 475 bp, Homo sapiens
  misc_feature (10)..(10): n is a, c, g, or t
  misc_feature (14)..(14): n is a, c, g, or t
  misc_feature (22)..(22): n is a, c, g, or t
  misc_feature (37)..(38): n is a, c, g, or t
ggtgtagcgntctngaggatcncaggggcatgtatannaccaaagggaccccagaaaaagcttaagaacttagttgcagccataccggaatgggaggtcagacagagcagtctattggtggcaataagatgatcaaattataaacagaactgaaggccatgccagacaagggttaagtcacacagccttggacttcaaaaataaactatgctccaactgctacaaggcttttctttttctcaaggaggtaaacaagcacgggccgccagataagaaatattaaaacaactacagctcatccaactcttagacactgacttccagcccctgttccaccagatatacctttcattaaacaagatcctgatttcagtaactttctccagagaagaagaccaccgaccttagactggttctggttggattaaagagagtgtacccttgcatgccattgtgtcctgcaagacattttgac

SEQ ID NO: 120691 - DNA, 170 bp, Homo sapiens
tgatagcagtgctgggtgcttccatggctaaacataagaaaatagactctgaaaggtttctcaaacacatacccctttgaactcttcttagtttatgaaacaacaggtgttatgttcagtcagaaaaatggaatttgcctgtctggaaagggagaaacatagatgccaca

SEQ ID NO: 120692 - DNA, 510 bp, Homo sapiens
cggtacccggtgtttatcgatgcacatagaatcgatcggagatgatcctatgtggctatggcccaggctccgcctctcgcgaaatgcgacaaaaaagcattattttcagtattgggtctggaggccttgcctgctggtcttcggagagaggcagagggaggtgcctttgtggaccctcataatctgcgatctcttcttttgctctctcgcattcactgtcttcagcaagagctgatgtacctacatgtcaggttcttgtctggggaggacccataatcaggtttaggacaccgagaaagtggtagtgatgaggagggtgtctgtttaatgaatacagtcagaatcatttcattacttattttgtgttcttctcttaatttgttgagtattgttctttccttacttgttaattccaggaataggaattgttaaaacgactgttgaaaatgtcggtaacacagggaagcccagaagggctgcttagcggtggcatcgataaacagcgggtac

SEQ ID NO: 120693 - DNA, 536 bp, Homo sapiens
ctgccccatctctccaccgtcctaggtgtgccaagagtcaattgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgattcctgatcacccactgataccaagtactcatccccaagattgttaaacaaggccagacactcctggcctcaagaggatgggactgaaaaacaaaaagaacactgaagacccagaggagcccctgatcgcctcccagagcacggaacctgagatcggtcacctgtctccctctaagaaggagaccatcatggtcaccctccatggggctaccaacctgcctgcctgcaaggatggctccgagccgtggccctat

SEQ ID NO: 120694 - DNA, 304 bp, Homo sapiens
tcctgggttccagctattctcctgcctcagcctcccaagtagctgggattacaggcatgcactttgacaccccggctaatttttgtatttttagtagagacggggtttcaccatgttgtccaggctggtctcaagctcttgacctcaagtgatccgcccaccttggcctcccaaagtgctgggattacaggcatgagccactgtgcctggccacgaaatgaagagattttactacctgaaccttaaaactgttcctgagaaatcaccaagaagactgaccagcaaatgaaaacctggaaaaaaa

SEQ ID NO: 120695 - DNA, 692 bp, Homo sapiens
caaacgaaggacacgctctttgctacttggcaggaagaaatgggcttagattaaaacttggccaccaagcagataatctgaatataaataaagaattctttattctaaccaccagacttacggtgagccctgggttaaaagattccatttgtaataaggcctgcttgcttgggtgaatcctgtattcattcaaaaacacaaaacatgactcatgcagtgaaatttgacttctaacactgctgattaccttaagagaaataagctaattgaggagcagaaaaaaaagccctgaacattttatttcagaatgtcttccctattattaaaatataaatatatataattttgttcattaacagaaaatagcacacttacatttagtttccactgcaatttagattcagaacttggtaaatctttaaccagacattttcacttaactaaaatctagtttctgtttgaattaatctggtacaactactcatggtcatggaagcagagacttcacgtcacaaatcactcattgttattctatccatgtcaagtaagacttacatgattttttaacccacagcaacatcactgcacaaaagtaattttcacagtctactattaaatcttctactagagcttctaaaagcaacaagttctggtctaatttgagtttatctcttctttctttcctagcttaa

SEQ ID NO: 120696 - DNA, 104 bp, Homo sapiens
ctccggctcaagccccgccccctgcccggcggctccagaggtccgcggctccaggccccgacccctgcccggctgcacaaggcgtcctctgggccaggccccgc

SEQ ID NO: 120697 - DNA, 533 bp, Homo sapiens
tggtttatcgatgccacccgcctttgttttcttggctctgagtcaccccaaaggtggatgcctggcaggggtggtatcaatccccaaggataagtccctaagaatctagttcttcctacctcttggcagctagccttctttgatgtccttggggtgttttatgtgaaactctattttctcctactgtcctacaccttcagtccctggctgtaagagacatgagatgaaaggtcctcccgtgttgtgtcttgtgccttgtgttcaggacagcatatccaagtgtgtatgggccttgtccaggcaccatttagtatggggctattttcctgatctgtcgccactggacacccatatcctgagcaaagtgagagctgaacccacctggctacagtgtcactccttggcagtccctggaagaattcttccactcagaactttgtgatgacttcacaaagacaacaaaaggaggaaagtgattcatagtggcatcgataaacagcgggtgataatcgaggcgcaatgggtggtgacat

SEQ ID NO: 120698 - DNA, 200 bp, Homo sapiens
ccactctctctcatccacttccggatgtggctacagacttctgccaggatggtgtagaaaaacagaaattagctggagtagaaataactatttttctctgctcctaaactattcccaaatctttaaaactcagggctacccatgaatcttcaactttgaaaccacccttcaaggctcctgaagtgcccaagggctgagcc

SEQ ID NO: 120699 - DNA, 242 bp, Homo sapiens
ccattcaagtttataacattcaaggaggtctttcctgtctgaaacacttttaaaggggacaaaacctatttcgtttttctcactcagatatcgggatgtgggtaggatcagcaccccacccaaactccaccattatagctgccatttgaaaactcctgttctgatgaaagggaaggtgatatgcaacgggagctagttcatcaggaattgcaactgtgagaaaaatggatgaaaatacaacc

SEQ ID NO: 120700 - DNA, 391 bp, Homo sapiens
tttctgacattcatgttttcttgatgcctggctttgtgaccaagtgcaattgctttcccttctattaacagtagtcatctggctgctgtctagtttctggtcttaactttttcatcaaaatttttttttccttcttttttgttttgtttttgagatagggtctcactcttgcccaggctggagtgcagtggtgcaagcacagctcactacagccttgaagtcccggggtcaagtggtcctcccacctcagcctcccatgaagctggtactataggcacgagccaccgcatctagctaattatttattttaaaaaatttttttttctagagatggcgtctcattatgttgaccggctagtacacaactcctgggctccaagcaatccttctg

SEQ ID NO: 120701 - DNA, 110 bp, Homo sapiens
agcctcccaaagcgtggagatcacaggcatgggccattgcactcggcctctctctggttttcatgtgaatagtttgctctgggaaggcaggaatgaaaacagaaagaatt

SEQ ID NO: 120702 - DNA, 472 bp, Homo sapiens
aaaaccaggtaaagggcacatgggaaactctgaattatgttttacaattgcacatgaatctaccgtgatctcaaaagaaaaagtttaatttaaaaatcaaagaaaaagaggtctaacactttactactaataataagagattagaaggtaaggagtcaagagtggaaaatgcttaaatttgagatgtgttcaaatgaaatgtaaacacacaacagtagatgactgtttagttataattaagagtttatgtaactacacattataaagtctctcctcttaaggttgtgttatggatacctggtgacagttgtagttatttcatcttcctcattctgtaccagaactttgaagagctgattcaaaattataggcagaaaactcatgattgcatgaatcttttccacattcaataagttctgtagtaaattggcagaaaaaaaggataccaattaaatttgaagcatgtcctaca

SEQ ID NO: 120703 - DNA, 582 bp, Homo sapiens
cctgcagctctctctgatgtatgggaccatgtaggtccacctacccttcaccaacagcaacaagcgcaaccacttgctcaacttctctcaggccccctcagctgcaagctacatgaagacagggattggctccaccagcactgccaagcccgctgtgctagggctctcaacattcagcagatgtgcctgggatctaaaaacatccacagttcctcaactgtaactgccaaatccaagaagcactaaaacacagaagttttctaaactcaattggcagtaaaacctcatccagcctcatttggtaaaatctgatctgatctaatatggggctatttatagtcttttctctctcctgctgtggctattcatacattttgctacagaaataaacatggtggcttatgccatgctgcttctgatcttccactacagagtaaattcaccagatcatcttttcaaaatccaaaaaattctcaattctgaaatacatctaggaccaagaacttcaaaactatgaaaatggaagtacaaagttactcattgactgctagcatcccatgttcaagcctccagccctttaac

SEQ ID NO: 120704 - DNA, 1307 bp, Homo sapiens
acagagctggctgggcagcctcaagctggagccctggggaacagcctgaaggctgggagcactgacaggccgcttctgagccccaggtgaggctactctttaaagacaggcattttacttgcagcaaaatgtaagtacatttcctccttgaaatggtatctacttctcagctgtaattcctaaagcctcctaatctttaaggctcccatctcacattgctgcatttttaaagtctagctcagcacacacagccaatctaacatttcatactattgatttgtataacatcatggaacatttcagaaaccaatttggaagcagattgaacttaattgtggttgtgacaatattacgtctaaaggtagataaaagtgaggagtaaaaaaataggcaatattcatttatatattatgaccatgtgacactaaacatttaaatattcagttctctcaaatgactaatttattattcttttcccagttgctcctcaccgtgtggtcacagactgtttcttgtttaacggcatggtggtaaccttaataattccttcctgtgtgtactgcgttatggccactctgtaaacccgtattctctccagaactaatctcctgtgtattatgtttctttattcttagtacttccagtgtctatacccaaattacaaatcccctctattctgaaagaccaaagaaaattttagcagatctgaactgggagttctgagttttgtctttggaattagggtgattttttttttcttttttaatgaaatgaaggtaagaataattttaacaaaggaaaaaaagaaagtttcatatgtctctggtgtaatttaataatatccaatttacaaaagcaggaggtagatttagctttagtataaagaccctagctgttcaaaagtagctcaaaatgtagtaagttgcttgtcactaagcaagtaatcaacaactataaggtagatggttgagtcatgtaccctcatggaggatacatcaacttctaattcatgtagaatttccagcagagaatacatctcagtagtcactgaagcatttaattagacattctagtacctatcagaatccaaagagtacagttgaattatatatattatacatgttctaataaattctcttttgaatcattcagttcctgagaagattatgtgttcagctgaactgcaggagaaacttagtttttactgatttccctaggggttggttttttgtttgctctctagaataaattgatcccactgctgtacatcaaatactcaagcgttagcacaaaagacattcaccctc

SEQ ID NO: 120705 - DNA, 479 bp, Homo sapiens
tcctttctctttgcgttttttgcccctacccttttttctcttttgtggccttaacatgattgtcaaatatttataaataggagtgagcatctttatattactcttactaataagatacatgcttaatttgtcattctttacctttttgggacttaatgaatgtttgtcttttgcagataaaatggagctgctagaaatagcaaaagccagccacccatattaacccctccattttccctataattaatggctttcattattgtggtatatttgttacaattactggactaatatgatacattattattaactgacatccacattttattcagatttctttagttttttgcctaatgtctttttctgttccaggatcccctccagaataccacattacagttaattgttatgtctccttagtctccccttggctgtgtcagtttcacatactttctttgtttttgatgatatagatgtga

SEQ ID NO: 120706 - DNA, 438 bp, Homo sapiens
aaatgtttgaggtgacagtccaattattctgagttgattgttacacattgtatacagttatcaaaatatcacatatgccccccaaaatacatacaactgttacatatcagtaacaatttttaaaataagtgttagtagcagattggtaaataacaggtcctattggacctactttaataagtagatgattatttgtaatcaatgtgtaactaaatatatttaaatagatgctactaaaatgtatgtaatggattaaacaatcttcagcagttttaatcaaattgttactctgcttagcaactctgtctttgaaataattatatgatatctcagttcagttttataaacaacataattcattttcaatcgagaaactgacattaataggactttactatacattaatatatctctttttttctttagacagggtcttgc

SEQ ID NO: 120707 - DNA, 241 bp, Homo sapiens
gggcaatacagtgagaccctgtctttacgaaaaaaaattaagttagctggttatggtggtgcatgcctgtagtcctagctactcgggaggttgaggtgggagaattgctcaagtcctggagtctgaggttgcaatgagctatgattgcaccattgcactccagcttgggcaacagagtgggagcctaactcttaaaaaaaaaaaaaaagaagaaaaagagttcctgtcattcattgagggc

SEQ ID NO: 120708 - DNA, 570 bp, Homo sapiens
agcatctttaggaaagaccaaaattgaaagccaaggcagagacaggggaggtagttttgggacagcagaacaggaccagggaaatcagagggaagcttcagagtggacaggtgtgagctgaaggaacttcccccttcatacacagcttgttgccttttcctaaacattgataggaatggattttattcttggctatatttgagtgagggtcccttgtaattagtcatgcctgaaataccagttatgtatggaatcaaccagactagaatttgagtctcagtgcttactagctaaataatcttgggaaaatcatataagttatctgtcaaatggtctaataatagcacctaagtcatgtggttgttgtggggattgaggcatcccagggatctgggataatacatgtaacatcctggtacagtgccttatacttggaaaatagtcaatgaatgttagatgctattatgatggctgtgaagctattacagtgtttatatgcatgtatctcctacctgcagggctggaaatatttttatctattacttgcctggagatataaagtaaatggac

SEQ ID NO: 120709 - DNA, 754 bp, Homo sapiens
gatttcttcaaagtatttttgggtagtgtaggtatcaaagttaggatttgaatctgggtttgccagtcactgacaacaaagcccaaatttcctccactacacaattgcatagaagaaacagaacaaatatgaagtatgtcagaagtaaccaaccatgagcactgtgtaatgctagaaccagaaaagcagaattcccaacctttctgtgttattttccactactttgctctttctcactgggctttggctgacttacccttcccactgttccctttacttagaatattcttccctccattgtttgcttgaccaactctttcttatccttcatgtctcattgcattagtcattttttggagagtaggggactttgctgaaatttttagatccttctactaaaagtcacatagcactatgtttttcttccattgaatgtgtcataattgcaatgatacagttacttgagtgatcaattgttttagtcagattgtaaactccataaggcagggacagtgtctgtcttatatacaatgttttttttttgtttttttttagcaactagcacagtgcctgacacatagctagctagttgatgttcaatcaggaaggaatgaatagatggcttatatagcttgctggagatctgttttcaagtaagatattttaaaattttattttataaaataattttgtccttatgttttatagcctatattatgaaatattgggaaaaactttatacttatgtagtagc

SEQ ID NO: 120710 - DNA, 206 bp, Homo sapiens
cagacaaagaaacaaaaaacatgtatgtgtatgcatgtatatatatatattatataatatttaatatgtgtatatataatctaaaagaagaaaaagtcgaaaagcttatttctgcctaaactgtttacaaactaaagttactataaatttattattaaaatgtaaataaaatttactaaaactacattgatgataccaatgtaata

SEQ ID NO: 120711 - DNA, 273 bp, Homo sapiens
cctcagcctcctgagtagctggtactccaggcatgcgtcaccatgcccggctaattttgtatttttagaagaaatgaggtttctccatgttggccaggctggtctcaaactcccgacctcaggtgatccgcctgccttgggcctcccgaagtgctggaattacaggcatgagccaccacacctgaccaatgaatatatttgttttgtggtaaaactctaagcaaagctgcatcttaggcccttggccataaagcgtctcctttccctgtcaca

SEQ ID NO: 120712 - DNA, 392 bp, Homo sapiens
cccagcctgggcaacacagtgagactctatctcaaaaacaaaaacaaatgagctcgattaaggcaagttacaagaggcatgttataaattaggaggcggtacgtgtagttattttgtgtctttgggttttccttaccataaataatatactcatgggccaaaaactgtaatgggaatttctacaaagaagtgagagtggccggaaaatctgagctagaaaaagaggccaggcatggtggctcacgcctataatcccagcactggaggaagccacaggaggaggattccttgatcttaggaatttgagaccagcctggcaacatagagagacctcatctctacaaaaaatttttaaaaaattagccgggtgttatcgggtccagccctactgg

SEQ ID NO: 120713 - DNA, 295 bp, Homo sapiens
tcttaaacctctgaagagaaaaatcttattaggaaaatctttatagttaagcagggctgactttgaagtgaggcacgtgcgctggctggtatcatcactccacttcaggagatgtgaacagttgccatcagatgttatctatgaacttactcattggattaatggttatttgcttcagaaaactaaagagtaataggagagcaattcatttgctggctttcatagggttcttgttttgaaaaaggtctgttgttgaactgagatccttacagttgcatttccttatacctgataa

SEQ ID NO: 120714 - DNA, 364 bp, Homo sapiens
ttttcaacagggcacagtatcttcttcatctcacagtctatctatgtgggtgtggcagaaggatccagagtaaaatctcaaacacagtgatctactggttagggatgataatatttaggaaattcagtacgcctataggataagaaagtgcgtccacaatttgttcactgatccctttcttgtatgaggtggctctgggccatgttctttctgttagggctgataatggagaacaatgacggatctttggaaggctctgattgaatgttacagttcaaggtttgacctcaagcagcagcatcctattagatggagcatactgctacctgcaggaataagatgacagtagcacctccctattccc

SEQ ID NO: 120715 - DNA, 458 bp, Homo sapiens
gtggtgaagataagtgaatatttatcctaatcttaatgaatttttatattctgtctttatggttgaaatcccccatatcgacttcatgactttcaacgtattaaaaattcaaaaagttagaaataagttgaatataagacagaatgttactaaaattttaaatttacaaactaaattacaaatactttaaaggggaacttctttctcttgccctaaaaacaaattaacttctatcccagctctgtttctcacagctatcatctttctaaaagtttcctgaggttttatttaatcacagggaaagataattttgaaaaaactaataaatctatgcctgagaaataaaagatttgtcttctgaaatattctgagttttgagacatgttcttcagcgtcatcagaaaatcaaagtgcagtctttggatagtgttcactaagcatattatgtaagcaccgta

SEQ ID NO: 120716 - DNA, 272 bp, Homo sapiens
agtcggagtcgcgttgaagccagcgtccggccggcagagcggcgtcggcggggttggccggggcggtgtggcgctagagcctgggcgggccgggggcaaggagtcaaggcttgggggcgggtgacgggcgggcggagggcttgcccccgtgtggtcctcggagcggcccgaggtccagcctcccagcggtcccggaggaggatgcgaccggggggccccgggcggggcggtcggcggcggctgcagcgctagcggcgcgggggctgggcggc

SEQ ID NO: 120717 - DNA, 618 bp, Homo sapiens
cagcccgagcaggctcaggcagggaaggcattgagacgttcctcctctgccgtttactcagtactatcgacttgtccttcttcattattcagcaagtaattctttccatgagctcccatcgatttccagattgaaatatttcttgatgagctttgtaatgagaatctgtttcaaacgaactggtgtctggttagagcatttcaccttgggccagtttcattgtggaaacagcatcaattcctctctagggacttctgggttccctcctcctgcctcttactggggacatctgtgcaccctcttcctggggtcctcctggggacatctgtgccccctcttcctcctcctcactggagatggacatctttgcctcctcctccttgtcctccctggggacatctgtgcctcttctcctggggtcctcatttcttctgatcctccctggggacggctgtgccccctccccctagtcctcactggggacatctttgcttttcctcctggtcctcactagggacctctgtgccccctcctcctggggtcatcattgaggacatttcagctgtcgcgtaagaagcttgcactcagagccaggcaagtggcagctgttccacaaac

SEQ ID NO: 120718 - DNA, 748 bp, Homo sapiens
ctgaatcatttttatgttaatgagttttgccaccatctgcttttttgtacattgttactataggatataaatatgggcaaatcttgccatttccaactgagatagggaagtacaaaaaagaaaagagttcaagaaccttctgtgacagtgagtaaacagtgaatttagtactagaaactatagtattctttttccctgactcagctaaaatgtagtttaggaaaaaaaaacaaacaattgaactgggctgttcaaattccaacactgtcaattaacagctatttggccttagtcctattgttctgatctttgtaaaggtcactatccacatctgcaaagaggaaacaaaatgacatgtgtataatagggtataaaaaagaacctgtcagacaatgtacatgaaaatgtttggtaaattgtaaaatacattatagtggcaggctttagatcacctccacccctccccaggccgggcgcggtggctcatgcctgtaacctcagcactttgggaagccgaggtgggcggattacctgaggtcaggagttcgagaccagcctggccaaactgatgaaaccccgtctctactaaaaatacaaaaattagctgggcattgtggcacacacccgtagtctcaactacttaggaggctgagggaggagaatagcttgagcccgggaggcagaggttgcagtgagctgagatcaccccacttgactccagcctgggcaacaagagtgaaactgtctc

SEQ ID NO: 120719 - DNA, 398 bp, Homo sapiens
agcccagcaactccagcccaacaggtctggcccagggctcctgccctgtggggacagtctgaggtagagtgaccagctcctcccagtttacccaggaccacctggaaagtctcctgtcttaggaaaccactcaatcccaggaaaatcagggcactcggtcaccctcatctgagatcctgtcttgccggctggtgggctgtgcagctggctcaccctgcaggctctaggcagttgggaagagcaatattgctcccagaagctcctggtctgatgggaggtgatagagacatccaaatccaagtgacagatgctcacttagaccctgttacagttcacatgacggacacagaggctgcgtctctctccactgccatacaccagctcccagaccccatctc

SEQ ID NO: 120720 - DNA, 423 bp, Homo sapiens
ttttatgaactaatagagtgagaactcagtcactgttgtggcagggcagtgggcagagggcaccaagccatttatgagggatccacccccatgacccaaacacctcccactatgccccatctacagcagtaggggtcacatttcaacatgagatttgatgagaacaaatatccaaaccatatcacatgctaaggggaaacatgcttaaggaaaagtaaaaggaagagcatcatgttactttgagaattggtgttgtaattccagagagaaggagcagccaaacctggatgagaagcaacaattttagcaaagactcaactataatatagcacctgtctagccatttctgcttacagaaaaattcctctgcatagcttagtctccaaaaacagtcagtggcatcgataaacaccgggtaccgag

SEQ ID NO: 120721 - DNA, 235 bp, Homo sapiens
cctgaagactttgagtgtaatttgttaatatctgatggctggattggtcataagggtggtaagcagcacttaatggattggagggtgtgccacaggatgaattccctacctgagccacttcttggtgactcagctttccatgctgtgaaatggggagaaatggaaaaattgcctttgctgagggatatgtggagaatttccatttttgctctaagaaaaccagaggaaacgtccc

SEQ ID NO: 120722 - DNA, 500 bp, Homo sapiens
cacgtgcagctaaaatgtattcttttgctttgtatgttgaccctcattttgcccttcagagcccacagacaatgggagacctttagccatttgaagagagatgccttaattctccctgggcctttgctttagggaagagaaggggaggtaatgtttgccaagtgtcttctgtgcaccaggcatttttctcatttttgatgtctcatttagtcatcatttaatcataagaatagcatttttctcatgtaaatctaactggcctgagcagaggttgaacctgtgacttgacctccttgttgccaccaggcagtaaaccattcagtactcgtggaccatgtcaaaaactatttgttcaactatcagacactgtacttagttttatgaggatactgcctttcctcaaggtgctcagagtccaaagaaggagacagacacagtattaggttaagtcacggggcctggatcacacagttagcaagtgctagtgaagttgggattta

SEQ ID NO: 120723 - DNA, 662 bp, Homo sapiens
agcggggaacaatcacttgagctcgagtcaagaccagctggggcgacatggcaaaaccttatctccccaaaatattcaaaaactagctgggcgtggtggcatgtacctgtagtcccagctacctgtgagggtgaggttggaggatggcttgagcctgggaggcacaggctgcagtgcaccgagatcatgccactgcacgccagcccaggaaacaaagtgagactctgtctcaaaatacacacatacacacacacacacagatttttttctgagatggagtctcgctttgttgcctaggctggaatgcagtggcatgatctctgcttactgcaacctctgccttccgggttcaagtgattcttgtgcctcagcctcctgagtagctgggattacaggcgtgtgcaaccatgcttggctaatttttgtatttttagtagagactgggtttcacccatgttggccagggtggtctcgaacttctggcctcaagtgatccacccatgtcggcctcctaaaatgcggggattacaggcatgaaccaccatgcctgacctgttctaccatctcttttataaatattggtctgcttctctttgaagggttcttattctagtagtagaataagatagaataagatcatgtttgttatctctgtattgaca

SEQ ID NO: 120724 - DNA, 107 bp, Homo sapiens
actccacatcagaagtagtggcagtccagtaccttgttagagatgatctataattcaaagtactttagatactctgttattgaataaatgaaaactcagtggctgct

SEQ ID NO: 120725 - DNA, 745 bp, Homo sapiens
tcgtacccacagatcacaaagacgtgaagtaattgtactgtgatgagttcatagatcaaaaggcacggcgagcacagtggcccatgcttgtaatcccagcgctttcagaggctgaggcaggaggatcgcttgagcccaggaggttgagtttacagtgagctgtgatcacgcctctatactccggactgggcaacagagtgagaccctgtctcaaaataaataaataaatgagcaaacaaacaaataaactctggattcttgtaaacggttttgcaaatgtgaaaattcagtataatagtgacttgggtaattcagtgttgatatcttttcttgttttgattagagaacaaggtgggcgtggggtgattgaaacagtccctgtttccagtgggagtggagttgatggcatggtggaaagggtgggctttcaaggcaggccattttgatgttgagggacacaggctctctggtgaccttgggtacattacttcacctatttggatttcagtttctttgcatgtcactgcctgatccataatagaagtacttttccaacctatcccctaagtcaaatgtcttctctttgagaacaaggtgtcccaaccttaggagtctgacatcattcagaaagtggagagagcctgtcattattctctctcatgcatctttatttcctctcctctccagctcctacattgtgctgtaaacacaggcctctgccttgaacacatgtttgccagatgct

SEQ ID NO: 120726 - DNA, 568 bp, Homo sapiens
gtgaattgatagttattttccctttataaggaatatacatgattggtgtaatgatgatttgaattaaacttaatatgcacaggacctttttttaggcaattaagatttccactccctttgcagtattttatgtagaagaaaagttagaatgttgcaaaactgacagtagtttggtaattatctataatagttagcatatggatgatcctgactctagcgtgcttggacctaaaatttaactgaaatttgtttcttgtttttttggaccttttaaaatgcacatgatcagaatcagcatagcctattacaataaggttttgttattagaagacagctgaagaaaaacataatcaacaaattcaggttacttttggattcagcttattcttaggaatatttactaagtggataaaagtacattaccaaatcatttgcaaagtatgcaaatattacagagagcctactatgtgttagacactggacatatagcagtgaataagtggggtcaggttttccctctctccaatcttatattcttttgaagggaatagacaataaacaaatagaa

SEQ ID NO: 120727 - DNA, 102 bp, Homo sapiens
cggagttggcactccaggctattaaccttcatgcagctgagcagtagaaatcgtgcctcctgaacagcctcccctgggaacagccctaccctagttgcctca

SEQ ID NO: 120728 - DNA, 382 bp, Homo sapiens
ggaccctccacgatctccacagctctttctccatgcagccttctcctctctgattccctgtcctgtggactctgctcctgggtctccccagaatcctagctttgtctccccagttcagggatcctactgggctctacctgggtttcccttggtattagtcagcccagtctgtcatacaaaacaccacagactgtgtggattcaacagcagaaactttttttctcactgttctggaggcttgaagcctgagatcagggtgccagcaagtccggtttctggtgagggctctcttcccagcttgtagatggccgccttcttgcagtgtcctcccatggcctctcctctgtgcttgcatggagagggcactccagtgcctcttcct

SEQ ID NO: 120729 - DNA, 360 bp, Homo sapiens
caaggcaaagggcatggctacagggaggggtgaaggattgggacaatttttgcaatatattatatagcccatactgctaatcaaatcaaagtttatagatctaacggaagcgtacgatttctgatttccttgatgaaacacttatcttttcagctttactgatgcccagtctctttttgataggctgggggaaagtcagagaaaccagaaatgggaaaaggttgaagtgagatcttgaaagggataggtaattattaacaattagctattgcatgcattgtataatttcagatgtacccggctcatctccttttataggacactgaagcccaaagcagcacagtgtatcacccacattcc

SEQ ID NO: 120730 - DNA, 461 bp, Homo sapiens
cacttggtcagtgaaggagtctttgctgagcgccaatgacttgcacagaggtgtgcgctctgctccagggatgtctttattcaagtcttaattctgtaactttaaacgttttctcatttttaaaaacagtcacatcttataatgtctgtgtggtgctttctaattgctcataaatgtggcctcctgtggtctggtccttatcacagtcctgtacggcagatgtccagcaataagggaactgagatgcagagatcatgccactacactccagcctggcgacagagcaagactgtctcaaaaaaataaaaaaaagaaattagccaagtatggtggtgtgtgcctgtagtcccagctactcaggaggttgaggtgggaggattatttcaacccaggaggctgcagtgagctatgattgtgccatttgagctccagcctggacagcagagcaaagaccccaaaag

SEQ ID NO: 120731 - DNA, 264 bp, Homo sapiens
ctgagtagcatcagaggccacggttctcagcaacacttctgttatgtactgagaaaccttgaaccggtcataatttctttgggtttcaattatgaagtcaaactagatgacctttaaagaatttcaagttctattatcttttgatttttacatttctcataggacccaatatggaactgagtacagctatttatatcaaaattattttgtcttcacttttttttttttttttgagacggagtcttgctctgttgcccaggctgg

SEQ ID NO: 120732 - DNA, 306 bp, Homo sapiens
cggggagaggggctgagacagacatattcctgaaaggaataattactgcgtgatagtggaaatatacacaaagactttgggagtaacagtgatggagggacccattgaaaacttactaacgtttacagctgttgttaaaattcatccaaaccagccaattatatctacattctctagaatgaaagtacaaaatgattacagtggatgttctaaacaccagtgttgacacaatccccttttcctactggaatggggatctaatggggaaagtgaaattctttctcaaaaccttatcggtgttgatac

SEQ ID NO: 120733 - DNA, 700 bp, Homo sapiens
attctggagaactcttttttacacaggctttgaacaaacctccctattgccagtcttctctttattatactgtgctaccaatttctgttttattgggtgtcctgaggtgtaaattgggttgcctttttgctttcacactgctgtgttaggagtttgctttctggagtctgttaaatcaattaccacttgcccatatgctttctagcttctaaaaattgtttttgttgccttttccattttctttttttttaaattcactctgatttctttctaatttttatggttttacttttttatatttaactttttaatttgttttgaatttactttggagtaccaaaacaacatgtttagtgtctttgtacatcgtctgagctccagatctgtgcttccaactgctggttagaccatgtggaccgtctctatgccccatgcatctgcattcatctagttttctggaggggtctcttccatttttttttaaactaatgggtttgtctttttattttttactttatttatttatttatttatttatttatttatttatttatgtattttcgagacagagtttggttcttgtcacccaggctggagtgcagtgtcacggtctctcagctcactgcaacctctgcctcctgggtacaaacaattctcctgcctcagcctcccaagtagctgagattacagtcacctgaac

SEQ ID NO: 120734 - DNA, 575 bp, Homo sapiens
atctgaataaaattttcttctattaatttttgaattattgtctcttctccaattgttggcacttccatttgtggaaccctattattcacattttatgttatattacttattactttattatatattctttaccttattttattatttattattgagctactcctgtctgccactattttaggtcttaatgttaatcattttgcttttactaatcccctgaataatttgcttcaaaaatgtaaaaatattacatttttaaaagtttgagagctcttttttccacagtgcttgaattttattaaagtttatattgtttttgtttttacttaaattgttttctgtcacctgcagctgttctatttctctagatgcttgttttgtaatctcaggcatagcaggctttgctctactgttcaactgctcctcaatgtcatacaggcagtgacatgtcctgggggccatgttagtctcagcccaagcagtaggccagctttgactgttagattcctctcatggcccaaggtctcacatgcagccagctgctagtcagttccagatgttctctgaaggagcag

SEQ ID NO: 120735 - DNA, 532 bp, Homo sapiens
aaaaaaataaataaataaaaataaaaaataacaatcaggaacctgtgccttggagaggttaactaacttgaaggagctcatagcttaggttgattccaaagcccgtgctctcagaaacattaacccctagttataatttcctgtggcaagaatgaaaaatgcaggttttcaggcttagaaggatttttaagcaagtttatcaggcaggagtagatatagtaagttgccaaaatgtgtgatgctacagaaccccatatgggccacttcagggggacctggtgaaggaatctcacatttattctaggagtctgggttattgtagaagagttttttttttttaatcctccttaggttctgaatccctttatgaatctgatggaagctaaggatcctctctttggaaaaatgcctgtaagcactacatacatgtttgtgcataattccagagggcttggaaaacctttgtaatccggtcgtggaccccatttaagaaccctcctcgagggtagcattttccaagtgcaggacacat

SEQ ID NO: 120736 - DNA, 177 bp, Homo sapiens
tccttactttattttgttttgaatctcatcctgagtcaattgtttgagttgacctttctttttagaatcttaatttttaaagccaccagtagccacttaaaggccatcagttaccacactggagcttataaatattttcattttcctaattttcaataaaaaagttggattgtatta

SEQ ID NO: 120737 - DNA, 745 bp, Homo sapiens
agcattcaacagagttgactgaaacatggatccctaaaatggctctacaactcgaaaaagttctgaacgtcaggtttagcttttgagtcatttcccccgctgtcaaggtggcaaatatatagcccaagaaggtggcttttgagtcatttcccgcaaggtcaaggtggtaaatgtgcagcctcagaacctcaaggataatgcgacagagctgcaaaatgaatggttgctccaaagatggaagcagcctttgtaaaactgccttagtgacagttaacttttcaacatcatacaatttttgttaacaccatgcaaaaacctatggtgttcagcagcatagcatactctataccgtaaccaaccctcttactgaagaaaagacatagtggataaattgcacttccaaaagttcttttgaatacctcaatgaactggcaacaacgtaagacctgttatagattgaattgtataccccccaaattcatacgttgaaatcttgattcccccaaatctcagaaagtgtccttgtttggaaatacggtcattgcatatgtaattagtttagatgagatcattctggaataggataagcccccaatccaatatgactggtgtccttataaaagaggaaaatgtgctagctgggtgcagtggctcatgcctgtaatcccagtattttgggaggccaaggtgggcaaatcacctgaggtcaggagttcaagactagcctggccaacatggtgaaacc

SEQ ID NO: 120738 - DNA, 1019 bp, Homo sapiens
gacaggaagattgcaagccagtctcactcatgaatatagatgcaaaaatcttaagcaaaatatttagcaaaccaaatctagccatgtataaaatagataatatatcattgccaagttgggtttgttccaggaaagacaagagtgatttagcattgaaaaatccacgtgtcattcagcatgttaatagattaaaggagaaataccaaataatcatataaacagatgaaggaaagttatttgacaaaattacgtgctcattcatgataaaaactctcataaatagtaactagtgaaaacctacagtaaactattgctgagcatttgctcagggccgtgcaattagttggaaagaggagagcgtgcaagagcacacacacatttatgaaagcattttggtatatgaagaggcaacatacctgatcattgaagaaatgattaagttttccataaactgtgctgagacacctgattatccacatggaaaaaatttaagtggatccctgtctcataccatgcataaaattaattccagacggattagaaacttagaaagtgaagggccaaattaaacttttattttttaaatgaaaagggaaactggccttaagacttcagaatggagaagtatgtattcaacaagacatcaaaaacgcataccataaatgaatgaatccgtaaatttaatcacattgatatcaataactcaatcaaacaggcattaaaaagagaaaagcaggccaggtgcagtggctcacgcctgtaatcccagcacattgggaggccaaggcaggtgcctcacttgagctcaggagttcgataccagcctggccaacatgtgaaaccccatctctactaaaaatacaaaaattagccagacgtggtggcgcatgcctgtagtcccagctactcaggaggctaaggcaggagaatttcttgagcccgggaggtggagaggttgcagtgagccgagattgtgccactgcactccagcctaggcaacagagcaagactccatctca

SEQ ID NO: 120739 - DNA, 410 bp, Homo sapiens
tggtgccgcttgcggactgctcttttgaaaggaatggatgtttgctcctttgccccctctctcttcctgctggctgggatgcaggtgcagtggcaggagatgaagccgcccccaggactcaggggtggaagccgtgggaggaaaaggacacggcctccaggcctgggcacatcactaggcccaaccatttagagtttccagtcccccttgtcgtaaggatcagctcagggatgggcccagtcagcaacagagctgggacttggccagacactgaggtccaggggctctgcttcagcaggtgctaagcagaagggacagcggtctggagctgttacgggtgctaggccgaagggacagcggcctggagctgttacaggtgctaagccgaagggacagcggcctggagcggt

SEQ ID NO: 120740 - DNA, 455 bp, Homo sapiens
cctatgtaacaaacctgcatgttctgcatgctgtatcccattagcttaaagtatgattaaaaaaaaagagtttagcactggggagcagaatacactcactcagctgctgtgtctgactcccctctgttgactcaccatccttctctcccaggatgctctctggccaatccaagttctacttctcttttagttccctaccaacttttcttggctcctctttcagattggtccttcttcaaagaaatgtaattgacttagatggcaggggataggcatacaactccccaaggagcccctggtctagtaggggccacagataatagaccttggcagagaatgtgaggggcattctaggggtcagttcaaggtgttacagcctacaacagggagcacttagccttgtgggagaatccagggaggcttcctggcagagatgactaggtttagtctggtga

SEQ ID NO: 120741 - DNA, 321 bp, Homo sapiens
aataaataaaatgcctatcctcaataacactgcatggagtggagaaagcagagaagtaacaagaacattacagcatagcttataagagttaggatggagtaaatacagggtgctgagggacacagaggtagagcacccaagccagactctgggtagtcatggaaggtcttctaaaggaggtgacatttatatggggacctgaaagatgagtaggtgtcacatcagccaggaaaaggggccaggaaaaggatcccaggacagagagaacgaatgcctgatctcccagaagcaaaagagaacaaggaattttccaggaactgg

SEQ ID NO: 120742 - DNA, 267 bp, Homo sapiens
tccaagtttcactgacattatatctaatataaatacatggccttgcctcatctgaggacaattgagatttcctttttagaagcagagagtcctaatccaaacaattgtacgttttaactagtataaaaagataactttagctaattccagctacttgggaggctgaggcacgagaatcacttgagcctgggaggcagaggttgcagtgagctcagatcacaccactgcactccaccctgggcaacagagtgagaatctgtctcaaaa

SEQ ID NO: 120743 - DNA, 870 bp, Homo sapiens
caaaaggctggtgccccagaagcaggcgagcgtggctaagaaaaaaaagctggacaaggaggaagaggaaataaggaagcagaggttgcagtgagctgagatcgcgccattgcactccagcctgaacaacaagaatgaaactccgtctcaaaaaagaaaaatttgcaaagggagggaacagcatggagctctctgttcaccggtctccaggacctcggattccacctttaatcctgaaaacccaggaaggcttctgtatccctacaatgaagcaggtttggggctggatctgcagggtggcaactcaatccatgcagaacagaagaagcatggacttttccattctggctattccattcactagctgggccattctgagcaaactacctcccaatgtgcctcagtttcctcatctgcaaaatgggctagtcgctggcattgtaccgagcagtatgagaccggaggtcatgggaagaggctggtaggcacttcatcccaggcagctgctcagggacatgggacacagggaggggactccgagctgctcctagctcagagaggctctagggacaggcactggaaggaaggggatgcagaatggtgagtggagctgggtctcagaacacagacatcttgaagtctgctatgtgctgatttcacacttgaccccccaacaccctgaggcattactgtcctcatttctcagatggaactacagaggcccaaggaaaaggggcttaggccaggacacccagctcttctccaagtgtctgtctcaggctagcttttgcaactctccattgggattcttcctagatctccatctgtacctgccaacccacctctgacccccaacctgttgcgcccagt

SEQ ID NO: 120744 - DNA, 267 bp, Homo sapiens
tgcttcttgaaatctgcagaggttgaggcagctgtctcaaactagaggacagagccctgtgggcaggtgggtgtgagaaactcaaacaccgcagtcttcacagacccacaagctattggcaggtgcaatgtgtttattggggcagatgtccatcccaggacttatcaactgtcatctatatttgggacaacctctattgaaaatgatgattttcacttcaattctgaggagtaggcaggaaagggaaacttttagaaggaggatata

SEQ ID NO: 120745 - DNA, 515 bp, Homo sapiens
agtgacagagttcacagatgttatcacactactatccagtctcattaaatttctaggtacctacttcaaactttgctttcaaataaatattaactctgtgttgcattttaaattaaataaaaattattatttttcacattggaaacttttaccccaagagtcagattgtctaacatctagtttaactttataagcattcaactttaacaaatattttacacaatgattttaactgaaacaatgaaactggggacattgttctatatttctaaatctctgccccatcccttttttatttttgcttcctctaaccttatgttccttaatcattctgatagtttgtgtacatgcagaaggaggtgggggtggctggtattgccaccttttctttctctggatcctgattacttcttgttttatttttccacttcatttccatgtttttcctcctcctactcagtgtcaaaaaaaagagtgctttttaatatgtttaaaaaaacactttgaaatgatac

SEQ ID NO: 120746 - DNA, 288 bp, Homo sapiens
tttttgacagagtcttgccgtgttgccaggctggaatgcagtggcacagtggcacgatcttggctcactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctcagatgcatacattgtacacttctcaaccctgtcaag

SEQ ID NO: 120747 - DNA, 687 bp, Homo sapiens
cgtggtggctcacgcctgtaatcctagcattttgggaggccggggcgggtggatcacaaggtcaggagttcaagaccagcctggccaagatggtgaaaccccgtctctactaaaaatgcaaaaaaattagccgggcgtggtggtgggcgcctataatcccagccactggggaggctgaggcagagaactacttgaacccgggaagcggaggttgcagtgagccgagatcgcgccactgcactccagcctgggcgacagagcgagactcgtctcaaaaaagaaaatcaaatacaatgaaaagaaaaatacaacataccaaagtttgtgggacaccacttaggtggggctgagaggaaaatttatagcattaatggatgtattagaaaaaaggaaaagtctcaaatcaattatataagctctcatctcaaggaatcagaacacaacacaaaaaaccaacgcaaaaaccaaaactttgaagcaaggcccgaagaacagcgacctggtctaacactcacgacgcatacactcacctaactttggcaaccaacgaaccggaggcgcggacacacatcttcactgggaacccagcggggtttgggaacacggctcactcaactgttggacaacacttctagcaggactgaccaggagtcgctacacactcactctcacggtcatccggaccag

SEQ ID NO: 120748 - DNA, 611 bp, Homo sapiens
ccacaaaaagaagcagagaaagtgtagaagtgaccgcaggagacagcaagcctctcccagtgcctgacagtgcttactctccgtcaggccagctgagaggctgtactgtgtatcctgaggaagttttgtttccccgtcatatgtaactttaaaataaaactccaggccgggcgtggtggctcacgcctgtaatcccagcattttgggatgccgaggtgggcgggtcatgaggtcaagagatcaagaccatcctggccaacatggtgaaactccgtctctactaaaaatacaaaaattagctgggtgtggtggcgctcgcctgcagtcccagctactcaggaggctgagacaggagaatcgcttgaacccgggaggcggaggttgcagtgagccaagatcgccccactgcactccagcctggtgacagagcgagactccatctcaaaaaaacaaaacaaaacaaaacaaacttcattcctgaaacagcttgaatgagacacttgcaacctacaaccccccaaatctaactaataggcagtctaaaattagataaattgtggtgtaaatttcagaggcagtttggtaaaaaggttcaattttagccttcatca

SEQ ID NO: 120749 - DNA, 308 bp, Homo sapiens
agcctcccaagtaactgggattacaggcgtgcaccaccatacctggctaattttttgtatttttagtggagacagggtttcaccatgttgcccagtctggtctcgagctcctgacctcaggtgatccaccctcctcggcctcccaaagcgctaggattacagggatgagccactgcgcccggcctgagaatttatgtattttaaaggagtttgaagaattttgatagctacccacccaaagcaacacttaaatgaaccatcccatctaagtgtccatattgcactacctagtgaggtactcgtgtaag

SEQ ID NO: 120750 - DNA, 283 bp, Homo sapiens
tcaagagagaggaaggttggtggtggccatggtcagatgctgtccatctcagtgtatccaggcagggacacaggcaaggaccatttcttactcatctttggggcttcacagccccaaagattctttgcaacctgagcagaagttgctttttatcgcttacagatttgacattttctaggaaggtgatgcaggttttaaaaaccgtatagttgagaagagtggcagcaataatcagataataagggaacaaaacccagttctttgcgttgtgtcggtaggtgcc

SEQ ID NO: 120751 - DNA, 423 bp, Homo sapiens
aaagcatttgtaaggacacgcagtctcagcactgctaatggtaactcccttttgcacaataagtagtaggactttatcgtgccaaggactgcagacccactgtggaaatcgacattaggggtgatccaggctatgtgattcactcacttagttcgccaacaagtggcatgtttctatcccactgttaatttaccaaacgtttaactgtagcttcagaggtgatttagttctgagggtctggacctcatgaatagattaatccataatgggtgaatgaataaatgagctatctcatgtccttctgagaaaagaaagagatctgagctagacactcagctccctcaccatgtgatactctatgccacctagagactctgcagagtccccatcagcaagaaggtttctcatcagattcccagcctt

SEQ ID NO: 120752 - DNA, 138 bp, Homo sapiens
gtccgccatcactcttttcttccggtacggtttcagttagccaggatggataagttctgaagatctattgaatagcatggtgactacagtgaataatgttttgtgtatttgaaaattgctaggagagtggatcttaaa

SEQ ID NO: 120753 - DNA, 252 bp, Homo sapiens
ccattttctgaagaggaattcaagcctgctgcaggaatttgcataagtaatgaggagctgaatattaagttccaagacaatggggaaaatttcttcacagcatgtcagaggtctttatggcagccctttccatcataggcctggaggctgaggaggaaaaaatgatttcatgccctggacccaggacccccttgctgtttgcagcccagggacttggtgctctgcaccccagcagctctggccatggctgaa

SEQ ID NO: 120754 - DNA, 1217 bp, Homo sapiens
caacatttaaagggacaatacatcatgacctgtggggcttatcttgggaatgcaaagctgcttttttaatatctgagaatcaatcaatgtaattggcaggattaatagaataaagggggaaaaacaatcctttcagcagatgcaggaaaagcgctagtgaatgggtaagcaaattgtgatgagcacatgcagtggaatactattcagcaataaaaaacaataaaaaattttcctacatggatgaatatcaaaaacaaagtgctgtacgaaagaagtcaaatacaaaagaccacactgaatgattgcattcatatgaaattatagaaaaagcaaaattgggcaaagttagtttcagaatcatcttagcaggcaaagctcacatcataggaaaatgtgttgaagccttacattacaaatatggccaaatccactttggtaacacagaggctgcaaatatgtattaaaaatatcatgtattaaatatgtattaaaaaagcaatgaagtttaatatttcactttttctttagtaattttcagaatacattaattgatctagtactctccagaggtggttgattactttcttttttggaacatctttatgaactcatggatttttacatatttggtgtgcatcagtgtattgctatcattattattacctttttaatgctcctattaccacatctttagccaatgcataccctttcaaattagtgcttgtgtccttttgacatgatcttaatcatttttgatagattccctgttcttgggcattcagtgaatgacaatagtatactgaaacgaattaagataaaaaccaattgcttagagctagataaaaatttacaagttaataattttatcattaaaataatatttataatgaagatgtctttcaagatattaatttgccaaatacttgatagttaaataaagaaaaagtcagtgaaaacatttttagtaagatatgtgtgagaaggatactgagtagcacttgcaatctggactggatggctatttttcttcatggagatggaaaggtgccacaacaaaggtagtgctaaggtgaatatttctcctctgtgatgaaaaataactcacaaaattggcttctttgttaattttttttcaaaaccaaacactcagatcatcaacagcaaacaaaattgtgaatgtttttactgcacacaataaaaatgctacgatgaaattg

SEQ ID NO: 120755 - DNA, 138 bp, Homo sapiens
cagagaaatcattctcatttgtgatttgaactaatctggcatccaagtgttaggcccacatcctcacctactgtggagattgcaacttatataagctgtcatcaccttaaattcaatctatcttgaactgattaatgc

SEQ ID NO: 120756 - DNA, 568 bp, Homo sapiens
tgctaccggtttctggggctactggttatgcttctgcctggtgtgagctaaagctcttttatctaaaagcaaaacaaagcaatccaggtgcctttgttttcatctcactttctggcataggatgctctaaacttgtaaacaagcatatctggaccaagcagacctgctgctaattgcacactcacctcgagcccaaaatgaccctgttacatccaaagcacaccaggtattcatgtaaaagtgctagtgtctgctataaagcacatcgctaaccttgaaaaggaagggagaacttagaaatcaaatcaaatcaaatcatactttgtttccaatggaaattcttaaagttgttacacgtacaaaacacattttcttcttatcaatcaaaaaggcccaatcaactagaaaaaaacgacttggagtggagatagagaagtctttttctgcttatacaaggtactggcctactctaaaatatactccaagagcttcaccttttcaataaagccagaagtgccttgtccatttctcccttcatcttcagccccatcagattctagaacatcct

SEQ ID NO: 120757 - DNA, 429 bp, Homo sapiens
cgaaaccccatctccaccaaaaaaatacgaaaaccagtcaggcgtggcggcacgcacctgcaatcgcaggcactcggcaggctgaggcaggagaatcaggcagggaggttgcagtgagccgagatggcagcagcacagtccagctttggctcggcatgagagggagaccgtggaagggggaggagagaggggagaggggattttgtattttttgtagagatggatttcaccatattggccaggctagtctcgaactcctgacctcaagtgatccaccctcctcggccttccaaagtgccgggattataggcatgagccaccgcgcccagccgattattagctcttgatacaatactttcagaatctgaaacggagagggtaaggaacttcagcgaagtcatgcagtgaccagaggacaacgcgtaagtg

SEQ ID NO: 120758 - DNA, 559 bp, Homo sapiens
accattaacgagtccccatcagtttcccctagccttgggccataacccaatgtgctttaaaaacgcatctgttagtatcttagcagtgtcacttgtgggatagtaatgtcactatcccacaagcgacactactctcgttcagtattacttaatgggacaaaaaacaaagcaaattatataacaacgactgacctgacctcctgcagcaaacaggccatgacagataatcaaattccactaaactttacgttcacctattttaactattaagagacgaaactgaggtcctttgcaatatcctcccctttccgagaactgattatttttaaagtattgtcacaggctatacttgcaagcagctttttaaatgcaattccaacatcagcacgttggggcactgacttgttttttggcagattaaagtaacaaattttattcgaaattcttctattcagaaaaataaaagcagggggaaggtattctgcttggatttcccaaacagacaaagttctttgactttgaggacctacagaagacatttgcagaaatggtgttttgc

SEQ ID NO: 120759 - DNA, 113 bp, Homo sapiens
ctatgaagaaaataaatcttttttctttataaattacacagtcttaggtatttattgcaatacaaaatgaattaatacaatttataatgtcatccaggttttgttctcttatt

SEQ ID NO: 120760 - DNA, 678 bp, Homo sapiens
ttctgtgtaaatttaaataatttctttaaaggcagtaagcttttatatttaatatacctttcactgtgcaatcacaacaggaagattttctaaattagacatctttaccttgaagaagaaacttgtctgtttcagtgtctttttgtagcaagattgaccaaaacaagtggtaaataagtctgtaatatttaactgtcatgaaatacctttgctaataaggaaatggcctcggtttggattaggtggagtttcgtgtgtgcgatgtgggggtgtatgtgtacatatatttctttttttttttttttttttgagatacagcctcactatgtcgcccaggctggagtgcagcggcatgatcttggctcactgcaacctccgcctcccaggttcaagcgattctcctgcctcagcctcccaagtagctgggattacagatgtgcaacaccatgcctagctaatttttttgtatttttaataaagatggggtttcaccatgttggccaggctggtcttgaacttctgacctcaggtgatccacctgccttggcctcccaaagagctgggattacaggggtgagccaccgcacccggcccatatttcctttttttatactggatagcaatatagggtcttgtctttcaccttttaagttcacagaacagtttgtcctgaccaca

SEQ ID NO: 120761 - DNA, 283 bp, Homo sapiens
atttgccacaaactaggaacaacacagtgtccaataagtaaatagataagttgtgatatacccataccccgtaacactgcatgcagccagtgcgtgaatctcacaattgttttgctgcgcaaaagaagccaggtgattctgtttatatgaaatttgagaaaaggcaaaattaatctgtagtgacagaagtcattatcaatggtttcccaagcctaaagggggtgttactaatcgcaaaaatgtatgaagaaactttctggggtgacggatattctttatattg

SEQ ID NO: 120762 - DNA, 844 bp, Homo sapiens
aggcagcctggtgtatttgactggcccagaggaggccagcgtggtgcagtgtgcgacagggaggtggaggggagaagcgcacatccatcctcggctcccacacccgcctttcccacacagatttctctcttcctgtctgatgttcatctgatcctctctgcttcctcatctgtaaaccaggaatcccagacctatctcagaggcatgtagataatattcttccgtgcacggtaatcctcaagacaaccccaatgaggcctaatactatcatcctacttcacgggggagcgcattaaagccagaggttcagcaactggcccaagccacatagctggcgggcagtctggctccagagtcttggttcttgactgcttgaaagctgcctcactgggaggaataaatgagagagggagtagttgagactgggaatcggctggatgtggatggcagcccacagggccatttcccttcctctttccattctctccagattcacactcaccgaatttagaaggagtgatgctgcatccttgagttccattccatcctttacaggggaggaaatgaacctcagggggtgagcgatttgcctaaagttgcacagcaaagagtggcagaggtgggactaggaccccagtcttccagctcagtgtcctggtagggagcagaggttggagctgcggcctcaggtggccaaggtgaggcatcgaacagaactgcatgacgcttcccgatctgccctctccaggtgaatccatatgcatgaccaatcttcctgtagcacggacctccctccctgagtcatgtgaggaattcatatttctgtgggttaacatgttgcaga

SEQ ID NO: 120763 - DNA, 385 bp, Homo sapiens
ttttcacactcttctgtgaattattttttgactttcaattataatgaagttattaatcttacaaaggctcgctttgtaaagagactaatctgaataaacttgcttgtatacaataagtgccatggcaaaaattaagagtacagttattatcagagactaaaataacaatttaattttctagaaatagaaaattaagaaaaataacttttaatgctgggatttgacattaagaaatgaatgacaaaaatgggaccaaataaaatgctgtaattggccagacatggtagctcatgcctgtaatcccagcacttggggaggctgaggtggaaggatcacttgagctcaggagttcaagactagcctaggcaaaacctggtctgtattt

SEQ ID NO: 120764 - DNA, 325 bp, Homo sapiens
acctctgccccactccctcccctaacaatgccacaacatctgtcaatcacatatagtattctgataccaaaaaataatatttaattacattaagttgctgaattgggggatttatctgatttactgttattgtttgaatatggtttgtttgtcccaccaaaactcatgttgaaatttgattttcaacatgatggtgttgcaaggtggggactaaggagaagtgtttggattatgaggaataatccctcataaatagcttggtgctgtgttcatagtagtaagtgagttctcactctcaagacactgaataaattctcatgaggat

SEQ ID NO: 120765 - DNA, 798 bp, Homo sapiens
aatgagtggggctagagttgcctccccaggaggggctggaggtcagggcctggtgggctctgcaggcttatcagttcagcacaacgtgctcctgcattcaagaaacagggcatggggctgctcactggcactggaggccgaaagaaggtgagggcaagtgagatgcagggacctcttctcacagctgtgctgacaagcacaaaaaggagccccccacgtccacaccaggaaaggggggatggtgcacaagatccagcaggaactttggagtcacactgacgtgggttcaaatcccagctctgccgctgagcaactgtgagatcttggcaaatgtttaactttcctgatcctctattgactcatatgctaaatgtgacttagaatgcttgtgtcgtaagactggcgtgagataaagtacggcaagtgggaaacacaaagcctgtgcacgtgaggccctcaacagaaaaagctgaattgctgtgtactggtagcctcctttctcttaccaggaagcccacgcctctggctaaaccctcaggctcacttgcccaccattaccaggtgcctgtctcccttgcctgtcttcccttgactcggggaacttcacctgctttccttccctagaaggccccagcgcccaccttgcttgctgtccttcaaatcaaacaacctgccctttcttctaaaaaggctttactgttatcactaaagggaaacaaaaaggtgcaactaaaactagccttccttaagcctgggcccaagtcccaaccctgatgctaacttgcagtgctaccttca

SEQ ID NO: 120766 - DNA, 306 bp, Homo sapiens
caggttcaagtgattctcctacttcatcctcctgagtagctaggattacaggcatgcaccaccatgcctggctaatttttgtatttttagtagagatggggtttaggcatgttggccaggcaggtctcaaactcctgacctcaggtgatccacctgccttgtgctcccaaagtgctgggataataggcatgagccactgtgcctggccaggaatggcatctcagctgtgatataaaggatgactggagctgatgagatggggaagggtgcgagtacaacaacatcctaggctaagggacatagcag

SEQ ID NO: 120767 - DNA, 266 bp, Homo sapiens
tcaaacgtaatgtacatgacaaatatttaccattttctcaattaaaaataatttttgaagtaaaattttaacaaattcttcagtcttaaagaaaattacaccagataatttggatttatagaaaagaatggaaggactgtaattgttaaatgtcctggtaaatataagattattgtttctttcttaatttcttcacattatataactttaacatgcatagaggccgggtgtggtggctcacacctgtaatcccagcactttgagag

SEQ ID NO: 120768 - DNA, 702 bp, Homo sapiens
acaggggctgggcgggccggcccagggcctgcctatggcctgaaagagaaaacctgccacggagcccgggcttctctgatcctcccgccaaactttgtctctcatttagctttctttgtgtctgaggatttagcaaaggcctcagggattcaacagagttggattgctgagaataaaattacggatttctccataatggacacacgcactttttgtttgtgctgtttcctttagaatggacgatgagtcaaaattgttcgtttatgcttcttcacagaaggatcttctgtgtcgtaggaggtggcctgcagcaatctggacattcagtggtcctcctgtgattaataggtgaacggatgagctattctgataagaactggggaacttttgccattcaaaagcaaatagaagaactgggagattcctcaacttagcttttcttttttttggttctaaagtgactgcgaatggaggtagaagagaagaaaagctttcaaaaacatcttccattaagaaaaatatgtatcttcatgaagacctatctgagtaaaattactaaaacataatggctttcttgaaatagaatggaatgaaaggcatattagggagtatgaaagtatgaagattttattaacatacttctagaagtttattaaatatctgcacaggaactgtaatttgagatcagtggtggaaagagaa

SEQ ID NO: 120769 - DNA, 455 bp, Homo sapiens
agaatacctgagatggtgtaaacagatatccaggtagacagaccttttgttcttgttttgagatagagtcttgctctgtctcccaggctgtagtgcagtggtgcaatctcagctcactgcaacctccacctcctgggttcaagcgattctctttcctcagccacctgagaagctgggatcacaggtgtgcgccaccatgcccggctaatttttgtatttttagtagagatggggtttcaccatgttggccaggctggtcttgaactctttatctcaggtgatctgcctgcctcggcattccaaagtgctgggattacatgcgtgagccgctgcacccagcccagacctgtttttaatagctttgcactaatgttctcatttgagggaagagatatctgaatgtttgtttatgggcataaggctacttccttcttttcttcaatatacatataaat

SEQ ID NO: 120770 - DNA, 392 bp, Homo sapiens
ccaagattgtactccagcctgggtgataaagtgagaccctatctcataaaaaacaaaaaaacaaaaaagaaaaaaggagaagaaagagacacagattagcatttgaatgggtggactgagtaaagcagatggccctcgtcagtgttggtgggaattgtcctatccattgagggcttaaatgaaacaaagactgaggaaggctgaattcaatctctgctgactgctggggctgagacatcaatcttctccggctctcagtgctcttccagactcagactggaatgtacactatcagctctccagttctcaggccttcaaattacacctctggctttcctgggtctccagcttgcagatggcagatcgtgggacttcatgggacttctcagact

SEQ ID NO: 120771 - DNA, 386 bp, Homo sapiens
ttggccaagatcacatagctactaagtggcagaaccaagatttgtatccaggttgtattagtccattttcacactgctataaagatactacctgagactgggtaatttataaataaaagaggtttaactgactcacacttccacatggctgcggaggcctcaggaaacttaaaaccatggtggaaggtgaaagggaagcaagcaccttcttcacagggtggcaggagagagagagaacatgagagaagtgggaagcactagacacttatcaaacaaccagatcttgtgagaacccactcactatcatgagagcagcaaggggcaaatctgctcccacgatctaatcacctcccaccaggtccctcccttgacatgtggggtttata

SEQ ID NO: 120772 - DNA, 283 bp, Homo sapiens
aaaatacaaaaattagctgggtgtggtggcgggcacctgtagtcccagctactcgggagactgaggcatgagaatgacttgaacctgggtgggggaggttgcagtgagccgagatcatgccattgcactccagcctggataacaaacaaacaaacaaacaaaaaacctagtggaagtcggagggtgagggaggcttggggcagaaagcaaaatggagaaagtaggagagtagagctgacgaagcaaacagaagctgttcagtgcagctagccgaattggagag

SEQ ID NO: 120773 - DNA, 189 bp, Homo sapiens
tgatgggatgttccatgtgacgggtgatgggatgttccgtgtgacgggtgatgggatgttccgtgtgacgggtgagatgttctgtgtcagcgggtgacgggatgttccgtgtgatgggtgagatgttctgtgtctgcaggtgatgggatgttccgtgtgatgggggagatgttccgtgtcagcgggtga

SEQ ID NO: 120774 - DNA, 594 bp, Homo sapiens
tattgacagacttgaatctttcttcctcaatatgagttaagttaatgaaaactaagggaaggggcagaggtagttattttctttggtgggtcttgactttgggcaaataagagagcttcaaagaacagcttcatccttttctttgggagaggtggagggttgagaagcaggagcagggagatcagaaagaccatgaggttgcttctttagcacatcaaagtgccacattttgggatattcgtttctgagctcagactttcctggacatttcacatgttaacagatgagctagtgactgtggagaggaaaatagagttagtagctgaatggtaaaagatcccattaaaccagtctctcattcctgagaataggccaacccaactaaacagtagtttctcattttaagagatggtattgtagatgggctctcaaaattagacctctatccatgacacaggcaaacagatctttaataagagatatttttatggaaacagatgaaaaacaaacattaatgtctgaggtggtctataaactagtttcttttagagtcatgggggcagtcagctgagagggccagtggcaatgtgatag

SEQ ID NO: 120775 - DNA, 700 bp, Homo sapiens
ggtgctgtgcttcctagctcagttcctgcattgttgagttgtgaagtgggactgacgcagagggccttctctgcccccttctgttccccattatctggcaaaatgagtaaatgaattcagtagtgtttaaaggatgcttgaaagtccacaattaactttataaaataatacggtatttaaatggaactagcaagtaccaagcaccctttgttcatggccagaaggacataagccttcattaacagagaatttctcatgctcaatcagaattttttcacttaaagtgacagttgagttgtattaaatatgaaaagctacagagatatcacaaactgtgccatttctgaaaagagtgattcagcctgaagtgacactacaaacaacatgacagaatttgaaaaatggtcaatgatgtaagtaggacttcctgaagtgaagaagggtcccttctcaaaacaagaaggtcaaggctactggtgcttttctgaaatgcagcgaggaattgttttaattttctttttttttccccagggcagcatattaatattatgaaagcatttggaaattagggaaccataaatgaccatagtccattttaatgacagtagaagagtcatcctaataatagatagtaaagaaatagattgtgacaagtggatcgatgtgggtttcttctgccattttccatctacactagaca

SEQ ID NO: 120776 - DNA, 566 bp, Homo sapiens
gtctaattcaaggaatgccactctaaaggaaagaaaaattataaacaagaaaacatagtaggctgtacagaagataagcaggtgatttgatagaagcttctagaggtggggaagaggcaagtggtaattttataaaatcaggtaatcaggaaagccctctctgagaaggtgacctataagttgagatctgaagaagaaagagtgagctatggaaagaggcaagtgaaaaactgaagaacactgaagaccagcagaacagcatgagcaaaagtcccaaggtgggaaatagcttggcatgctgggcatagaaaaatggccagtggggctgcctttctgatcacaccagaggtctgggatttattcaaggtaatgagaagccactggggttccactaaagtgaactacttttctcaataaattaagcttagcctttttaggtactaaactttaaaccatttttcaatgggagtttctttcacattacagtagtctcccctcataacaagagacacctcccaagacgccagtagatgcctgaaacctcagatagtactaaaccctgtatc

SEQ ID NO: 120777 - DNA, 472 bp, Homo sapiens
tgaagaaagaaagagggaggcggcagcagtttcttcagacagatctaggcgttcggtgactttcctatcacaggtcctgagccccagcactacacattcagattcaacaagtccggagtagggctctagagctggcacacttcccggctcctagaagattctaagatgggaggctcgtgagccacacccagagaaacaccatccggtgaccagagaacaggttaggatactgaacatcccctaggatacagtagggagtctccctacggtatcctacacacacacacatacacacacacacacacagatacagaggtaggtgagcgaggacctcactttgaaccaggctgaattaggaccaagtgcaacctcccttcacttcagacatgagcattcacttccatctctgtgctcacccccaggaggggaagccaccagtgccagtggtcatcaggaggtaggcaccagggca

SEQ ID NO: 120778 - DNA, 348 bp, Homo sapiens
agatttcagttccacacatctgaaagaataaatcacttgattcacaggtctctagcatgcatcagaattatcaagggaagtttgttataaatgtacgttaccatgtcaatcagcaaaaattctgactcaaggatctgtattttaataacctacacacacacacatacacacacacacacacagatacagaggtaggtgagcgaggacctcactttgaaccaggctgaattaggaccaagtgcaacctcccttcacttcagacatgagcattcacttccatctctgtgctcacccccaggaggggaagccaccagtgccagtggtcatcaggaggtaggcaccagggca

SEQ ID NO: 120779 - DNA, 317 bp, Homo sapiens
aatgtgaatgtacttaatgccacagaaatatatacttaaaaatggctaaaatggtaaattttatgttatgtatctatagtattttactaaaatctgaaaaaagttatggctcatttacactgatattttcctataattcgtattaaacattatatgttatgaaatactcaggttcaaaaagtaattcaagatgtgctactacttttattttaacaaatattttcatttggtcatacaaatctattcttttttttttttttttttttttttagggtaagagagggggtccggtgttacccgcgggggggttccccccc

SEQ ID NO: 120780 - DNA, 391 bp, Homo sapiens
atcatcaacacctcagcaacagtagaggaatgcagggaatgtggctcccaacatttggtgatatcaactgtcctgggagaaaccccaaactcccaagagtcaaacattggtttaaaaaaggagtttttttggggtgggggggtaggttgttgtttcgagtttattagtagtgtttgatgtttccaaacaccagttttaaaagggaagatgggttgggggacctcttccagtaagcgtgtacctcaagaaccaaacatacatgaattaagtccagataaggcaattcaactcatttgtatcttactgaggcacatccaaccaaggaagaatagagacttagttatattaggctctctcccagctctgagatgagtatattctttgggggact

SEQ ID NO: 120781 - DNA, 496 bp, Homo sapiens
gcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccactggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaatt

SEQ ID NO: 120782 - DNA, 786 bp, Homo sapiens
gaaaaaagaataatttaaaaaaacaaaaaataaaaagaacaacaagaacaaagtgaataagtaaaatttaaaagaactgaaatggaagagatgggggtcataggtcaatgctggtgagattcatgagaagcagtgatataattcttcttacaaagaaatatctcaagattcattaatgggataatattccccattttccccagaataaccaccagttttaaaagttaactagattttggaaggcatttttgcatccttatctttttataattttcactggaataaatcactaactttttatcctgttaaatggggaccatcatatcttatttcatagggttaaagggttaccttcatggaaaagcattgcagtcctatgacctttctggatattgctgcaaacaatttttcaaaaacattttgcacattgccactacagcataaaaatagaagcatttctaaattaaggttcaaatctaacctacaggtcaaattttccaggttgctctattctattatttaattttaaattttttaaattccagttttaacaaaaaattacaagacaagcaaagatgcaggaaagtgtagcccatacaaggaaaagatataataaaaaccacctgaggaaatcttgatctcctagatatggactttacgtgagatattttcagtatgatcaaataactaaaagaaaccacatctaaagaactaaagagaagtgtaagagctacgtcttaccatacaaagaataagacgaaaattataaataagaaccaaatagaa

SEQ ID NO: 120783 - DNA, 262 bp, Homo sapiens
agcgccacattgcaaggtggctgcaaggccagacctagctgtgtggttattagcacagaggaggttcccctctggagagggaaggggcctttctacttcctaatgatgtttaatggatgactatcttaaccaaagggagaggggaaaagtcatttgtgtgtgtgcaagtctcaatcaagttcgaataaagataataagctaaagtatgaagaagttgccttaggtaggagtcctaccttctgaagtggctcatctgaaggca

SEQ ID NO: 120784 - DNA, 376 bp, Homo sapiens
  misc_feature (17)..(17): n is a, c, g, or t
ctatccgtgtccggggntgcgtaactagttagcatgccagtgcactccagcctttttgacagagtgagatcctgtctcacatccacttgggtgagctcttcatatttctactcaaacctgtctctcctgagtagctatgactacgggtacgtgtcatcatgcctgactaattttaattttttttttaaaatggaggtctcactatgttggccatccatggccaatataacagccatgtaacagtcaccgtgcctgactgcagcagttctcaatgtatgaggaaaatgggttgtgacactgttgtaatgaggcaagaaaagttaagaactgaactcaagctgctgaagatccaagatactgtgctctttatgctctg

SEQ ID NO: 120785 - DNA, 733 bp, Homo sapiens
ttacttggatcatgccatccctctcctcagaaaagtgccatatgccacttaaaaaaattaaaagaaattaaaaatttctgactaaaagggatttcacaacttaaattgggcagatcctggagtgtcacaagacacaatgtttgggaatcatttttctgaagtgtgtcaaacatgaggaacagaagaataatgcagtttattattataaacacctggcctaacctgtagggcagggaagggaatgtttgcgcacttgctgccatcaggaggagcagtgagggggtaaatgacagcaggagggaaaaccacagcacacctcgaggagggctccagcacagctgagctgggctgaggttctcaggtgcagtggcgaaggggtaaagcatctctcttttgtttttgttttgagacggcatctcactgtcgcccaggcttgagtgcagtggcgcaatcgtggttcactgcaactgttgcctcccaagttcaagcaattctcctgcctcagcctcctgagtagctgggattacaggcgcccaccaccacacccagataatttttgtatttttagtaaagacggggtttcaccacgttggctaggctggtctcgacctcccgacctcaggtgatctgcccaccttgacctctcaaagtgctgggattacaggcgtgagtcaccgtgcccagcctaaagcatctctcttaagggaagagggaagaataagggactgtgaaa

SEQ ID NO: 120786 - DNA, 326 bp, Homo sapiens
gttttttacctactcggttaaattgatttctaagtatttttgcagcaattttaaatggaaatttatttattttttaaagatggtttattgttatacagaaacactacagatttttgtatgttgattttttttatcctgcaattttcttgaatctgtttatttgttctaaaagatttttggtggatcctttagggttttccgtatataagaccatttcatctttaaacaggcacaattaaacttcttcctttccaattttgatgccttttatttctttttgttggcgaattgctctggtcagaactacgttgaatggaagtggtaaa

SEQ ID NO: 120787 - DNA, 326 bp, Homo sapiens
ctgccacagaatcctttttcctttcccattattactgaaatattggtgttccctagacttctgttcttacccttccatttttccttctggatgatctcattacctataacttcatctactactcaaatgctgattactcccaagcatttatctctagaccctcatctttctttttggctcctgacccacattttctacagcctaaggggggctctatcctagattttccaggcagtcactgcaaattcagcatgtctaacatcaaactcatctttcctacctaaactcctcctccttctcatttccctatctgggttaactatatg

SEQ ID NO: 120788 - DNA, 347 bp, Homo sapiens
atcccttgcaccccacgtgtcgcaggacagaacactcggcatcctgggggcttccttatcccacagccccaaattccgggaacagcatggatgtgggagggggcatggaatccagacctggattcttgtcccggacctacccctcacccttgtgaatttgagtaaggcatgtgaatttgaataagatccctaactgctttgggtttcctggtgggtaaagtgaattcaagtaaggtctgtgaatttaagtaaggtccctaactgctttgggtttcctagtgggtaaagtagaataacggccccaccctgcaggatgagtagcctgatgacgtgagagagggaaggat

SEQ ID NO: 120789 - DNA, 766 bp, Homo sapiens
catggtggcacgcacctgtaatcccagatactcgggaggctgaggtgggagaattgcttgaacctggaaagtggaggttgcagtgagccgagacggtggcaccacactccggcctgggggacagagcaaaactccatctcaaaaaaataaaaaaagaaaaaagaaaatttccataataaaatgaaactcttaaggaaaaaactgctttgaacataaagccaacccaaaaagtagctcttacctaaagtgaattttccctagtgccaaatgaaattcaaataaatcccaatcttctaattcacacaaatcttaagatttctaatactttaaaccagaatgaaaaagtcaggtatgccaaattaacaatcgaagagaaaattaatcccacaccaaagccaaaacattgaacttcctcccactctcgcattcacacacacacacaagcatgaaccacacaatgaaggattccagttgccccatccagacaactggacgcacatcacacacctcctagtcatccagggaccatcttggcagcctgtttctcatcactacctgccaccctgtgcctgtgttgtggacgaggaaggcacgggtagtagcctagctttttatttttttaaatctcagcaatagaggcaaggttatttctaccttacatccaagagtatggagcacaagactagctgtttattaataacatgcttattttccacaccaaccacacggttttccaatttcacaaagtaaatacttcctcatccct

SEQ ID NO: 120790 - DNA, 423 bp, Homo sapiens
  misc_feature (72)..(72): n is a, c, g, or t
cctgacctcaagtgatctgcccgcctcagcctctgaaagtgctgggattacaggtatgagccaccacacctnggccttctaatgacttgttttagaatgtggatgtcaatgtcacccaccttattctcaccaaatatggagctagagagccaagtttaacgaggttttcctttgacaccctgagagcctcgcgttgcatccacttctttccaacattattatttatgctttttacatagtaggcacacagcaggtatttgttgaatgagccattgctagattagaagtgggaaagactgacagtcgaatcgttaggagtcgtctgcagtcgtcaaggtgagtgatgacagtggcctgtatagggaaagggggaagctggagatgggatggatgtgccctgttggagagacagattccacagaa

SEQ ID NO: 120791 - DNA, 478 bp, Homo sapiens
ctgtccaagaacgacaaggggggtaggcacaggcttgagggatctgtgagaaaaaagacagaggatgtggcctgggaaaccacagtgccttcctcagccacagcagctgcattcattatttactgctgtctaatgtcatcagtctgttctaatagatgttgtaatgggatgaacagctttatctgtttcctttgtgtgatttgcacatatcctgtgggagctaaggatattggagtcaggtggtatgagttccaatgctggcccacgtcctttactggctgggtaactcagagcatgtttctcaacccatttgagcctcagtttcctcatctgtaaaatgggaacatgatatctcgtgatgttgtcgggtttaaatgggagagtgccatgtgactgcttaaacagatgcctagaacatgaaaagaactcaataaattatagtttagaaaaaggccttggccacgaaaagaggtaaaat

SEQ ID NO: 120792 - DNA, 267 bp, Homo sapiens
gtgaatctggatgaggcaagtggcctcagccggcaataaagatgtgttatgaaatttcccatgccagaagagacactcatagctgggattggccttttcaaaagcagttgatggtgatgagtgataactccccttttagttttggcatcagatggagtttgtagctcattggcttcattgtgttgcctgggtatctcctatttagacttaattggatggtttgcaccactgtcctaggtggttgctagtcttttcaaggactatcct

SEQ ID NO: 120793 - DNA, 467 bp, Homo sapiens
ggctgaacttcatggcgactggctggttgtggggatggtggagaaggggaactccaggtctgtacaaccaggtgactgtgggatgactgcccgaatggggaaagcatgagcaaagagtttcagaggcggctgacgagcgcaggtctggacatgctaaggttgatgtgactgtggggtacagacagaagttgtaatcatggggctcaggctcgagagacgggccagggccacagagaatgttccttagcgtgacagtgaagccacaggtatgcgcgaagctgtcagcgagggaaagaagggtgcaaagagctgagagccgaggacagaactgcagagaataccaggaaagaggagtccaaggagagcagagtgaggggcaggaggagctgcaggagcaactggtcccatgggagccatgagaggagaggagtttccagaatgagggagaatcaggccacagcaaacac

SEQ ID NO: 120794 - DNA, 257 bp, Homo sapiens
tttttttctttcttggggtctcaagtgaagcctgagaaccgggtctgtaagctcccaagtgcagattctcaggtctagcggtgacattggacaggacgagacatctccaagcctcggtcattgcctcttaaaatctcacaacgtgtttatgaggcttttgtgacatacttgcaaattctctttgaaaacgaaataatctgtacaataatcccccaagacacaggtttacctttataacaaacctgcacttataaccc

SEQ ID NO: 120795 - DNA, 409 bp, Homo sapiens
aggcaagaagaaaacacctatgtcagactgtgtgtgtacagtatttaaagggaaggaacatgtaatatatcagaaggtgtgctttaattgaggagacaaaagaaaatgaaccaagtaaagaggtttcattgttttaaaaaaatgcagtgagatttatgcctggttcctgctgaacctgtaaattgtttagagcagagaagctgtgtagatgaaatgcttttgagatatttttattcacagaaagttgaattagacgagaatagcttttggattaggacttatccaggtcttcctttagttccacacaattccatgtactcaacaaaagggtgcctaattaaattccgattgaagaaattcatatgaaaagcaatgtgcaacattaattctccgtatgtgcaaagtactg

SEQ ID NO: 120796 - DNA, 761 bp, Homo sapiens
gacaggataaacttccaagtataaatattggcattaagttgcttgcctggctgcatatataaatcaggctgttccttgtagaagaagatctaaaatttaccaacaatttctatttgaaaaatgaaaccaaagtctagaaatactactatggtccaccagtcaggtttgggtttatggtcaggggaaggatgaaggcttgacctaagtccataaaacattgggtcaatgtggtagctagttcctaagatggcgcctaacggtccttgcctcattgtatttatacccatcagtggtcccttttccatgttgtatcagagttagtctgtgtgaccatcagaatatggcagaagcgatggtgtgtcttttctgagattaggttataaaagactgaagcttctatcttaggctttcatttttcgggaagctagctgccacatcttgctgttaactaagcaccctatggaaaggcccatgtggaaagaaaatgagatttctagcttcagccagtgaggcatgagctcagccaaacaccgagtaaacttggaagcagaccctctagacttcagataattgcagcaaccttcagccagaaacatgcaactaagctgcttctggattcctcacccacagaaaaaaaaaatttacttataattgaaaatccctaaaacatcccaaacaaaaaaaatttgttggggggcgcccggcgccctgaaaaggttttaaaccccttcgggttgggggccggggcccccaggggtaga

SEQ ID NO: 120797 - DNA, 379 bp, Homo sapiens
ataaatttctgttgtttataagttactcggggtatggtattttgtcacagcagcccagacaaagatgcaagggatcaagttggctgagctgtcttttttctttcttcttctctaatctcccttttccatagagttaccattgacagaatacctgccatgtgccagaccctttatatccactattttattttatccatatttcccttgactctagacaaactgaagctcagagaggtaaaataactgccttggtcacctagctggctagcagttgagccagatttaagcccaggcccttgaattcctgaagcctgaagtctttctacaacactgctggtcccaaccctggccatgcagcaggataatctggtgaattact

SEQ ID NO: 120798 - DNA, 416 bp, Homo sapiens
cattaaaagggcagagtgggaggaggggatgtggcagccgaccactttgaaggccagttttctcaggcaacttagaccatttttagtcaaattttatcttagattcacagtactggtggttttcgagtatattatgttaccttctgaaatagttcctgtcgttttgaggggcttttctttataaaatagtcaactttggctataaaatgttactttagtgtaattccaactggaccagtcttatctgtagcatgcaagaagttcaagtttctcttttatttttaaaagtggcccatgatacctgtaaatcttgggaaatgactgagtactttgtgcttttattttgaagctaaacagttaacagaaacacaattttgtaaacagataatatctgtggtctgttgagttgctaggat

SEQ ID NO: 120799 - DNA, 354 bp, Homo sapiens
tgagacggagtctcgttctgcagccaggctggagtgcagcggtgcgatctcggctcactgcaacctccaactccctggttcaagtgattttcctgccttagcctctcgagtagctgggattacaggcatgtgccaccacgcccagcaaatttttgtatttttttttagtagaggcggggtttcaccatgttggccaggatatggattacaggcgtgagccacagcgcccggccaagaaaggctattttaaaacttgtacttgccttgtactggatcttaaagagaaagttttctgttttctcccattgattatgatgttagctgtgagcttttcatctatggcctttattgtgt

SEQ ID NO: 120800 - DNA, 382 bp, Homo sapiens
tatccgagttcggggttgggtagctgtaggtcttagaaatggcatcaaaggtggccttggcgaagatgcccagggtggcactgcagccccggtctgaggtgtagcaggcatcgataccagccatcatgagcagcttcttaggcacaggtgcggagacgatgccagtgcccctgggtgcagggatgaggcgtaccagcatagagcctgggtattaaaataatcgaccattttgtaggcagtgtgccagcagtgatgccaccgttagggcaatttctcaagcaccttctcctacatgaacaataatgtgcaatgcagcccattacagccactcagtggcacagactgttaatatccagtattgtcctaagttgagacaaataat

SEQ ID NO: 120801 - DNA, 438 bp, Homo sapiens
agaaatccacagaagacaaagtagtatggctttaatgaattgtcataaagcgaataccctcctaacaccaaccagaacactagaactttgccagccaccccagaagccttttacagtccccttctcataaaagtaattatcctgacctttatggcaatcatttccttgcttttctttaggaatacatgcttgggtgacaaaatgacaaatatcataggtggttgtttcttttgaaaaacaaatctttggccgggcgcggtggctcacgcctgtaatcccagcactttgggaggccgaggtgggcagatcacctgaggttgggagtttgagaccagcctgaccaacatggagaaaccccatctctactgaaaatacaaaattagccaggtgtggtggtgtatgcctgtaatcccagctactcaggaggctgaggcagga

SEQ ID NO: 120802 - DNA, 507 bp, Homo sapiens
ctttatcctatctttatcttatcccccactttctagtttctccaattgtcctcaaatgtctctaaaattacccaaatcaggatccagtcctggctcatgcatcacatttagtggatatgttggatctcttggatctcatttaatccagtatctttttattatgatactaggcttgataaagagcccaatcagttgtctgccctgtagaatgccacatattctggatttttggtttgcttctttatagtatcactgcagttgtacctctagtccctgactttacttcaaactggaaattaaatctaaaggtttgttgaatttaatgtggctaatacacatcttaggagttgtgacgataggttcatttgattgatgctgagggttcaggctaattcacctggctacactcaggaatgccaaaagcaaactccgggtagcaaaatcaacttaaaatggcccattttcagccaagtattgttacaaaataagtaaagttaaactcactcc

SEQ ID NO: 120803 - DNA, 374 bp, Homo sapiens
aagactaagagacagtgacatctgactttcattcgtgaaccccagatatctgagacaggtctcaagtcaatttagaaagtgtattttgccaaggttaaggatgtgccagtgacacagcctcaggaggtcctgatgacatgtgctcaaggtggctggggacagcttgcttttatacattttagggagacatgagacatcagtcattatgtgtaagatgtacattggttcggtttggtttggtaaggcgggacaacttgaggtatgggcttccaggtcttaagtagatgagagacaaaaggttgcattcttttgagtccttggttagccttccactgaatagacactttagtctggctcagttaatctgcattcat

SEQ ID NO: 120804 - DNA, 309 bp, Homo sapiens
ccctttcctgttgtttcattgaattgtcaaggaactctcatttttggcctgcaccctttgccctccactcgttgctgtctctggagtccaagaataccactgctccaagaggttacctgcctgcctaaaataacttctttcagtgcacaatcttctgcctaaggacctgtaatgctgtcttggtgtccagactccatcctggtttttgagcccttctctttccttctcagtgtagacagtgacccttcctactcatcagactggatgcatccttttctcccctctatatcatctcttagcaactcctcc

SEQ ID NO: 120805 - DNA, 376 bp, Homo sapiens
gctccagatagcatccacgtgctgctggccatgaggctcccgctgacttgctcagagttggaattagataatgaagcatgtaactgcatattcactttagctggctggtttaccgggaaggaaacgtcagaagtgaaactctggccagggaaatgtggatgcccagcctcatagcaatccagtcgtccagctggaagggagagttggtggtgatgagccatcttcaaatgccctgcatatgctgggcaaagcattctcggcctcacttcacagcataagtgtcatgttctctatttaactgaagctcagaaatggacaatgacctgctaaacctcccacatgtagttagtggtgggtggggatttgaacccaggtc

SEQ ID NO: 120806 - DNA, 397 bp, Homo sapiens
catgaaaatcttaaaaacttgctcccgattgacttttggtaaacaatgaaattaaggcagaaataaaagaaattatttgacataaatgaaaacagagacatgacttactaaaatctctgggatgcaacaaaagcaatgttaagaggaaagtttatagtactaaatgcctgtctcaaaaagtcataaagatctcaaattaatgatctaacatcaaatctagaggaagtggaaaaacgagaacaaactaatcctaaagctagcatcggaaaagaaagaactaaaatcagtgcagaactaaatgaaattaagaccccaaaatccacacaatatatcgacaaaaaaaaaaagttggttctttgaaagaataaatattggtagaacactagctagattaaca

SEQ ID NO: 120807 - DNA, 336 bp, Homo sapiens
cttttggggtctttgctagacaccgtggagaaaaaaagaagaaagaaaaacttaaacctatcacacacatacaaccatcaaaaccacataagccccttgaggaatctataaatataatagagaatatgagaaatgaaaaacaaatcactacaatcagagatagcgttacaagtgctttaagagtttgcagataatacattactagagtacaaaagggattaggtaagcttcacagggcaacagcatataagctatctgaaggccttcataaactagagatgaacaacatgagctaggacttggaggagcaaagaccccaaaaggggtaccgagctc

SEQ ID NO: 120808 - DNA, 158 bp, Homo sapiens
tgggtgttgttaggatctcagctcaaatgtcacttctccaaaggctctgaccagctaatgactctctccaccatcactctgcttaattgtttctccgccatctgaaataaactagctcattctcggtctccttcttctagaacaacagctttgtaatt

SEQ ID NO: 120809 - DNA, 153 bp, Homo sapiens
cttcaagaagaatcctcttgtgaaaatgttcatatgattttatgattctgcttccttccctgtccttgggaaagagtatattcaccctcagagaaggcgtgaggaatcaccaaaccagatcttttctcccaaatcagtcaagaaatgttcact

SEQ ID NO: 120810 - DNA, 408 bp, Homo sapiens
tcaccccacggtcacccagtgtgggcagggtctgtgtccagcaaagggagtcctggcccacgttccccagagacggtggcacctgggacgccgctccctgcacttttgtccctagggaagaatggatgggcctccaaagcccccaggaagatgctcccagaagtgggctggggtgggtggggggtgtgagtcacacacagaggaaggcctccgtgagccacagacacgcagcaacccttcctcagaaggtgcctggcctgccggcggccagatacaacaaaggcgcagcctgggccgctggctggacagaacaaaggcgcggcccgcacactggactgctgttgaatttcccaggaccccacggaggcccagcaactgcggggtgagcgcccacggcaggggcctcca

SEQ ID NO: 120811 - DNA, 1009 bp, Homo sapiens
atgactggtgttcttataagaagatataatttgggcacagacagagggaagatcctgtaaagacacaggaaggagagggtagccatctacaagcagagaggccttagaagaaatcaaccctaccaacatccctatccaggacctttcagcctccagaactataacaatcaaaagtgtggtcatctgctgtagtccagggaatcccagccttgcttgcaatagatggaactacttctttgggcttgcctgctgatcgcttccaagggacttcagcagctctgtttcagctggctcaaaggagaccttgctcagggagactcaacgtctgctggtataaagaaatgaggcatgctggcacaggttcaccccacagggcttggtgactgaggaccacagaaaccattttaggggctgagatgccaggcagatgccagcaccatgcttttgaacttcccagcctccagaacttttctagggaatagacatggacatcttcaaaaggccactgttctgtctgccacagaggacttcaaggccagaggccattactgatacatgaaagatcacttctatcaccagcaggaacagcaagtacccagaaacagggttcagatgagagatctgcatctgcaatgtcactgatagctccaaggcaggatacttaaaacaagcatactgcagcggggggacatatgagtccacaaaacagcctagagcagcaggaaaatcacctccaacttacttctgccttccaaattgtcgggtgaaggaagctggagctcatgaagattcctaatctgccacagaattgatgccaagagaagttggatcattgcgtggactttttcaaacgggcccccgtccggcaacactgtggtgaagacaggatggcactgttcccacaactgttagactgggattaaatccagactatgggaagggttgcatgtatggcactgaccagagaatatagccagatagattgcacaaggcgcctgagtttatatcg

SEQ ID NO: 120812 - DNA, 395 bp, Homo sapiens
tcttctgcggtcctgcctcgctgcatggtgagaccaggtgccagggacactgaggcacaagcagcctcttagagtgggaggagactggctggccacagagggttagggttagttcccttggaggccacatccttgctggcagaaaggttctctcccagcgtctaccatggagttagaacaatgacttgagcgcttggcagttcacccacacttacccgctgagacctctgtagataacagcccaaaggagatgaacaggagagaagagaaaaggccatctgcatcctccccatgagctccagagagcacgagtggtggtgagtgactttcatccaccctgatcccacctcacaggacctggctctgagcacagactctttttaatggaagggagg

SEQ ID NO: 120813 - DNA, 161 bp, Homo sapiens
gcccacttaccatctccatttcaatgtcaaacagggatctcaaacttcacaagttcaaagcagagctctggaatgcctgtcccaaacactgtagggtctcccaggtccccctcccctcactttctttctttgtcctgatcgagaagcatggagtacctgga

SEQ ID NO: 120814 - DNA, 419 bp, Homo sapiens
gttctgagctccgagggcgggagcgtggaccctgagggctcgttaattatgccccactggcctttcaacctgcgtggtaactaccaggctaggttttcctaactcgagccaaacagcaagtttctgacttgattatcactaaaagagaaaaatttcgatcttttctaatcagaagggagtaattttctctttttaaaaatattcgtatgtacattaaaaaaacggaaatgcacaggattttatcagtggtactcctcgagtagtagagttttcatctttttatgtatttctaaattttctacaatttacacacactgctctgtaccagtaaaggagtattaactctacagcttccagtttatctgggattactatcttgtgtttactgacttaactttaagactatggtatctttagca

SEQ ID NO: 120815 - DNA, 415 bp, Homo sapiens
gactaattgtcttataggatcgttttaattttgaaataactataatctgggataagtaattcatcacatatactttaatatgtgtaagtgtcatgtggttgaggactttctcatccttgtttgaaactgtctaggggctctgtgtggtggttcatgtccgtagtcccaacattttgaatccaagcactaggattgcctgagcccaggagttagagaacagcctgggcaacatggtgaaactcccatctctgtaaaaaatagaaaaatttgtcaggcatagtggtatgcacctgtagtcccagctactcaggaggctgaggtgggaggatcacctaagcttaggaaggttgacgctacagtgagcagtaatcatgccactgcactcgagcctgggcaacaaagggagaccctatct

SEQ ID NO: 120816 - DNA, 280 bp, Homo sapiens
actgttcaaatccttcctactccaagaaaccttcccaactccccacttcacagcccccgctgtatttgactcccaccatatcccactatacatgcaacacctcctgcctcacacccatcagcaagggccgtgttcctgtgcgtgtggcacaggaaccaaccagaagcctctccatcccaggcagggaccagatccctgcctgacctactttctgtctctagcagagttagcacagcactgtgcgacagcaggtacccaagacagacctggagcaagaact

SEQ ID NO: 120817 - DNA, 229 bp, Homo sapiens
ggtcttgaactcttgacctcagatgatccacctgcctcggcctcccaaagtgctaggattacaggtgtgagccaccgcgcccggcctctattagtctctttaatcctcactgtaacttagaggggtcagtgccactattttccttattctaccaatgaagaaatgggctcagtaatgtgaagtgactgctctgggttagtcatagagtggctgagttgaaactccctct

SEQ ID NO: 120818 - DNA, 336 bp, Homo sapiens
taagtacaatagtagaagaagctataaaatgctgtgttggctgggtactgtggctggccgggtgcggtggctcctgcctgtaatcccagcactttgggagaccgaggcaggtggatcacttgagttcaggagtatgagatcagcctggccaaaatggcaggaccctgtctctactaaatatagaaaaattagttgggtgtggtggcgcacgcctgtaatcccagctacacaggcggctgtggcaggagaatcacgtgaacccagcaagcgaaggttgcagtgacctgagatcgtgcactgcactccagcctgggtgacagagcgagactgcctctc

SEQ ID NO: 120819 - DNA, 584 bp, Homo sapiens
gaggagcgtctgtggggccttaacccattgtatttcgaaagcagccatagacaatatgtaaatgcataagcattcctgtgttccaataaaactttactgaataggcagtaggccatagattgctgaccctggctctaaaacagcttaaatagctacttgtactaaagaaacagcttagtggcaaaactaatatatataagaatctttaggctgggcgtggtggctcatgcctgtaatccaagcattttggaaggtgggaagattgtttgagcccagttcaggtgggaagactgtttgagcccaggagttcaagaccagcctgggcaacatagggagactctgtctctacaaataaagaaaattagccaggcatggtggcacacatatgtggtcccagctacttggaaggctaaagtgggaggattgcctgagcctgggaggttggggctgcagtgagctgtgattgcagcatgtactgtgcagagggagactctgtcaaaagaagagagagagagagagagagagagagaaaagaaaggaaagaaagaaagaaagaaagaaagaaagaaagaaagaaagaaaga

SEQ ID NO: 120820 - DNA, 424 bp, Homo sapiens
aatctataggttccccaaccatctctttctatccttttgaaatttatggttgaaaaatattgactaagcaaaagtctatattttttagtcattattttaactgctaggacaaaagaaaataaattatctcttatttatcctaattctaaaaattcttaagataattactagctcaacatcccaattaaatacaagaagggaaagatggaggctttttgcatttatgggaaatcagtcagcattagcaagtctcttaaagacagaccaggtttccatgaaacccgtaaataccattataaagaattttaacagcattttctgcaaatattttctcttatatcagggtcaagtttaaattttggtggattgttagaatttttccaaaaaggctgggcaaggtggctcatgcctgtaatcccagcat

SEQ ID NO: 120821 - DNA, 379 bp, Homo sapiens
tcagcttcaggctctgaagggttaaatgtcagctctgggacaagagaccatttcaggaaatggaatttgattcttggttttgttgccccctcccctccagcgtaccatactttccccgcatttacttacgtttcaggtgtcaacatggtgactcacccaccctcagggcagaagggctacccgctgccccagtgaaattcggtttgaatagggataacctggtccctccatgcagcccggaaatggctgtcaggacctgccaagggcttagtaggttggaatgctagtggacgtggccacatctggatctcatccccccgcccccgtcagaggggattggagagatgagggcagctccccaagagtcagtgccgcctct

SEQ ID NO: 120822 - DNA, 205 bp, Homo sapiens
aaatcagctggccgtggtagggtgcgcctgtcagctgaggtgggaggatcacctgagcccggaggccgagtcccccagactggccacaccgcggctattcagccttaggccagaggctttcctgtctaggtttcagagtccccatctgtcacgttagcatgtcatgtctgtacatgtgccaggatgtgcccagagcactttgtga

SEQ ID NO: 120823 - DNA, 347 bp, Homo sapiens
gatcttattttcctataaccacagaggtgaatatatggcccagagttggacaaactacagtgttcccttcccagccatagtgattggttcagagtagggcatgtgacccaagcttggccagtcagggtctatccatggacttatctgccacagcaataagaaaagactgttgctttcctagagtggaaatgcagataagttgagtctagggctaccactagccctttttgcttattgagagatagagtgacagagtcctgacaacagtatttaaggctctgaaccaaacaatacctaaaaccagccttcctacctgacatctccagttacatgaatcaataaattct

SEQ ID NO: 120824 - DNA, 338 bp, Homo sapiens
tgatgatgtctaggtgagaggaaagggccttcggaactaagggtgaaaagcagaggcctgaggggcctgcctggactgggtccctctgattcccagcctattgatcaccacaatcccaactcccaaaaaaaccctcctgaaagactcagaagctgaaaggacagatcaagaaaactggagaagtgatcacggcgtactggaatgaaaaacaggcatggagcacgtggggtctgggtgaagtcgctgccctgtttctctgtgaccttgggcaagtcacttcccatcccagcagataaattgtgggtgataattaccagcctccaaaggtgcctgcaata

SEQ ID NO: 120825 - DNA, 310 bp, Homo sapiens
tagaggaaggaggactgtaagtaagaggtgcttgggcatcctggcagttggggaggcctgagatgggcacgcggttgggtttgggagcggaggagcaggctgcgggttaagaagcccagacacaggtagaggggagaacacttcgtcatttttgtggctaatcggaagtgggagaccctcagggaggttgaagatggaaaccctacaaagggcttcaacctgagaagcctgaaagacacgtatagctgagttggacacaggcgacccgccagggtttgaagcagcacccggcctctagctgctatgccgg

SEQ ID NO: 120826 - DNA, 176 bp, Homo sapiens
tctatgcctataccctggggtctctaccaaacccaattcctgggtagagaatgctcaccttaaagaaatgctggaaatccagagacccttacactggttcataattaagaaagcaatgctgacaaaatcccaacaggagccccatgcagaggatcttggctggctatgtcttttag

SEQ ID NO: 120827 - DNA, 535 bp, Homo sapiens
attagctgggcgtggtggcgtgtgcctgtaatcccagctacttgggaggctgagacagaagaaccgcttgaactcgggaggcagaggttgcagtgagtcgagatcgggccactgcactccagcctggcgacagagcaagactccatctcaaaaaaaaaccaaaaagatgctggttgcagacttactgtgaatgggttttgcaactggactgttgacctgcagtttgaagttggtggcctgaggaaatggcatgcttccctttggctagcaggggatgcctagggcgggcactctaatcctccttcccctccaacttccagaggcctgtcacagttgactctttatatgctagggcctggcctcacgccctggagcttccctttggctcagaccctgcaaagggtaagacccttaggtctgtgtttcagagctctcggcttggaaagtgggggagggggaagatggtcttagattatggggaaaacccggaatggttcacagaactggaatgtcggctcttcagcctctgcggctt

SEQ ID NO: 120828 - DNA, 417 bp, Homo sapiens
tccagtttcccccaaggtgtgcatatttacatatcattttgttttgttttgtgatcataccatacataccactactctgcaatttgttttttactttaaaaacaaagtgccaataaaattactcaaaaactaggaatagaaggaaggtacacaacgtaacaaaggccatatatgaaaagccctcagctaacattacactcaacagtgaaggattaaaagcttttcctttaagatgaggaacaagacaaagatgcctgttttaatgacttctattcaacacagcattgaaagtcctagccagagcaattatataagaaaataaaaggcacctgaattagaaaaggagtaaaattatctctattcacagatcacaggatcttacatgtagaaaaccctgggctgggcgcagtggctgac

SEQ ID NO: 120829 - DNA, 198 bp, Homo sapiens
aggtaatggcactgactttgtaaaaatgatacgcttagctcttcttcatcagcatcatggaggcttggaacagaaagcagaaaaataacaatggcattcttcatatcttagcaaataaaatcatatttggaaggactaagtaagatcagcaggcttcctcgtgtacctaacaatatttttaacttgcagccaaaactg

SEQ ID NO: 120830 - DNA, 441 bp, Homo sapiens
ctggctacctatcttggcgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagcaattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacg

SEQ ID NO: 120831 - DNA, 308 bp, Homo sapiens
gtgtttctgagcagagtttgggacagccatcccaggaccacagacccagcaaactcatcccttcttctcctttcatcttattaccaggactcagggccacccagagctggccgctagcctcacttctaggcaagggggggaaagttctttaatgactaagccatttggggaaatgggtggggtcgaggtgtcttgggcagtattggcacttggcagaatgcccacagctattaaacagtgtattttgtttacatcctcaacattacacattgtttatatcacaattgcatccctcaggcacgtatttt

SEQ ID NO: 120832 - DNA, 869 bp, Homo sapiens
  misc_feature (619)..(619): n is a, c, g, or t
  misc_feature (665)..(665): n is a, c, g, or t
  misc_feature (687)..(687): n is a, c, g, or t
  misc_feature (734)..(734): n is a, c, g, or t
aaccgagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgcccactgtgactgtgcgagccacgacagagacacgggcgctcgtgagcagtgtgcttcgtggagtgctgcatccagagtacatcagcacggtcgcacacaaaaagcagacctacatcagccagtcagtccgtgcagtgactatcacttcaagactacaacttcacagtcagctcttgcactgtacctgtcaactaagctacccttggatgtccggtcctggaaccaggacgtccaagatcgcgtagcagatgagcgccagacgcgctcgtctcaggttggcactctattcctcaaggaaacaaaccgtgacagcgccacacgtattcaggaggcgttccacagacccccatgatggggcagcacatctcagtcgacaagcacgggagatggtcgtctagacacagccattttgtgcagaagtgcgcgtcgcgtccgacgtctattncctgaatgccctaacccaattttgtgcgcagtgttttgcgagtacngacgcgaggcgagtctggcatngtcacaagagagtgtttggaagacgtggcaaggaatttgtcgtgccncaggaggccttgacgttggacccacaggacttccttgtcataacacttgacgtattagaccttccgcgcacgccactctgagcacaccgaacatatggatcaaagatgcgacagcacatctattgggaagcctca

SEQ ID NO: 120833 - DNA, 810 bp, Homo sapiens
gataacataatagtattgtggttattattattatttttaaaatcatcattttttaaagagagggtctctgttgcccaggctggggtgcagtggtatgagcatggcttgctgggtacaagtgatcctctggcctcactgtcctgagtagctgggactacaggtacacaccaccatgcccagctaatttcatattattttttgtagagatgggggtcttgctatgttgcccaggctggtctcaaactgctggcatcaggtgattctcttgccttaaatcctcatcttcaagcctatttaaaactgaaaacccttatcctgaatttcttatcagtaaaataaggaagaggactaaatgtctttgctgctttctctgtgctctgctctagctgttatataatagccactccctcatgatttccttctcagaatcttattattataatgtataagcaataatgttgcttgtggataagactttatttaatgcgtctacctctgggggcaggaacttcagggctcacgctggatgacctgattgaccctaggaagttgctctgtaccctcttccagaccatttgtcccctcctgagcaggatctgaacataacagctctgggccttgagtcaggggtcatttagggtcttgataaccaagaatgtatagactgggatgagttagacttggtggagagccaaccctctgtgtggaagtcctaattcttcagtaggtgataactgattaatacccatgtggaaaccagaagcaataaccaccagagagtagtaatgatttggcacaccaccccctttt

SEQ ID NO: 120834 - DNA, 580 bp, Homo sapiens
gttaggggaggcagggcaatgttggaatcttaaagagtagagaagactccatcaagatagcacttgaacaaagtctcagcagtgtgggattgaaccttctggacacctgggaggagagaattccaggcagagacagcaagggcaaagcccttgggctatgagcatgtaagagggctccaggaacagtgtggtagccagtgagggctgaggcagacccaggaagagtgagagacgggatgtaagcatgtggtcctgtagactgtatagagccttgtgtgaactttggctgccactctgagagggggccattgagcagaggagtgatagggtcaggcgtgtgctttaggggattggtgagcaaaggtggaaacagaccagttaggaggccatttgcagtagctcaggtgagaagtgcaggtggcttgtaccagtgtgccagaagttagaattttgagaactggttagattctgtacttaccttgaaggtaaaattaataggatttgttgacaggctgactatatgagaaattaaggcgtcagggttgatttctaggtatttttgtctgagcagttgagatga

SEQ ID NO: 120835 - DNA, 299 bp, Homo sapiens
catgtctgggaccacaggcacaagccacaatcagccaatctgatgccattttacacacagcataaaccccatcgctacagacctgagcaagccaggcctggcttgctcaggtctgggacagaccacagacatctggcttcaaaggccatagtattgtaatgactaaaatagagaacacctcctgagtgaagaaagatgcactgaaatgaagtgatcaaagcacagactctggaaccagagtcctgtgttcaaaccctaaatctgtcacttactagctgtgagaccctgggaaaggcact

SEQ ID NO: 120836 - DNA, 1054 bp, Homo sapiens
ccatgttggccaggctagtctcaaattcctgacctcaagtgatcccctacctgggcttcacaaagtgctgggattacaggcatgagccaccgcacctgggcagaaatgctattttagaagtgatctcatgtgatactatgtttttcaacatgatgtcagaaattggtaacctgctgttttatcagttaagttctgtcaagccccagcctcacgccgtgaccactccttgtctgtgaaacccagttctacagaagtcacaaagccattgtcttagtctgctcagtactgcttagtctgctgccataataaataccacagactggattccttgaacagaaatgtatttctcacagctctggagactgggaattccaagatctgggtgctggccaatttggttcctcatgagggctctcttcctggctttaaggtggctgccatcttgctgtgttctcatgcggtgaggggatggagagagcacaggctttctggtgtctcttgttataaggtcacaaattccatcatgagacctcacctttgtggcctcacctagccccaattatctcccaaaggccctacctccaaatgctatcacattagagcttagggcttcaatatatgaattctggcaggacacaaaacattcagtccattacagccattcattcatacacgtgtttggggttttcagttacattaagcaacatgttttgcagctacttggtttgatagtgccaaatctacccggaaatgatttcagccctaaggaaaacagctcctgctacagtggaacacacagtagacaggcacgagagaataaccaaggattagaccgaggcgttgtcatgcgtttggctcattaagccatgcatgttaggcttggagctctattttgaggtgtgttgagaccaaatccttctcctagatcccagtacttaagcctggcaggaaaaaaagctgagtacactgtggttttagagtgtaccttttgataaatagtttgcagcatgtccctgaaaggggaattttttcctttgtcttgcaaatgtcaaat

SEQ ID NO: 120837 - DNA, 387 bp, Homo sapiens
aaggcagaagaccagctgacataaccctaggagactccgtgtactactgggcaatgtctatgcttcacccaagcaggaaagaaaaccagattttaaattcttgcatctgtcccatcacatcctctactagacatcaagtcccacgagggcagatttcacctgccgtggccactgctatctcctccaatgcttggacagtgcccagcacatagtgggccttcaatgagtgtgtattcgacaaattaattccaaagttatatttgtgactctcaaaaaccttcctaatctgactcagcagacgctctcccgctcctgcctcctttgtgtgttcagctcaccctacacatgctctttttactcccatttccttcgtcctatctgcagctt

SEQ ID NO: 120838 - DNA, 429 bp, Homo sapiens
atccttagaagggctccctttcatcccctacaggaagtaccattcccagcaggccttccatgcaggagccatgcttaatatactggttcttcaggaacacccagagaaggaacctgcccccatcaaaagctcagagagtccttgtctagacacaatgacagtaacttagctgaaataagccacagagagggaaacaggacataggagaaagggcacagatactggagtcagacagttctggatattcatcctggctctgccatgtaccggttacatgatttgtagttagttaactcccctatgcctcagttcctttgtatgtacaatgggaataataacaggacctagtccatagaggtgttgttgagaaacagaccatgagagaaccatgtaaaacatgagaaatgaagtaaatgattctttattatt

SEQ ID NO: 120839 - DNA, 865 bp, Homo sapiens
ccatcgcataatacaaatataaatgttgatatcagtactttgttcagtatcattttctctattgcacatcacctagcaatcctccttttaggaatggttggctcaacaagatctcattaaccttgtgttttctttgagtggtgcactatactaacagctataaagtgcatttcctgttatttgtttcctatgtggcagtctttcttaacttgtcaatactttatttccaagtctttatagaggaagtgactatagtcaaagaagttaaatgttatcttaaaatacacttaaaaaaatcctggaagtacctgaaccattttagaaatattcttgtcatttttactctttaaaatagtacattcaaaaaaagagtgttaataataacacttaaagatatattcttatctttaagcaatattggcttcaacagcagtcacatcagtgtcttgtgctttatttggcctgatgtgggaatggatggtgccaattgtaaaaaaaactttggttaatttatttagtcagtatctagatagaactctataagactatgatggggcttttgtgtaatattttctattgtaaaagcaaaagaacacatttcttgtgcatttaggtaagagaaaaaactcacatatttaaaacctgcttttttgcgggagggtggagataatacacaggtaaatttttattttggtttgttttgcaccaccttctttccatttttggtcagctgttcaggctgcatttccgggataatgtatttaccatgcattttagtcattgtacctctcagcctccagctggccttcccccagggtatctttgcacttgcaggtcagaaaagaccaagttatgaatgtgatct

SEQ ID NO: 120840 - DNA, 244 bp, Homo sapiens
atcagccggttgtggtggtgcgtgcctgtagtcccagctactcaggaggctggggtgggaggattgcttgagcccaggagatggaggttgcagtgagctgagaccaggctgagagcctggttgacacactgaggcccatctaaaaaaaaagcagaatggttttttcaatgaaaccttccagctgctgtaccactatgtattaagcagtgaaatgggacacatccaagagcctcttgtgcttttc

SEQ ID NO: 120841 - DNA, 327 bp, Homo sapiens
tttcttttatctctacaaatattgtgacttgtaattgtcacttataaattcattctggctatactgaatcattccccaattatccgagtcatccaaatatttgatgtgcatttccacaaatcatgtactggcccccactacaagtgattggggataacttgtagaattaattatatgctttatatctccattcaggtcaccaatacattgaagagagcagggcccagaacagcttatatggatcaacgactgacagagctgctggggttggtgcaaagccactgacttttgctattacccataacaaagtatgttcaaatgtaggtc

SEQ ID NO: 120842 - DNA, 490 bp, Homo sapiens
ggcttatccacaggcatcatatggtgaatatccaaaaagagaaatgtaaggatattgtggcaaggctcggcaaaataggaatagcttttcaacaatctttccacgaaggaaagtcagtgttttcttagatctctgtaggtattttacaaccagagagcttctcagcaagtagcacttgtaaactcagagatgaacaagaagaagccaaatcacagcttccgaataggtcaaattagcaaaagagacttgccattaaaagcctgacactgagcgtctgttaagggaaaatcagttgtccaagtcacttaaagacttgtacctcaattttctcataagtaatttaacagatcattcttaagaattgctggataggccgggcaggatggctcacgcctgtaatcccagcactttgggaggccaaggcaggcggatcacgaggtcaggggattgagaccatcctggctaacactgtgaaaccctgtctctactt

SEQ ID NO: 120843 - DNA, 235 bp, Homo sapiens
ggtggatgtcctgcccttgctctgtctttaccctggtcaagtcccttcccttctctggtaaaagaccaggaaggacaggaaggcagcactgaccgcctccaatgtgcctcctacactggcggcctgtgtcaagatgtgtcactgagcatgtcgccatgtccttgtgcctgtcacccccatgtcaccagttcccagtgtctctccaccctgagagacagagcgagactccatctca

SEQ ID NO: 120844 - DNA, 450 bp, Homo sapiens
ctcctggattagaagcttaggctgtcccccagccctatgctgaggacttggaggcaaggtggtttcccagctccatacctaggcatgcctctaggcacttggtagccacctactggattctctctcagcactcgtgcttgtgcttgctaagtggacctggctggtctggccttgcccatcatggcccctactccaggtgcagagcaaagagctcaggccactgcccattccgtggatctgccttttggctgtggaaacagagagcttctgcctctgtaaacaagcatcctgtaaacaagaatcaaatatatacccagccacgtgggctgcagcaggctcttacctgcaagtaccacctacgggcttacaggttgaactgcacagccccatataaaacctgccaaaagaagtgcacagggctatagaagcaaagccaagaccccatctagc

SEQ ID NO: 120845 - DNA, 753 bp, Homo sapiens
tactttataagcatattgaggggaggtaaatggttatagagaaacagagaatgggaaaaagtataataaactacaggatatttgcacaaccatgacactaaaagatttgacttgtagttattctcttgggtaccctgaggttaacacgtaatacccattcaactaagcctctataaacagttgggttttccgcaatcacagccactattcccacttcagtgggcagcagtgttcagagaaaagccagatttagctcttgtgcaataaacaccagaaaccaaaagagctaggaaagctgtttacgtctatgcccaccaggaacccttctctgctataaccgcatgaatgaactggtaagaatgaggtctcaacaaagcttcaagacggacgttgttaactagttgctgccctccaagtttttggcaagacagattaatgaaaaacaggtaacttatttttatacaggctcagtatatttacaagcagaaaggaattctgtacttttcaaagcatttagctaccaccttatgtagtatttaaggtagacaggaagaacaatcatttccaagtatttctatgcactctttacaaacattatctcatttaaattctcaaaataatcaaaagggtaggaattatcaccccattttacaaacgcagaaattaaaggacagaggggatgaataatctgcctaaggttccagagcaagtaagtagcagagaaggcaagaatcatcacttcgttctcaggca

SEQ ID NO: 120846 - DNA, 724 bp, Homo sapiens
gggagtctgttttgtacttgttttcacattaatcaaagagaaggctgcaatgtaccttcacggttctcttaattaattcctgtaactcaaggtacctcctcagctctcttcctgcagcactgaagaaagaccagcaagagtgttctgagcaagcctcagaacactcagagtaaatgacaagagtgttcttgtcttgccgttggttttgttactttctttttgattaatgtggaaaccagtacaaaaaagactcactggagttttctctaatcagagggaggaggtttcccactctgctcaggagtataatatcatccactcttctcattaactttttatcagagatcttgctacctagttgtaacttgcaagcgacattcggcactcttctcttgacagtgcgcattgcagacctctcatatttagatctgttttctgaaagagcatgtgtccttttcctcagactactctaatcaaaatctaatcaaggtttttaagcagaagagataaagtggctccatggcactgacttaagtatccaccttggccacttgcccctgctccgctcattctgttccattcagtaataaaaattttcccatcaggcaataagaggtcaggtagcacttctcaccgctggaacaaggctttggagttaggggtgtgggtccatttgaaggatgaagccaattgttttgactgatttcagtttatcagtctgacc

SEQ ID NO: 120847 - DNA, 371 bp, Homo sapiens
agttaacattctgtggtaactgaaacttgaactgtgttgctcgggggacaactgtgataactgaaatttgtgaatattgaaactatgggccgggcacagtggctcacacctgtaatcctagcacttcgggaggctgaggcgggtggatcacgaggtcaggagatcaagaccatcctggctaacacggtgaaaccccgtctctactaaaaaaatacaaaaaaattagccaggcgtggtagtgggcgcctgtagtcccagctactcaggaggctgaggcaggagaatggtgtgaacccaggaggtggagcttgcagtgagccgagatcccaccactacactccagcctgggcgacagagtgagactccgtctc

SEQ ID NO: 120848 - DNA, 883 bp, Homo sapiens
gtgacctaagacactgatctaaactgaatgtacatggctaatggtttggatagacagatttttttaagtgggcaaaagtggaggttgtgttgactggaagctttggggaacagtgatacggatgaatttcccagaatggtcccagagtatgagaataatatcccacgtgaatgctaacctaaattcccactcttcagaggaggctatcaacaatcaggtacacatcaaccatatggctgtcatgtagtctcttttcctatcaccccacttattgcccaagtgatttacttgtaaactgtgaccagggtggtaggcaatgatagaggtgatacttgagttctgtagtatagacttagctcaccaaggctgacctctggatactgctgctgctaagtgtcccatatgtcaggggaagtattcttgtattcttgcaagtattttgtcatggatgaggcagagatttgtcttcactgagataaacactctagatttcgatatgcttcactttcttacatgctattgctagcaggaccatctgtgaacttactgaacgctttatacctcatatctcaacattttttggacccatttctatacattatacagaaagggtaaggtaatgcatgggtgaccatgagactcggtagtcctaatgtgtaccacattccttataagcagaagtctgaatttttggaagactcagttaaagtggcatgtagtcatttagcaccctcttgaagtactgttcaattttggacgttatagatgagctgaatagtgactaagaaaaagcataatttcttctgtagacaaaatgcattcgttaaagaaaggagaggtaggaatggagtggtacctctcatattacacttaataatagcca

SEQ ID NO: 120849 - DNA, 957 bp, Homo sapiens
aacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaa

SEQ ID NO: 120850 - DNA, 234 bp, Homo sapiens
tgctgggattacaggcgtgagcaaccgcgccaggcctaggatgtcttcttaagtgtgcacgcaaatcatgcaggagaaattaggcagagtgcgtggaagccaagtgacttgtttctcaccaggaggaaaccccatctctgaggtcagttggtggcttctctacccaggtgtctgttgaacccagagtggtgtcacacctcaggatcggtcccccaaattctgtgcaatgaaagg

SEQ ID NO: 120851 - DNA, 333 bp, Homo sapiens
cacacatgaatgcctgatttcagagtgagtagtgttgggagcatggttctgggaggtgatgacatctcttctttcctaagtctttgaatgtgtcccatgagtgtcctgtgcttcctcaagggaatagctgtgagctgcctgattgccctaggccattgcatggcctgtgtgaccatgcttctggcatcattgcccctggtatcattgcccctggcatccttttctctttgcccagtattccaaggctcaggtcgcctctgctcctgcagcctgccttacttcttcagcctgctgtgaacaccttccatactgggctgagtaaggaggctgtag

SEQ ID NO: 120852 - DNA, 181 bp, Homo sapiens
ggagcggtctgggcatgctctcctccctgtcctcatctcctccactcctccctgtcctcatctcctccactcctccctgtcctcatctcctccactcctccctgtcctcatctcctgcactcctctctctcctcatctcctccactcctccctgtcctcatctcctccactcctccctgtc

SEQ ID NO: 120853 - DNA, 292 bp, Homo sapiens
ccaggcttccttacatggtgtcccgagagtagcaagggggcaaagggaaactgaggcctagatttggaagttgcacagtgtcatttttgccacattttataggccaagaaaactcaacaaggttaagcgaaggaatacaaatccacctcttgaagagagaagtggtaaagtcacattgcaggacttgtgtacaaggatgaattgttatagccatttttgaaaacctagatgtattttctttatttcctattgaattcattgtggcaggatggaggcattggagcaagcaggg

SEQ ID NO: 120854 - DNA, 857 bp, Homo sapiens
ccccaggctcatgttcctactggacctcctcatacactttgccctagccaccctggaattctttctgggcctcagatgtgctgtttcctccaccgtgagccttgttttctccatccatagccggctgcctctcatcttccagggctcacattgaatgccacggcttcagagagcctgtgctgattctccctctccacgagcccctctacccattcacaatacatgttcattaaataagcaaaaaccaacaaaaataacagcaaaacctgccctaaatcaccttccttctcatcacctctcaatgagaatcaaagtcaaggacagtttactgagtaatgctggcaataatggacattgtagtaaatcatgcatatgatgaagccaaaatccacagtttaaagtagagtggaacggatgagaaaacaacccaaaaccctgattatgttatttctgatcgctagttggtggaccttgctttaaaacacctccatcccattcactttttgtcagagaaccctatttgcttccttcatagtaatggtcacagactatcttatctttgttctttggctttgtcctctaaatccccagcatctagcatatgttcagctcttggtggacatacatacagagcctcagcacttgctgttccctctgccaggaatgcccttctcccggacaccctcccagcgggctgctttgttccttcctgcaagtcatcacccaaatggcaccatcactcaaattcttccctcacttccctgtctctgggccctctccagcccatgccctgctgtatttttctccttgccctgttcttgtcactgcttaacatgttaccagcgcagtagagttac

SEQ ID NO: 120855 - DNA, 288 bp, Homo sapiens
gaaggcaaaaatgctttctacaatggcgttccttcctatttgactgggcacctacgaatttatgctgtgtgctagaaatagactaaaacattcttacagcatgttagtgtgtttgcgtgtttgctgaagatcacttcggtataaaccagtttgttaggctctctgggttagggactctgcattttcttcctctcctaccgagatggtgttccactggtccagcccggcaggagcagcaggcagggcacagctttactggctgtttgctgctttgctttagtgcaatgt

SEQ ID NO: 120856 - DNA, 189 bp, Homo sapiens
ccttgctggggggtggtgctgcctgatttatgagtggaggataactatagccagcccattccacccacagaactgatggagacaaaatgagattatgttttttcagaacttggcagctgccaggggttggtgagggacccattgggccttcctgaagagccctggctgccagtgctgtctgagtggatt

SEQ ID NO: 120857 - DNA, 289 bp, Homo sapiens
gccagcgtctctctgagtgggatgctgtgatctatagaatgtcttcttgtgcagtgcacccctgagaacccatacttggtggctctgcttgctctgactcgatatgtagaaatcagtctaagttgtacctcctctaggtaacctgacatccattcacccagacacacatctcctctgtgctcccttagtacctgggacctgcctttagcttagttgcctattgtagaccttaagaactctggctcgggagtcaaactgataggaagtggaattgtggttcactgctgtg

SEQ ID NO: 120858 - DNA, 733 bp, Homo sapiens
ggtaaataaacatggaataaaaagtttgtactcagaaatgaaaaatgccaattaaattagtgataccacattgtatatctgaaatagctgagaatgagtatattctttcatttattattgtataacaaattggcataattgagttttatagtacatatgaaacaaaaaaagttaatgctattttgccctgtaatcccacaattaaagctttttgaaaggaaataattcaaatgagcaataatactgtacacgtataggtctatttagaagggcattatgtagttttaaaaaatcactataatgtagaaacgagttagtatgaaactttaggacacaaaatgagatgccagtcaattataagtaagaggtctgtgtgggtaaaaactgaaaggtaatagaaatgagaagaattctggttggtaagaataagatagttatatatcttaaagctttcagtgaaatcttaaccttttaattttttttttagcctttttttgttagttttgagagagagtcttactgtgttgcataggctggagtgcagtggcacgatctcagctcactgcaacctctgcctcctgggttccaataattctcatgccacagcctcccaagtagctgggattacaggcctgtgccatcttacctggctgatttttgtatttttagtagagatggggttttactgtgttggccaggctggtcccaaactcttgacctaaagtcatccacc

SEQ ID NO: 120859 - DNA, 875 bp, Homo sapiens
tctgtaagaagggtccgtatgcaggggaagggggaatgacacgaacccccccaaaaatgaagagctcccagaatagaagaatgcaaccccagaaaagaaatatcagcatgctgtatctgggggggcagggtggggcggggaggcctcagacagcctcgttgagttaacagaatggcctcttgtttctgagagcaatccagaaaagagacaagagtcctagcaccctgaacattcccattttccaacactgcctggaaatatacactttcacgtgctcaggaagggcaccaaagtagggagtttggctgaatatgaaggtctttcaaagctgagaataagagtgatgctatatggtggctcacgcctgtaatcccagcactttgggaggctgaggcgggcggatcacgaggtcaggagatcgagaccatcctggctaacacggtgaaaccccgtctctactaaaaatacaaaaaaaaaaaaaaaaacggaagaaaaacaagaaaaaaattacccaggggggggggaacgccccttacaccaagaaacaacagagggggggaacacagaaaagggtgtgcaccccgggaacggaacacatgtgatagtggaaccaaaagttgacacatgtcatccgagcgtgggggcgaaggaaaagtcctgtgttcaaaagactgacacgaattaggcaatattgcaacgatttttaacaacggagtaaattgaattatgccatgggatgggaagccccctatagaaaggatctgacactggaaggacgggggaaaaaaaggtagagagggagaagacactatgaaggacacgggtagtatgagatgagtgtaagataggatagtaagattaagaggagagataaa

SEQ ID NO: 120860 - DNA, 406 bp, Homo sapiens
atctcctcctacgcaataccaaagtcttaattcaacagtcagtcaggagaaatagagtcgcagaatcaaagggtcgtcacagccgggtgcagtggctcatgcctgcaatccaagcactttgggagactgaggcgggaggattgcttcagccaaggagttcgaggccagcctgggcaacatagtgagaccctttcttctaataaaaaaaaagaaagaaagaaagaataaaagacactcagttggggttttggttttccacaagttgaggttgccaacctcatcagattaacctcgaaccctgacaactaaggaaagagagtggaggaagcaaagagcctctgccacctgtgtgagcctcagattcctcctccataaacccgagagactgatgtgtacctggctgcat

SEQ ID NO: 120861 - DNA, 351 bp, Homo sapiens
ctgaggttggggagagctggtggtttggaggaactacagggaggcccaggcagctggagcacaaggagatggggtggagaggaggtcgggaatcccaccctaccccttcccagccgctcctctgccaccaccctggaacactgccagggtccccttgaggggccgcctgcctccacccctgcctgatggggctgctcacagcacaggcagaagggtcctgtcagcacttaaggctgcccacttccctcctccgctcagaaccctccgcggctcccgtctcactgggagaagagctagagtcctctctgtggcccacaaagccctttaggacctggcctcgctcactctctg

SEQ ID NO: 120862 - DNA, 906 bp, Homo sapiens
ctcactgggactctaaaggtacagtttatttatttatttatttatttatgagatggagtcttgctctgttgcccaggctggagtgtaatggcgtgatctctgctcaccgcaacctctgcctccccggttcaagcaattctgctgcctcagcctcccaagtagctgggattataggcatgtgccaccacgccctgctaattttttgtgtttttagtagagacggggtttcaccatgttggccaggctgatctccaactcctgataaaggtacagtttaaaaggtacctcttttggagtaataaaaatgtatggactcaaatttgtcagaatgttaaatgggcaaaaggtggaggatactttctgaggaagaaacaggctagagagtgcacaagtaaatttaatgcttcaagtagaaaaagagttagaaagaatacaagggaaaaattacatctgatttccttttctgctaaccgaaatttagcctctacttccattatgcatccaggcagcagccacagttgcattagcaatacctgtgacggtctcaccagcagaaattatgactttcagtattttaatatcacattcacagtggctccaaatatcttgaaaagtttactctcagcatgactttgaaattataattgttattatatccaccacattaaatacagaatcacagaagttattatatcaaatatttgttgcttttaaagttttgcttaaaaacttcaatttctagtactacagtttcaatataatttattgcctttgtcatctcatggctttctccttcttcttcctttagcatttataaactttattttgagaagtgtctacaaagtttgtcagactgcaaagaagtccatatctcataaaagaccaagctttaaaggtggaagaaga

SEQ ID NO: 120863 - DNA, 1900 bp, Homo sapiens
tgctggaattacaggcatgagccaccatgcctggccttctatgtgttttttatagttgttttcacggtcattgtgggtatcacattatagataatgtgacttaccaccattcactgccatcaataccattacatggaatgagatatggaaaccttaatttcagttgggtctctttccccacttttaaatagtattgttttgaggattaatgctattacagtttttgtatcagttatccaatatgacttatagaacttatcaagggagtgatgctctgttgtatgtacccatgtttctgctatttccattattttttccaagattccatcttttattacttccattagccagtcttcaaaggcagttctgctagtgagaaattctttttgtttttctctttctgaagatgactttattttccctttattcccaaagaatagttttatttgtgctatttggggttcgctcagcttcttgaagctgtaagtttgtgtcttttgccaaacatggaaaattttcaaccattatttcttcaggtgttctttcagcgtcactcttttctccattctaggcctctaatgatacaaatgttgagtcatttgttactgttccacatggacctgaggcatggttcatttttcagtctattttctctcttttgttcagatttctctcctttgtcatcttcactctactgttgagcccatctaatgattatttttctcctattgtattttttaggtctataatttccatttgcttttttttccttgtaacttgtttccttgctgagattttctattgtttcgtttttgaaacagtagaacttgtaattgcttgtcaaatcatttctctgatggcagcattaagatccttgccagataatttcagcatcttactcatcccagtgttggcgttttctttccttcatgtaattttcctggttcttggtatgacagataatttttggattgtgtctcggacattttagttattatatcaggagactctgtactttttaaaaattttaacttcagtagtaacctgttaaggtatagcatgtaggtactagcatatatttgtgagctgtggttccagtgaccatttttcagaggctttatggtgctgttttggtttgttgcttttatctcagtccactggggctcgcactggttcctagtagtgctgcttgaggggccttctccaggctgagctgcgcagagtgtgtttgggtgagggaagaggacccccactagattttcgtgggctggagagtgcttcctgagccttgtgcctgttgtggcaggctcccccttgctggtgttcctggcagtgctcctgaccacattgtgtccctgggctgtggaacacttgcaggaaaggtgaacactgccaggaccaattatagcagaattcctcctgccagtacacagcagcactgtggctctggaccagcaaggagagtctcaagcatgggtttgtttctttttgattttaagatttttcttctgccttcaggttctggtattattgttctgttttattcacctttatgtttcttctagtttagttttagtttctttgtatttgatgggatttttttccttgcatttctaattactccttagttgtgtcatgtcttcctttttttcagttaccctcattcagaaatttcccatttctaatgatttgttattttttaaattctttttagctcagtttgaaatttgtttacagttttcatgttttatttgcatattgtttcatgtactttgattttctgtagggacaccattctcatgtatatgcacatactttttctctaataattacactgtttcactctgttctgttatttatttatttgtgtgtgtgtgtgtgtgtgtgtgagtgaaatgag

SEQ ID NO: 120864 - DNA, 313 bp, Homo sapiens
atttttcctatatattggtgtcaaagttattcattgtgtatgctaatttgaccattacacccccactaaaaaccatcagactattacccaataaataaactacaagttttaaccacagtcttcagggtagtagatttattgccttcttcactgttactccttataccttccctgtaatacaaagttacttatcacctgagtgcaacccttaattgctgcaactttactcccactgctgtcatatttactttattttcattcccttggtactgaattttcctctcaattttataaatcttttgtaacattaaac

SEQ ID NO: 120865 - DNA, 701 bp, Homo sapiens
ttgacaagtgatcgtcgcaagctcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccgcacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccaatgagcttgggaagtggggtacgactcgaattcgtatctggcatagtgttctgga

SEQ ID NO: 120866 - DNA, 677 bp, Homo sapiens
gaagaagaagttcaaagaaaaagaaagaaaaagtcactgaaattaatgatcatttttaatgttgtcaatttgacatacggaatttggtttatttgtttctgttggcatacaattttagatgcctcccatttcctgtctgtcttgattttaactttctgaatcatgtaaaatatttacatgattcagaattcaaacttcaaactatgacagtcacttgctgttcactatcaccagaacagcaagagagatatccacatccatgatccagtcacctcccatcaggtccctcctccaacactggggattacaattcaacatgagatttgcgcagggacacaaatccaaaccatatcatagatacacttagaaagtcttattcacctccctatctcttccatcacattcccacctcactccatgtaggtaattattttgtattagtttccggtttatccttttttgtatttttctggaaaaaataagcaaatacaaaaatacatatataaataattttttttctttttttcccattttccatacgcaaaaggtagcatgccttacttctttatattctgttcacttaatatatacagaaaatcatgatatcagttcatagagatatgtctttttcttttttaccactgtatagtaaccaactttgtgaatgtaatattgtt

SEQ ID NO: 120867 - DNA, 209 bp, Homo sapiens
taactgatgcatatttttaaaggacaaattttgggtgccaaccaattcttagcaatagaaaaatttcacagcaggaggctctagctctatgaacttgatccttgcagcttcctctttttatgggcacacaggtacaccaggaaacactcgatggactgctgcactaccctggtttcaactggaattttgttacagtgagtacaccatga

SEQ ID NO: 120868 - DNA, 155 bp, Homo sapiens
tgctgggattaccggcgtgagccactgtgcccagccccctcttatattcaatgtattcctttgaggtcactcactttggcacgtaattttctatttttctggttggtgtttgcccacccttcccaaacaaagaaatgcctttattcggccacctc

SEQ ID NO: 120869 - DNA, 421 bp, Homo sapiens
ggggtgctatgtctcttggtattgccctgagttttgcaagcagcttgcatacagaccatacaccatttacaagacaaaaaagaggaagacccaatagtaaatatgacaatctctgccctcagagaacttacagtttagcaggtgggacagacaaattaaaagaaaggacatcttccagactggaatgggatcgggctcaggaaaggcttccttgaaaacaaaataccatttggctgagatctaaggagcaacctgactttgcacgcttatgtatttatgttatgtgttttactttatggagaattttctgagtagagaggtaaaaagagatacaagaaaaatggtaaaaaagcacagaggagaaaaagatagcaagtgattccattctgttgggacataaatactaagaaagaagcctttg

SEQ ID NO: 120870 - DNA, 912 bp, Homo sapiens
acatgtgaagctgccagcaggacaattgttttttttcccatggatcattaataaaccattctggcctggcaattccatcatcttcctcagctttgtcagacggatcttcctcctttttagtataaagctttaaaaatggctgggagtggcaagagggagggaaaagaagaatctacttccatttaatgcacatgtttttccctaagctgaaaagtggctccctgctttcagatcatcttggcagccagaatacaaagggttcaaggcttgccatgggtgggaagtggctcggctcctagtatttgcagcaaactacagaccaggcctgatatggagacgaggcaactagtgcagcagatggcaaatagtcctgctccactggggctccagatatgcaccatcttcttccttcagccaaggcagcctcattcctgctatgcctgagtacagaaagcatttctggttttttagaaactccttttttaggcaaagatggaagaaggcaaagcaaatattatatgggaaactcaatctagttatagacgtttctttgtcaaacaaactaaaatagagcttttcctttgttggttagaaaaatttaggaatggaaatctacatttctccaaagagcattgagtgcaaagataaaaaccaaattataaatagaagtgagtatgacccattcagtttccaaggacttgagcatacagccttcataatactgaattatagcctttcatagatagaagggatctagaggttatatagtccaatccaaacatttcacagtaaatgagaaaactgaggcatgaagaagttcatcacttgatgtgcactttcacatggtaaatttcatggtagagccagtctccacattcctactgtattgctcttacctttatccccacagtg

SEQ ID NO: 120871 - DNA, 307 bp, Homo sapiens
cactagtgggaaagtaattgatacatttttggaggccgtctttcagttttaagtgcatataactctttaaaccacatgttctctttaaaggatttattatgaaaaataaaatttcacaaaaacatacagaaatatctacaacctgctgttagatgtacaaaattaaattgtataacaatgttaaaataattcctatcacgttatcttctctccctttttcaaaagtatctctatcttgcatatatgtcaacatattgtgttggtaacagtgtgtgtgaggcaggagactcctatactttatgtaacg

SEQ ID NO: 120872 - DNA, 453 bp, Homo sapiens
ccactatcgatgcacaagatcttttggcgtgctggtggaaaagagaagataatggcagtaagtccaaaagcagggagtagcacagacaaaaatatcagtaaatttcaaacacatatggagagcgagggacctagcaaatggaacctgcctgagatcaccacttgggtgatctcacctaacaccctattttacagatgagtcaggcaatggagaccaagaaaggttaagtaaattgcccatgaacacaccagttaagggcagacacgagcctaaatcactggcatattaaccttggtttcaatctccccttgctactcaatccaacataacctttggtgcttggctaattcacacttgtgatttgggtctcccagcatcattagttcacctgctcttcacttcctagccactcacattatgtgagtggcatcgataaacaccgggtaccgagct

SEQ ID NO: 120873 - DNA, 371 bp, Homo sapiens
tacggttattctgcagaaagataagagttacctcttattaatcctatctactgggaaaatattttacacttttagattcaaagccagccacataaaatactaaatctagtggaaatcttacataaaaaaagatgacttttctagtaataaaacatttcctatcaaaatgaagatttttaaaaatagaataattctagtggttagaatagattatttagttgatttttgtttagttcatattattatggtcaacccctatttctttttttggacagctatttcttcctttttttttttaatagagacaggcttttgccatgttgtcctggctggtctcaaattcctgacctcaagtgatccacctgctttgg

SEQ ID NO: 120874 - DNA, 361 bp, Homo sapiens
agttttattatacacttctaataatgtgaagatgttttgtaattcagtagaaattgagtttctgtgtgtgtaggagggtcatgttatgaatgggcacatgtagacacacacgcagagggaggatccactcagtgtgttttgttaacaatgtttggttctgagccattgataatagttgcattggtatctaaaccctgatttgccacagtataacacaaagatgtgttggctgtgtacctttggctaaatggaatagaataaagttcatttggggatagaagggggaaatgattttaacttatcaagggaattgaatgctatgtattgcttgctttatttcctttttttttttaaataaaga

SEQ ID NO: 120875 - DNA, 320 bp, Homo sapiens
ctggatcataatggctctttaataacctgaaaatgttgacataaacccatggcttatggcattacctagagtcatttagatactgagctaattcaaaatttgttaggcaaatgtgtataccattatgataggatatttaagcccttagtaaataaaactgtacttatattttgcaaatataaatgtaacatcaagcagctatgcttagtcagttttctaattgggaaatatccgtgaattataaagcatgacttaaaatatttaatttgtaattagcgtagaattacaaagataattcataaactcactgtttacagatg

SEQ ID NO: 120876 - DNA, 293 bp, Homo sapiens
ggccaaggcagccaccactagcagggtcctcttacacaaaaacccttgatagtaacaatggtaggccgggcgcggtggctcacgcctgttatcccagcactttgggaggccgaggcgggcggatcacgaggtcaggagatcgagaccatcctggttaatatggtgaaaccccgtctctactaaaaatacaaaaaatcagcccggcatagtcctggctactcgggaggctgaggcagaagaatggcgttaacccgggaggtggaacttgcagtgagccgagatcgcccactgca

SEQ ID NO: 120877 - DNA, 420 bp, Homo sapiens
ctccagccccaggagccagggtttattgaccagaaaagacatatgagactgtggcccgcagccctgcttcctgatgcggggcagggtgagcggaggggtagggaggcaggcgggaagacccccaccctgagcgtctacaggggttcccatatcctctgctcagctcccccaggcccctgggagggagtcctccccactccacacctctggcctctgacttccacctgtacctgcctctttctctcagactgcgattacctgaaggggtccaggcagggtgggttcatggcctggtgcctccaagtgaaggccacaccacttcccagccctttgctcctggggcctggagcagatgtgtctgagtcagcttctctttgtagcctctgtcgggctgacagtgacttcaggaatgctctcctc

SEQ ID NO: 120878 - DNA, 305 bp, Homo sapiens
caatctactccatagggttgctgtgaggattaaatattatgaatatgaaaattctataaaaaatgttgagacattcaaatatcagggattgctgtcacatatctttcgccttcaaaaatgcttttgcggcatttttgttcactacttcaaaataagactctgaataagctaaaaataagtctgttaaaagtgcaaccaccactttgaaaagtataaatcaccacagaattgctgcctacacctgcccctgactcctccaggttctctaatgtctccacaagggcaaggattctcttacacctata

SEQ ID NO: 120879 - DNA, 278 bp, Homo sapiens
gggctgaaaaccttgtcattacccttaattcttcacttcctttcacttgccatatctgattcatcggaaaatcttccaccttcaaactagacaggcaaaaagcaaatgggaagaaaaaatggcatgagtgacaatacgaaccaagaccgtgagcatgacgtatgtagaagtcaaaaagaaacagacgccattgggaccaaaggccctatttggaaataataataaatgtttccacagggaataggttacattcataacatgaagataaggtaccaaag

SEQ ID NO: 120880 - DNA, 473 bp, Homo sapiens
ggatccgatgtataggaggggggagctgatctcaggggtcaggctgtatcaggtcgatgggtgataactgcaccttctctccaccatctttaatattggtgcacctgagggctcaggcttttgttctgttctcttctcttagaaaccctttgaactaggttttcaaaaccatggccctactgacattttgggtcagacaattctttatatgtggggctatcctgagcattgtaggatgttcagcagtatccctggtctctaatagcctctacctattagatgccactagtaattcattccccgattgtgacaaccaaaaatgtctccagacattgccagctgtcccctggggaaaaacaattgccttcagttgaaaaccactgacgtactctttgcaatcttggggatatcattcagagttacacctttaaatacatgaatacgatattgattaacatatttattttactaac

SEQ ID NO: 120881 - DNA, 295 bp, Homo sapiens
ggtgctcatgttttagagactaaatggaggaggagatgaggaaaagattgaaatctctcggttcaccagatggtgtagggcccagcattgtaaattcacacgttgactgtgcttgtgaattatctggggatgcaggtcctgattcagtaggcccaggttgggcatctctaacaaactcccacgtgatgctgatgctggtcctatgaactatactaaatagtaagaatctatggagccaggctgggcatggtggctcacacctatgatcccagcactttgggaggctgaggcaggc

SEQ ID NO: 120882 - DNA, 634 bp, Homo sapiens
tggggattacaaacatgagccacgatcacccagtgggtttctaggacttcttgactctgtgtctgtgttcttaaccaggggtcatcagctttggcccatgagccaaatctggcctactgtctgcttttgcaaataaagttttattggaacacagctgtcttagtctgcttgggttggtgtaacagaatatcatagactggatgtcttcaacaacaggcatttatttcttacagttttgaaagctaggcagtataagatcaaggtactggctgatttggttcctggtgagggtacactccttctggctgcagacagctgtgttctcacgtgtcatggagagagagctaggtttctggtttcttcttagaggacactaatcctgtcatgagggacctaccctcatgactgcatctaagcctgattatttctcaaaggcccagcctcctaataccatcacattgcaggcttaaggcttcaacatacaaattttagggggacacaaactttcagtctgtagcaacagctatgcccattcgtttatgtattacctgtggctgccttcctgctactgtgacctagcggagtagctgtaaaggagaccaaatgacccgcagagcctaaacatttagtatgt

SEQ ID NO: 120883 - DNA, 198 bp, Homo sapiens
caaagaacagagaagttattgtgcagtgacatgtaataatcaaacataaattgaccagaacaggaaagcccaggtttggaattaagcaaatctaactcttttgggttagtctaactctttttccatgaggcggtatgaagaaaacttagcaatccttccccaccactccccaaccctgttcccagaggaagcatgagc

SEQ ID NO: 120884 - DNA, 381 bp, Homo sapiens
atcatgagaaaaacaccagacaaatacaaattgacagacattctacaaaatgtcccattattactcctcaaaattgtcaaagtcatgaaaaagaccaaaaaactgtcaaagtccagaggacactaaggaaatgattccttagatgcaatgtagtatcatggactgcatcttggaccagaaaagggacattggtgaaaatctaaatactcttaagtttagttacaagcaacataccaaagctggtttcttagttttgacaaatgtcctatggcaatataagatgttattataaagggaactggatgaggggtatatagaactttctgtaaaatctgcaacttttctgtaagtctgaaattatttcaaaataaaactttaact

SEQ ID NO: 120885 - DNA, 235 bp, Homo sapiens
catttttacatctgtaaaacggaaatattcataataataaaacacctccataagaatcaaatgaaataaagtagaagtgctttgtaaaagataaacaattcaataactgtacaattcagtaactgcaaggaggtattatataagcatagatttttttttttaaaactaggagttgtcaacccaaatgtccatcaatgatagacaggataaagaaaacgtggcacatatatactgt

SEQ ID NO: 120886 - DNA, 682 bp, Homo sapiens
gaccgggaagggaaagaaattcttcaagaaaggatctacagagtattggcatatcatggaagctgcatttgtagaatcttcataggaattggttgggatgtaaaaatggtgaggcctaatcgttgttttttggtacttttttttttttttgagacggagtttcactcttgttgcccaggctagagtgcaatggcgcgatctcggctcactgcaacctctgcctgccaggttcaggtgattctcctgtctcagcctcccgagtagctgggattacaggtgcatgccaccacgcccggctaatttttgtatttttagtagagatggggtttcatcgtatggtcaggctgctctcaaactcctgatcttaggcgatccgcctgccttggcctcccaaagtgctggttggtccctcaaagtgctgggattacaggcgtgagccaccacgcccggcactgtactttttatttaatggatttcctcctggagtaacagcaacaccacacagcaacagcaaactaagtttggggccagaaccacaaattaacatcatttttcattgctaccatgtttaacatttaaaatgcttcactgaggcagttcttaatacatactatttttggataaaccaccaggcagataccaaaaaatattagcacactattctggtcatcttaagaaaaga

SEQ ID NO: 120887 - DNA, 391 bp, Homo sapiens
  misc_feature (110)..(110): n is a, c, g, or t
gctggaattaaagacacctgccattatgcctggctaatttttgtagagatggggcttcaccttgtttggccaggctgttcttgaactcctgactcaggtgatctggccanctcagcctcccaaagtgctgggattacaggcgtgagccaccacgcccggcactgtactttttatttaatggatttcctcctggagtaacagcaacaccacacagcaacagcaaactaagtttggggccagaaccacaaattaacatcatttttcattgctaccatgtttaacatttaaaatgcttcactgaggcagttcttaatacatactatttttggataaaccaccaggcagataccaaaaaatattagcacactattctggtcatcttaagaaaaga

SEQ ID NO: 120888 - DNA, 414 bp, Homo sapiens
gaaatctgtcttgaagcattaggtgtcccatttttgtgagttggaattgggacaggctaagtaggaagtgaggagggtggggagagctgtgctgtaggtctgtttgtcccttccttgatgtagccttcagttagccctttcagcttttttccccatcttgtgccgggccttcctgggtttcagtacttggatgtagggctgcagttatgtcagtggtgggtagattgaccaggaattaaggtctagggtccagcccatgtgagacttgactcactgatctacctttaggcatgtcttccttccagtctcatcctttttaaatttttttttttttttttgagacggtctcactctcacccaggctggattgcagtggtgtgatctcgaccaactgcaacctctgcctcccacccg

SEQ ID NO: 120889 - DNA, 165 bp, Homo sapiens
aaaagagttcaccccagactgtgcaaatgaagatcatgtaatgaaagaaccattctggatgctggggctcccagaaataccaagtgggggcccctcactcagctgaaggagcaaggggaggagatagtgttactggagactcagaagaggggcaggaaccgcagt

SEQ ID NO: 120890 - DNA, 217 bp, Homo sapiens
ataaataaataaataaataatctccccctctccccaaaaaaaacacctatggtgacaagttaatgagatagtatctaaggcttggacaagttgaaagccacttgtcccagatcgcataggcgcagttgggatcttcatgtagatcatatgaatggaaatctcctgagttttcctatgtagcacatggcccctctttctgtatggtaacaggaggcct

SEQ ID NO: 120891 - DNA, 327 bp, Homo sapiens
tatcagctcttttgtgatttgatttcacatggtctctgccttaaaaccattaaaagtcatgaaacttctgctatgcaatagcacttttatttgtcccaagatgtggttagaaatatactgggtagatcataaaatgcaaactcaggaaagctagctgggcatggtggctcatgcctgtaatcccagtactttgggaggccaaggcaggcagatagcttgaaaccaggagtttgagaccagcctggccaacatggcaaaaccccatctctactaaaaatacaaaaattagctgggtgtggtggtgcacacctgtaatctcagctactt

SEQ ID NO: 120892 - DNA, 229 bp, Homo sapiens
atagcctctggaggtatagcttgttcactgtacttacactcaggttaccttacactcaggtaacagaaaagcctgatggttccttttttattattcaaagccaaagctgatgattccatacagtgaaaaacacttgcaaaatatatagtaagaaaatgaacggatgtcacatttagattccagaagactttacgaaacatactgggaggtggggaaacgtggcgaaaag

SEQ ID NO: 120893 - DNA, 808 bp, Homo sapiens
acgcctcttaggggagttattagagctgagcgtgcctggtgtccctcaaggccaggttgggcgactctcgcagaggcccctcgacagatgtcagtcagaggctaggactctgccacatctttaaggacttggacacctctgggcaccgggctaagacggcgtcccaaagttaggtggcccgtcgcaggcagcccctagtagtctggcctcctcgcccgcacaacccttcacccacaggccaggtgcaatcccgatgcaggctcctggcccgaccctctacgcgctcaggcggacagctaaggtctggctgagtctccggcaggggcgtttggaatgtgaccggtcacccactctcggccctgcatttgcttgtgcatgcaagtccacaggtgtagaggcacccgaaccgtgtgcatcctcccggccacagcaccctaggcacgcacacgcatgcacatgcacgtgtgcacacggcgcggcatgctcacgcgctctcacgggcggactggtatccaggcgtggccgtgcgcacacacacgcacatgcatacagctactagcgtctactcgcgctcccccgtaggcacacacaaacagaactcgcactcgcgctcccgcccacacgttcctcgcagggtgccgggtggaatccgggctccctcaactttcccacccgagaaccccgcgcggagccgagggcagctctggggcggcgtccgacggggcctggcgaggggaccccgcgtcacttccccgggaggctgtgcctgagggctcctctgggttcgcagtcgcattggagttggggg

SEQ ID NO: 120894 - DNA, 430 bp, Homo sapiens
ctgagcaaaggctgtaggttgctactctgatggttgcagaaggcctgccttcaagggcttccaaacctcccaggtttcagcctgtatttgcccaggacctcaaaaacagttcatctcactgtgacccatccgtagcacactcattactactctgtcctttttctctcctttatctgttcactgtttcttaccctcctaagaattttcactgtgcctctccacctatcgtaaacatcatctctactagaccatcagctttctttccctctactttttgggtttgatttgaaatacatacagtttcttatcacaaaggatactggcctgactccgtcatccttccacacagctttctgagccaagtctgctcactgaggcacggccccaccatctccagccctcacctccacaatcgccatggggtcctgaa

SEQ ID NO: 120895 - DNA, 534 bp, Homo sapiens
ggagttcgagaccagtgcgtggccaacatggtgcaaccctgcctctactaaaaagaatttttcaactcctttataatcttgtgagactaccatcgtacatttagtctgttgttaactgaaatgtcattatggaatgcttgactggatactaatatgaaagtctattatttaaaaaatttaggattctcatactctaaaaagtcactatccatatttctacagtttgaacttaaattgaaagttaaagctctaccagtaggaaaacaccagctagtgacctgaccatttataaaatttggctccactcaaccgcctccatgattttaggttaccgtttatttcccatccatctgatcagtatctttatcagtttcttgctgatttttaattttctcactcatagtaattttatttacatagtatgcatttgaaatagaatgagaacaaagcactcccaattttctctagtgaccaaacatgataaaacacaaaccaggatctattaaagtaaatgagaactcgagactctgaatt

SEQ ID NO: 120896 - DNA, 602 bp, Homo sapiens
gaataaccaaaaacaagcctcgaaaagaacaagagtggaagactcacactttctgattttaaaacttactgcacagctacagtaatcaagacagtatggtactggcatgaagacatatagaccaacaatggaatagagagtccagaaacaaacctctgcatataataaggtcagtgattttcaacaagagagtcaggactatggagaaaaatggagaaaagaccattttttcaacaaataatattggaaaattagatgtcacatgcaaaagaatgaagttggacccttacctaacaccatatacaaaaagcaacccaaaatggattgaagacttcaatgtaagggctaagaccataaatctcttagaataaaacatagggcaaaaacaaaacattggatttgggagtgatttcttgggtagacaccaaaggcacagacagcaaaagaaagaagacaaattagacttcatgaaaatttaaaacttttgtgcctcaaagaacacaatcaacagagggaaaatatttcttgcctacaaaatgggaggatattttaaaataacatatctgttaagaagggatttatatccagcatatataggaaac

SEQ ID NO: 120897 - DNA, 225 bp, Homo sapiens
acactctggcaggagaggagatgctaagaaagtatacagctgtcgtatatcttgagctaaactgtctgctccttagaagaaaggtggcaattacaactgcaatgtgttttttaatccacctgtgtgcctgagaccgtgctcctaagaggtgcacatgcttgtgaaatggcctctccagggccctcctacccccatacattcctataccactgtaataattcagat

SEQ ID NO: 120898 - DNA, 557 bp, Homo sapiens
gcagtggggatggacatgaggaaagaaagctgcgaggtgtttctgaaactgaatcaacagcagccaagacacttatggaaatatgggagtgggtgaagagagatgactcaattaccaagtctaagggacatggaaagagcagaaacccctgctggaggagaaagtgactcagggtcagaggaggccgagtgaatacggaagacagtgtggctaccctggcaagtggctaggataggacccggagaatgttccaacccaaagccttgctccaagcacctctcaaaccttccccaactcatgatcacctcctcagaagctacttgataaggaaatacctgaaaagaacaggcaagcatagagccaatctacccttgagaagctccactggctacccaaagtgaccctccgtgaaggctgaggctgttgcagggttagagaaacgcccgctccaccttgaggtcccccagtaggggatatgaagagctaccttcctgccctgagcctgccactcactccccctgaaaccttaaaagatgatcctctctcactttgggagg

SEQ ID NO: 120899 - DNA, 622 bp, Homo sapiens
atggtcttgatctcctgacctcgtgatccgcccgcctcggcctcccaaagtgctgggattacaggcgtgagccaccgcgcccggccacttttgtctacttcttaggaaagaattaaaattgttcgctatacacttttggaaacagtcccaatggggaagaaaatgggtctggaaatcatgtttactactacttgtctaatattcttaaccactgaacttgcaagttatggtaacctttttttagaagtgtgttaagaggaacaaaaatttttctggtgcagcaattatcacctgcagatggcctaatattagcattgagttaactccagaaacagcctgtgagctgtgaaatggagttcagatagatagtgacaattcacagaaatgcctggtatattcatataaataaccaaatatcaagataccagctgatgcttacagataactctactaataacttagctaaaaatcctataaaaatttggtgttaaagaaaatttaatttgatctgaatataacgaagcctcttaactaatgcgtagaatattaacgatttgtatatacatactcatataaagaaggcttgaaattcaatttattgtgacttataatctgattagaa

SEQ ID NO: 120900 - DNA, 709 bp, Homo sapiens
actatttcactgttctgtattttaggtgttttaacttttcttttgagtaaccacagagtaacacatgcctttttgttcacaaatctttgtaatgtttttgagtacttccttcagacagatattctgaagtagatttacagttctcatgggttagtattatcaaattgttttccaaaatgactataacagtgtaatatacttattgtattatgtgtctcagtgcctctgtgtctcagtgcctcctttgaaaagtggggagaataatattgtctacgtcatggggttgacatgagtattacatgaattaatatatgtaaagcacttagaatcattttggcataatgtaaacactcaataaatattagctattgtttttactatttcactgcatcttctctggtttttaaagtattcttataagaaatcttaaatatacagacaaaagtaaaattactcatatagttatcatatgccatatttgttgtagatttttttctttaaaataaataaaattttatggtaaaatggagcttccccatctcccttgcccatctttcaacttatgccttatccagaggaaacaacttatggatagagtatttatcatttaggttttaataatttgactacacatttgtacatccataaacatagggaattgttttgttggatttaaaattttgtttgagtgatatcataatgtattatg

SEQ ID NO: 120901 - DNA, 261 bp, Homo sapiens
catcctgagaaggtgagggacatggggtcaagacctgattctggctgattgaggagcatctgtcttcacccctctcagattcctcctctacttcctcaccagcctcatgggatgagtatcaccaagatgcttttgaactctcaagatgcttttgaactgcctgggtgggccaggcagtggctcatgcctgtaatgcaagcactttgggaggccaaggtgggaggattgcttgaggtcaggagttcgagaccagactgggca

SEQ ID NO: 120902 - DNA, 531 bp, Homo sapiens
agaagaaaggcagaaaaacgaatattcagttttctagctttagcaatgtgttaatttcaagttagaacagtttgtatttttttttctttctcttgagtaatcatgggcaatacagtatgaaatgtatcatagatgtttaatgaaaaagtgctgggattacaggcgtgagccactgcgcctggcccaagctctttgttatgtatgatatagtgatgtttaacaaaatcagaaagaaactacaatcaggttgaattaagtaaaaaatttgctgtttttaatatactgcataggagcccctatttaacattgacagagtgtaagtcaaagatagacgaatgtgaccttccccaatttctaatataattgttacattaaataatattagtaatatgttttatagaaatgatgtcatatgatactacgttatattatcagattatgagaaattttgttccaattatttttcttagcacagggtagatatattgttatcttgagtcttattttcatgtaatatttttcctctttttt

SEQ ID NO: 120903 - DNA, 201 bp, Homo sapiens
tctacgtggcactgtgtctagtcctggaggtcctgaaagaaatcgtccatgtccccagccctcatatggttgatcatttccttggtaatttctgatatggttatgctctgtcagaagaggaataggtcctctcctctttcccagttggatgcaagggaaagcctcagaatgccatcttgtggccaggcgtggtggctcatg

SEQ ID NO: 120904 - DNA, 596 bp, Homo sapiens
ggctggcggatcactcgcggttaggagctggagagccagcccggccaacacagcgaatccccgtctccaccaaaaaaatacgaaaaccagtcaggcgtggcggcgcgcgcctgcaatcgcaggcactcggctagctgaggcaggagaatcaggcagggaggttgcagtgagccgagatggcagcagtaccgtccagctttggctcggcatcagagggagaccgtggaaagagagggagaggagggagaccgtggggagagggagagggagagtcatttgcagcttttaaaagccataattttgaaagacttgacattaaaaactcagaagtgttattgtgcaatttacgcataggctattgatcttttcatcagattatgaatacttttcagatacctgtctgttgaaggtctgtgtaggtgcttctcttaatagaggtaatattggctagtttttagaaatttaacttcaacctcaatctcaaatatttaatactgtttttcttccagtttgttgttgtgtttcttgagcatggtgtttcaaaactagtttttttcctaaatcagtgtcctaatgaatctaaaagttttagatca

SEQ ID NO: 120905 - DNA, 183 bp, Homo sapiens
aaaaaaactgactcgccttacacattgaggtagtactatgaggatccaaatgaggctaaaatgcttaaaaagccacaaagtactagatgaacttatgtcattatgaatgtggtactcatattgattttcttgtattatatgtgaagtgtgctccagtatctccacctaattatgtttggactg

SEQ ID NO: 120906 - DNA, 393 bp, Homo sapiens
gggaattaggagaataatcctgaatcccctaaaccatactcaattctggggtacagaatcatttagaaagccacagaaattaagtaactaggaaatttccaagttgttagtataactggtgagacctcaattcattcacatttactgggtgacttttcctcaaggagctcacatttagtaagggtttcgtattttcctcatacttccttcctatatattattaagtccataacctcaagtaccaacaaagatgggaaatagtcaagaaaattatccggtacaagggttggtaaatcaggtgctatgtacaaaagtaaaaaaacaaacaaaaaaaccaaccatgagctacccaataaggcaccagagaacacaaggttgaacatattcagtgca

SEQ ID NO: 120907 - DNA, 315 bp, Homo sapiens
ggtgtctttgggcctgaatgtttgagcctccctacaggagatggctagagcctagccctcatgctctggaagttagttctggtaaaagctttgcagttggcgctgtggatgccctgtgctacttaacagtggttcctcctttagaacttggaagacacgtgccaatagggaggaaggttctctgctaagatgcatttatttgtgaacacctctcacagtgtttttttcaaggatatacctgtggagggaatttcccatttcagttttgggggaaacctggtgagttgcttctcagatgtttaggtcacacactga

SEQ ID NO: 120908 - DNA, 139 bp, Homo sapiens
aggtccagagacccccgttacagggaaattcctctcatccccttttcctctaactggcttcactccttcctgttacttgcactcttagcacctagtaacaccagcagccagaccttagcaggcgtgcagctgccgttag

SEQ ID NO: 120909 - DNA, 1242 bp, Homo sapiens
aaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactccggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttccca

SEQ ID NO: 120910 - DNA, 171 bp, Homo sapiens
taggtaaacaaatcaaaacctaagttaggagtataactgttagctggggttcacccaatcacaagcagccagctcatcacaccatgcccaaataaggcaaatgcctagctgtagccaatcaggtgatttttcttcttctgtgtctggcacataaaggcttgctgtgcacac

SEQ ID NO: 120911 - DNA, 802 bp, Homo sapiens
ctcttggccagcagttggaagggatcccagggacgggctcagctactcagggcagcagccaggcatcggtgcagaggaaagccaacagatttttctttaaaaatgtgaaactagcagtataaaccagtgttttgaagtacaaaggtaaatagcagaagatatcagtgaacgcatgtaaagtggctgtcttgtgggagaggaaactgaagacatagtggagactattgtttttgttttgcaacgtttggggctgactttccagaattacccaagattgacctgtgggagatatctgggccccctgtgccttgcaaagcttcacatgggtgatgatgttgaagaccaggtgcggatcaatgggggctccatggcaaatgagaaacagaggaagaagaactaaccttcctacccaccagtgctcactggcactcaacatagccttgctcttgtttctggaggaagggccattgggatcaacttaagaacatggcagaacagagatgcttgctgaattagttggttggaagcacaaaattattttagtagttgttgcaaattgcttcacttctctgggtttaagtgtagaactcaatggtaatgtgaatagacttgatctccataggatcattgtggggactcaatgagatagattctgtagagctttgggcttgattggtgcacagtgttcaatgagtgtgctgggagaaactcttctcctcacttctggtgtttccttccaggaggagagaggtccctctgggtagcacccctggcctctctgtctgctccctgggttctgcct

SEQ ID NO: 120912 - DNA, 400 bp, Homo sapiens
gaggacatctccacttgaccccctaaggacaaggttgacaggacacaccgcctgtcatcattcttgcactggacacatctacagggcttccctgcaccgacctctgaggcaacatcctatcacacagccaacttgacctcactactacataccacagtgcctataagtcaacactgtctcaacaccacggggtccacaagcacgtttctgctaagtgaactgcaagccgtagaactaccaaccttttcagctttcctaagccaactgtgtgcccttcagcgtgacatgcctgtcctggccgtgctgagacttcaaaccagttaagggagctgaaatgcttcaccacgcctagggcatagcggaatccaacactggaacactgtcaacacgcagagtcatc

SEQ ID NO: 120913 - DNA, 533 bp, Homo sapiens
  misc_feature (49)..(49): n is a, c, g, or t
  misc_feature (90)..(91): n is a, c, g, or t
  misc_feature (95)..(95): n is a, c, g, or t
  misc_feature (106)..(106): n is a, c, g, or t
  misc_feature (129)..(129): n is a, c, g, or t
cgcaatcggctcggtccgagggacagcatccttggcctgcagtctctanagtagcgggactacggcgggtacatcaggcccagacaggtnnaganaaaaattcttngtaaatatgtggtctgctgtgtngcccatacgggtcttgaactcctagcctcaagtgatcctcccaccctgacctcccaaagtgctgggattacaggcgtgagccaccgcgcccggcaatatgtaaccctttcaaaatgaaaacaccactcttagctcatgggctgtaaaaaataacaacaaaacaggcgcctgctcatactttgcttgtagactatagtttgctggtctttgttctatagttatttccactagagaggaagagattcagagatctaatgagattctaggtttttcttttttgtttgtttgtgtttttttttttttttgatcattcttgggtgtttctcctcgcagttagggggttagggcgtgggggaacccctcttagagttcgccctgtgcgggctttgcaacctttggcacgt

SEQ ID NO: 120914 - DNA, 332 bp, Homo sapiens
tcagcctccctattacttttccctgcaccaccacaaatgccattagcccaggcctcctgggataagttttcccaaatggttttccccagtacattgcttcccagatcacagcttgactcagcattttctcctctgctgcttcggattcttgaaaacccctcacctcaggattgatgtcctggggtatatgtgggagggggtggagaataaggggggttggttatggagggcaaggtggagcaagtggggggtaagagaaactgtgagcatccccctgacaccatgagctctaccccaacctcagtggctcatacttggtgacctgggggtcc

SEQ ID NO: 120915 - DNA, 429 bp, Homo sapiens
gaacaaaggaacatctgatgttagagagcagctgcaggtcctcttggcccatctcaaagcttgtaagttatccttcaagttgacatttaagattttgaagatcacatttgtttttgttttgttcaagctctctctttaaccatggcctgggatgacttttaagcttttaagaggctcaaccagtggtcaacttctcttgagatggcccagagcgggggtcagtgaattcctcactcttggcagcatctatttctccaactctctccacattttttggtttgttttttgtttcattatgaggttctaaaactgcacagtcaagatgctgtggggggaggaagtaagtgcctgttcttggaacctgtgcagcgttatgctagcactggccaagacttatcagactatggttattaataggtgttatgggtt

SEQ ID NO: 120916 - DNA, 838 bp, Homo sapiens
gcagcctgccaccatcttggaagtggctcaccaccgtcttgggagttctgtgaacaaggacccctggtaacattttggcgaccacgaagggacatccaaagctatatgaagaatagagccaatattacaacaaataaccttcatgcctgcaaaaactttttcagcttaactaatgcttgtgatgtttaacgcctgtcttttcaacttggtctactgagtcttcaatactggtgactgagctgcttgaagtgaactctggacaaggtggagagcatcttcttgatttaagatatcttgcagtaagggaagctctgtcctgagaagcctttacagaggcacaggaagaggccaggacctgaagcctccccctcccccaagagtcacataagtgagcttggaagaggaacttcagcaccaactggcaatgtaactagtgctgcgtgaaagaccctgaaccagaaccacctaaataagccccttccagatacctgagccttagaaactatgtaatataataaagacttgtttgggggcaatttataacccagaactggataaccaatacagttatgtttttaacaaacagctggctggggtgaagagtgcaggttgaaacaacaaaaataattttccccgtagaaatgtacctcacccatatgaaaaattatacttgcaatcagattctcagcagcagtgctttaaagtacatttgtatttatttttaattgacaaattaaaaattatatatgtttatggtgtaaaacatgatgctttgatataggtataaaccgtggaatggctaaattaagctaattagcatatgcattgtatcatatag

SEQ ID NO: 120917 - DNA, 956 bp, Homo sapiens
ggaaggccgaggtgggaggatcacctgaggtcaggagtttcagacaggcttggtcaaaatggcgaaaccccatctctactaaatatacaaaaattagctgggcgtggtggcgggcgcctgtagtcccagctacctgagaggctgaggcaggagaatcgctggaacccaggaagtggaagctgcagtgagccaagattgtgccactgcacttgaggctgggccacagcgagactgtgtctaaaaaataataataataaaaactggcccacaaacttcctggagaattgaccgtgggctctcctgagtgaataggagctacttccctgctttcgttgcctgaggtttagaggtgggaggcccccatgatagggaaaacagccaccagggaggccgaacagctgatacgggatcaaggcccggggtacatcaaagggcttttccttcctctcaggctaaattaccatcacgtcagtagctccatcacttgcataagcggagggtaaggttactcaagcccagccatcgatccctttcaggctgaacctgtgtcctcatcatccaaagtccccatgcttgcatacgtctcccacccttcagtttggagcactgactttcatcgttggcaagggcaatggggagttctctttggcctctgatttgctgaattgccttcaatacatggcttaacctctctgaacccccatccccatttccgagtcttaggaagaactgtggcagggcgcggtggctcatgcctgtaatcccagatctttgggaggctgaagtgggctgaagtgggaggatcacttgaggtcaggagttcgagaccagcctggccaacatggtgaaaccccgtctgtactaaaaatacaaaaattagccgggcatggtggtgcacgcctgtaagcccagctacaagggaggctgaggcaggagaattgcttgaacccaggagg

SEQ ID NO: 120918 - DNA, 255 bp, Homo sapiens
ggaaaatcaccaccatcaatgagaaacatctgccttgactgttatttgagcaagaaataatttattgtttcagtcactctgcggttcaagttccatttgtgtcagcagctgtacacctaagagtcactaaaaacagttttatgttaattgttggaagaggacctgtacatgagaacatgtatataatatttaattgcattttgtaaattaaagaaaccaaataaactgctaaaaactccttctttggagatctct

SEQ ID NO: 120919 - DNA, 151 bp, Homo sapiens
ctgggaaattccaatgtccagccacagttgagaaccactaatctaaatcacccaacacaaaaaaaggaaaagaaaccccctaccatttccataccagttatactcaactcaccaaaaagttatagaaaatgctcaacagaggggctgaaaa

SEQ ID NO: 120920 - DNA, 309 bp, Homo sapiens
actctttgattcatgcctttattcctgaaacaggatttgttttgacttcctgattacaatcagggcatatgtatacacagatgggaagagaaccgtggaaagagtaaaacctcaggcacgtgctggggtgggagttccactcctgaggtcagaggagctggaagaggatctccagctgaggcagtctctggataggaaatgaagagctcaggaggaagtgcttgcttgggaaccatctaacagaggaggaagaagaaattcacatatttcctattaaaaagagattgttttggttcaagatcattgctt

SEQ ID NO: 120921 - DNA, 336 bp, Homo sapiens
gcacgagataaagcaagacatgtttgtgcaagtattggaatattttattccattttatccttactttctttaagttattgaaaaatgtaaaaaggaaagtactgatacccacaatgaaaatgtgtaagtatcagactccttaaaaaaaaacaaacaaacaactttttattatgaaaaattgcagcagcctgggcacatggcgaaactccatctctacaaaaaatgcacagattagctgggcgtagtggcacgtgcctgtagtactcagaatgctgaggtgggaggattgcgtgagcctgggaggttgaggctgacagagtgagaccctgtctaaaa

SEQ ID NO: 120922 - DNA, 828 bp, Homo sapiens
ggctaagagtagtggctgtagtagcggcaggtccacactttgacaacaggtgagcgggacagccacggctgctcccagaccctcgcctcccagcccagaaatctcccctgcattgggctgcctctcattccctccccaccctcatcctgtgaagtgtccagccactgtcctggccctgtgtgggggtcagcaggatttcttatgaccctgtgcccacccagggagctggcctcaaccatttagctttgactgaagtgggtagcgggacgcctgctgggctggggagttgggaagcttcgttaatcatgctttcagagcactttgcgatgcagagatgaaagaagtctgaggagagcaaagtacagccattacaatctccatcttcctaattgaggaaaatgaggttatttccaaatcctctgtgatgcgatgggaaatgtgcttgataggccctcacttacagctctcccctaccacggctgctcagagctgaggtagccagggtgctatgtgtgcagagcacccaggttacagccccgccacccagacatgccccagctgccctgcgtcactcctgatgcatcagccccaagaagggcaacctcgacaaaacatcaaagttgggcacctttgagcggcatggaagttctcctcctctgcactgagtaattggaacaaaacgacccaggcagtcttgctgtaacatcaaagctgcatataataacctcacagatgaatttaagagtgaatacattcacagccactgctcaagtttgaagtatgctgcaatgtttttcagcttcagaaccaagcaagaagaagaagaag

SEQ ID NO: 120923 - DNA, 490 bp, Homo sapiens
ggcaattcacaaaaggaaacataaaaatggccttaaaaattgctaaaataaatatttaagcaaaaaagctcaacttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatggg

SEQ ID NO: 120924 - DNA, 278 bp, Homo sapiens
agggccacaggtacacaaggagcctccgcaaggccttgtcctggcaagtcgtgtttcatggaaagttttcttgagaaagctaaatctgaggattctgggacatgagtgttactcatggccagcgtcatcatacggagcctgggagcaaattgttttttcaagaggtgtatgtaggctattgaattttgactagaaatggctttagtggtcaacattaattttgctttatatccagcagcatttcttatttttatcagggatataagtgaaggaaaaat

SEQ ID NO: 120925 - DNA, 785 bp, Homo sapiens
aacggccgggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaagtactacaatgattcaaaacaaagctatgctgtctatcgattcaaaattttaataaatccctctgatgttgttgaattagatgctgagcttggaaatcacattttacaccaacctttaaaagctgctgaagtctttcaatcagtctgttttattgctgttaagactctctcattaattggacaattgcagactgaaacgcaaattaatatagtgctgaaattaacacatttacctcccctgccaagttatggtcttgatctttgtgagtttccacttgattatacatctcagagattttatatgatgcaaggaattgtgattgcaatgacaactataaccaagtatacacaaggggcaagatttctttgttcagatgaagcatgccctctttcaaaaggatttcagtatataagagtgcatgtgcctggtgctacagaatctgcaacgataagaaatgactttttgtgtaatctatgtgcatcttcacttcaagaagacagaaaatttagagtacttggtggta

SEQ ID NO: 120926 - DNA, 280 bp, Homo sapiens
cagaaacgaggactgttctgcacatatgcatcaggacgcataatggggctttgttcgggcctgggcagacatggagggcaatgcctgagctctcttccagtttatctccacgtcctccaagctcaaatctggcagccctggagtggtttgaagttgaaactccacagagcagtggacttaatgctccaaagatgcgttgacattcagccattgtccctggcccccaagtgtccgtgggagttgctgagttttcatggagatgatccacgtccctgggtgt

SEQ ID NO: 120927 - DNA, 241 bp, Homo sapiens
ctgcccaaggaggatgccccacaaccacttggagggagatgctttgctgagagtccctgtcctctgcatctggagagcttggctcagagctgaggtgggagggagggctcctcttccaggtcgctcagttggacaccggaattgaccagcctgcaggctcacccatggagtacacactgtgtcctagtcaagcctgaggggcagtatccagcctcaacccccagcagaggctccagacaaa

SEQ ID NO: 120928 - DNA, 772 bp, Homo sapiens
atttcacacatgttgtccaaattcgagtgctggaggaattagcacatcctttgtggctctcccagaagaggactcttagaagcttgtgcctggtttcttacagactttgcctcatgtaccttttctctttactgatttttactttttaggtttgttgcagtaatatatcatcactatgagtacagctgtatactgagtcctatagtcctagcaaatcaccaagcctggaggcagtcttgggacccatggcacagcactatccttagaagctagttttgtcagtttcactttccatcttctatacctttgctgacatggtttcctagccccataccacctgttgccccatagcctattgagtaacttttcagtgcttggccaggatgaaaccttgctcaagatgatccctgatttccttattgttcctggctggaaatggctctggaatatcttgactttgattatctgaattattcagtttgattaatttatggcattaatcgaccttatattatagttgtgtatgcacatcacctcttctatttcattttaagctatttgaatgtgtagaattgttttattgtttttgtgccacccagagctgcttggtttctgaatggcttatgcctttgagttcagtgaaagtgcatataccacattaagtggtttttgataagaatgccattaaaatagatgtgactttgtaatttccgtctgacctcaggagctatacaaaaacttagaatatctgaggggaagtgttgaaaatata

SEQ ID NO: 120929 - DNA, 188 bp, Homo sapiens
atatcacctccctaactcattgagccataccggagtccctggaccatgggacagatagattgtgcactctctgtctttgaaattctctcctccctttacttcccacctctctgatctagtttctgccatgttctcttcctacctaataattcctcctcagtccccttcactgcggcactttctcccag

SEQ ID NO: 120930 - DNA, 735 bp, Homo sapiens
caaaaaagtttaatgtttatgagatttgttatggctgtccactgccttcacagtgcagaagcatggcaactgacatcatcaggcctcttcatattcctgctctgtgcattacatcatgatgctgctgagttggcaatgtcagcaggcagtgtcaaaagtctgagcattcctagaaaccattcctacaccaggagggctaacaacaactcacctatctgtatacatgactttaaccccataattatatctctaatacactttctcctagccagatgatgaaaattctcaaggccatttcattgtcaattgacatgagaactatgatagagagaagttggaatggaaaagtgagtgcccctaatgaattaaggataaaatatatttttccaaattttacataaacatacgtttatatgaacacattactaggatctctcccagggtcttggaaggggcctatgcatgtgatacgctatgaaattatgctacattggtttcatggtaaatctatctgtgacattgcctatgaagccacccacaccagcaaaatctgcagtgtttattacaaatttagctcaaacccagattatgaattcctctctcaggcaaaaaagaatagtttttggaagcctaatcatccttcaagagctagaaaagtgaaaataaatataaaaataatttgcatatcagatcacagaaccattgaagcaaaaaaccaaaaaagttcttattcca

SEQ ID NO: 120931 - DNA, 717 bp, Homo sapiens
gcagattcttgagccatatttcaggcctattcaatcagaaactgaatttggggctttgcaacccgtatgttagtaagtcctccaggcgattctgatgcacgcttgagttcgagagccattgtactgcatcagtctccctgcagttcctcagatctatcttgttttcccttgcccctatatttttctcctgtctggaatgattgttatccattttttcttcctcataaattagctcttcaaccttgcagacttagtttagtcaagtttctttctgtttcttcctccttatcacccaccctgctcccaggctgacttcaagacctgtcttaatctccatgctgcatatgtccgtacacacttgcatcatagaccattttacatagtacttttttagcctgtctcctattagtgaatttaggttcttgtttttcgtctttgtatttccatctatctggcagtatctgattgttttgtttatttttaatttttttaattaaaaaatttttaactgttttgtttgggttgtttcatatgtattaagcatcttccaggggccggcacagtgattaggagtgacagagtaggtaaagcagacatcgtctctgtaataaatacacatggtgataagtgctctgatgaagtaaaatagagcactgtggaaacacagaggagggggtggaaaaagtcagggaagtctgttcagaggaagtcacatgt

SEQ ID NO: 120932 - DNA, 183 bp, Homo sapiens
gaatgaaggtttcatgtttgagttgtttaactgtttaaattgcagagtccagaatgtactggatggtcagtatttattggtggaatgaaggagtaaacttcctggccaaaggttatagcttattaagtgatgagctagaactttttgatcataattgagagagggtatcctaccatgatagaa

SEQ ID NO: 120933 - DNA, 310 bp, Homo sapiens
aaggctgaaacgtgcatgtatataccagcctctctgggcacactctctctgcatggtagccagagcaggttctggctgctcttcaggctaatcgtctggcacctggactctggccacaacatcctctgatgtgcagaatccacttgaacatctgcaaaaaacttcaaggggaggagttgttttttgtttttttttttttgtttgttttgtttttttgccactttacgaattggccacatgataggttgaggtgagccgaggacacaaaccttacacaggtaggcagcactaagctaaaatggattaaaaa

SEQ ID NO: 120934 - DNA, 464 bp, Homo sapiens
cacagaatatcagaactgaaaagtacctaggaagttattgcacttgacaccatcattttacaaataaggaaaatgacatcaagttagataatagaattcttcagaactagagctttgagattttgactgtaagttcgttttcaagtttaacatttggtaagggcataagagaaggaatgcaaacattcatataacaaaacagtttggcaaatcatcagggggaaaatccatatcctaagacttgccatggatctaaatgactgttcatttagctctatgttctttttttttctagaggaagtctcactctgtcgcccaggctggagtgcagtggcacatctcagctttgcaatctctgcctcccgggttcaagcgattctgctgcctcagcctcctgagtaggtgggattacaggtgcacgccacaaaacccagctaatttttttgtatttttagtagagacgg

SEQ ID NO: 120935 - DNA, 207 bp, Homo sapiens
gtagatgttaaatcagttcaacttttctattaagtggaaaaacctcttacatggattcaaagagtaaaatctaattgctgcttctttgagacacctaaaacacagtaatacacaaacggatgaacaaaagtatcctacacaaatgtaagtaaaaggtaggtcagaaactcgatacaggttttaggggtaaaaaaaagattgaattaa

SEQ ID NO: 120936 - DNA, 342 bp, Homo sapiens
acgtttgccaccctgcgaccccgcccagctgttgtttttccactttcgtaagcaggctctttactgattttttatgtatttcattttagttgattttcatgtcttcccctcctgtccatcccatataacagtatctgccaaaaaagcctactccttttatgcttttttctcttatttaattgcactaatacgacatttaatatcagtaatagttgatagtagaatttgtcttgtcctttaataggaatgcaaagtgttgtgctattatgatgtatgcagctattcctacttttactaaggatttttttttttttttgagacggagtctcgctccgtcgccca

SEQ ID NO: 120937 - DNA, 337 bp, Homo sapiens
gacatgcaggtgactgttgcttgaaattgctaaatgacaaaaataatagctcatttttggcaaatgagctgaaagtatcttgacaatttttctgattaggcttagattttattcataaaaggacaaaacaactacttgaagtgaaaacttcagatgacttcatcttgtttcatgtaactgaccatttgttaggcacagtcataattttgggaataagaaccatcatatgacagataaaggtcataggagttcttcaacaaaacagtacacagccccttcaggtgtcctgaactgagctacatatgactctggacaccgggcaggtccatctggaaac

SEQ ID NO: 120938 - DNA, 166 bp, Homo sapiens
gtactgttttctcttccaactgcttccctttgcctgcaagaggaactcagataagatggatgttttgcttgacctgtttgatatcctgaactttctgtagctcttatttttcttcaatctgttcattataaatttagcttggcgtttctgtttgatctcttcaact

SEQ ID NO: 120939 - DNA, 781 bp, Homo sapiens
ccagcctggagtgcagtggtgcaatctcggctcactgccacctccgcctcccagtagctctcccacctcagcctctcgagtgagctgggattacaggcgtgcaccaccatgcccagctaatttttgtatttttagtagaaacggtttcaccatgtttgccaggctggtctacgaactcttgacctcaggtgatccgcccgcctcggcctcctgaagtgctggaattacaggcatgagccaccacgcctggctggatataccccgtttcgtttctcctttcatctgtccgcagacacccgcgttgtttccaccttttggctgttgtaaactgatttgtttttagagcaaggtattcatacctgagcaacaaggggtctctgggtggcgggaaatgcttgaagggaggagagccagggggtctgtggagaaatcctgtaatgggggaagtggcttggaggaagcagagcacacagggctgaagatggctgggccaggaggggacaggcccagtcccacctggtgaagctgggtttgtttcctggctgggggctggggggccagtcagcagaggggtggccctgttagaggacagagtcagagccctcttggtagacacggccgttcagagctggagacaagacgagcgaaccagaggggaatcatgagccagagtcatgattccgcacacaggggtgggaagcaacttccctagacctgggacggaaaggcgggctgttgggaatggctgtgggagagaaccaggggcagtgaccaggaggag

SEQ ID NO: 120940 - DNA, 543 bp, Homo sapiens
gcacgagattgcactataatataaacactgccagtattttatgtgaatggggaaattcttgatttttttgaaaaataattatacctaacagccaaaaactagaatcatcccaggtgttcatcaacaggaggatggatacaccacagtgatatgtgcacacaattgaatactattaacattcggcaataaagaggaatgaattattgacagtcgcaacaacatggatgaatctcaaaaattttaagttgaatgaaaagatgccagttcaggcacaatggctcacgcctgtaatctgaacactttaggaggccaaggcagatggatcacaaggtcaagatatcaagaccatcctggccaacgtggtgaaaccctgtctctatgaaaaatacaaaaattagctgggcatggtggcatgcagctgtagtcccagctactcgggaggctgaggcaggagaatcacttgaacccaggaggcggaggttgcagtgagccgagataatgccactgcactccagcctggtgacagagtgagcctctgtctca

SEQ ID NO: 120941 - DNA, 267 bp, Homo sapiens
ccgggaccgagggccacccggagcgcagaggcggcaccacccacacggatcccgtgggcacctagaactccgcggagggcgcgacggagctcccgctcggcctcgcgccccggcaggccccgtccgggtgctggagtgagactctcgcgctggcctctggagcgcggggtgggcgtcccgtcaccctgcgcccagcttccccggcccgttcccgcagggccggcctcccggcgccatgcccggcctgtactgcccctccagctggac

SEQ ID NO: 120942 - DNA, 196 bp, Homo sapiens
tctccaagctgtgtacagagaaccatgcaagtcgccccaaccagggaaaaacaactgccatttcttttaaaggggaaccaatgaaggtcttgtcctgatgagctcacaaaagcaaacttctccatgtctgtcgctcactcagtgggctgaagcagagccttcacgctaagctttggagacaaagcttcttagagaa

SEQ ID NO: 120943 - DNA, 354 bp, Homo sapiens
ttcagtggagtaagggatagctaaaacgaccagaggagtgaggagcaaggggttggatcctgaggaggaactgcaagagtgagaaggattaagacaagaaaaaggacagagactgggtcccattctctcactttctccagtgcctagcatagggctttgcacaatataaagactcatgagtgaatcagcaaaaaagcatatctgttgaaattatatgttcactttacaaagcattacaaaatgtgaattatcagggaaggactccttttccctcatgatgatcacaatttaaaggaaccaaaattagagtagttacatcaataaagaaacctacagataacatacacacacaca

SEQ ID NO: 120944 - DNA, 397 bp, Homo sapiens
gaagaaagatgatcacacaatttctatgagtggagcttgccctgggcctgctggacagtcaacagccagttctggacagtcaatggccagcgtgaaagagaacacaggcttggaaaatagcagtcccagcaaagaacaagagaaggtagaggctgccaggtaggcattttgttcttcacaaatttgtgcagagctggctctgggagtggaagccaggttccattacagactcatggacaactaactgacagatgctggaatggactggatgactagtgggggtcaaagggccagtatgccccataaattattttacaatgtcttgaattcacccatgaatttatttattcaacaaatatgtattaagtgttggctctgggccagcctgtataaatac

SEQ ID NO: 120945 - DNA, 776 bp, Homo sapiens
agcggggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggagacccctgtagacatagtaaattcttggactcagactatgactaatttggcaaaacaggttcatggaggttcttaactgatagtatagtctgggtggcattgaagttgcttccagataccttgatatactcattcctactgattatacttaa

SEQ ID NO: 120946 - DNA, 1138 bp, Homo sapiens
tcctcttcccagccctctgagctggaagcgtcagctcatgggatgaatggcgccccggcatggatgaaagccacttgccccagctccctccaggagtgtgcatggcagagctggggctgccacgtgaacccaggcctcaggaccctggcacagcccctgcacccacacttgccatttctccgcacccctccctggactccgccaggttagggtctcccaggccctggcacccagttcaggcctggagacacctcctctccttcctgcagggtgactccgacagcccttgcctgccaggatggagcctggactctggagggcatcgtgtcctggagcagcaccagcacctcctgttgtcaccaggcgtggatgcccgcatcatgaaattcatgcctgggaaggcgtggaggccgagaccaccccccctaccccgcatctgtgtaaaacacaaataaagccattgagagcaactgcaaaaaaacaacataataatctacacttcatctacaaatatctctaacatcttttcatcaatctacgtctacatatccaaataactaaccaaccatcacatagctcgaatgattaaccaacgatcagcaccaaacaagaagccgaggcggcgcgctatccctataaaaattatctccacggtaggcagcagcacattatatagtcaatagtcagacacccaccattctttttcagagacaaacgagtgccgccaaataagacgcggatgatcatcaatataaccaaccagcaagcgccacccggcgcgcgctttatacaacaacaccagtcccggctagtggttgcgacaacaacaccctcgctcctcaggtccgagaagttactcttcgaagcggcgagcccctcactacttgctggtggtgtgcacgacacaaacatctgagtagagacgacgacaaccacaactcccccaggcacgagaacctaaatggcaagacacctacgtggacgtcgaaataactactaattatcgaatcggacattatcttaaaagctgatcaatgacacaacactagctgaaatctaaagtaacgtctgagtcgaaaaaaaatataggtgttaccacgaacgagaaatattctacgcgaacagaaaactttacgcg

SEQ ID NO: 120947 - DNA, 1308 bp, Homo sapiens
gggggaccctgggtggtgggcaggctagagttggggggaagtttaaaacaatttttattaatatataaatagagacttgggtctcactatgcggcccgactggccttgaagtttggcctcaagtgatcctcctgcctcagcctcccaaagtgctaggattacacagccctcgcccctcgggtcccttctgcccttgtgggagttgccagtcctcctatcctcccagtacaaagctggcttccacttctgcgggggctaccacatcagcgaggactgggtggtcaccgctgcccaccaggggtcaggaaaagggtcggaaatgaactgcaggctggggaaccagcacccccatcccccggccacaggcagagccgcctctgcaggagacacccaccccaggccgtgcaccccacctccaccctcgcaggccacccagacggcagcttggggaaacctgggaggtcccgtaccctcactgtgcaggcacccccatgagcccaggcaccgcctgccaccctcactctccaggaagagccaccgcgtggtggccgggatcgtgtggtggccagggcgtctgaccttggctctcacccggaggccatccaggtgctgaggatggctaacgctaaggccacacagccagggagaggaggtggctcgtgacaccacgatgggacacacccacctctgggagaggagggtgactccgacagcccttgcctgccaggatggagcctggactctggagggcatcgtgtcctggagcagcaccagcacctcctgttgtcaccaggcgtggatgcccgcatcatgaaattcatgcctgggaaggcgtggaggccgagaccaccccccctaccccgcatctgtgtaaaacacaaataaagccattgagagcaactgcatacacctttacctctgtgtcctcaccaaggcaggtgggctgagcatgatgtggctgaggtggggggacagatgctgtcacggggacaacctctgtagaggtaagatcaggagggcttgcgaatcacccagccctactcccttcttcatacagatggggaaaccaaggcccatgttcatatgcagaacggtcagggctgggagcagcaccaggggttccaagcaccctgaagcttccatctgggctgcgggctgctgggtgggggagccacgaagggggacacacttgcccagggcaagggtcttctccaagcccctccctcccaactcagaggccaggtccaggtataattccatgtgcacttcgggagttccgcaggctgggatgagattcttttaagcaga

SEQ ID NO: 120948 - DNA, 1568 bp, Homo sapiens
gggggaccctgggtggtgggcaggctagagttggggggaagtttaaaacaatttttattaatatataaatagagacttgggtctcactatgcggcccgactggccttgaagtttggcctcaagtgatcctcctgcctcagcctcccaaagtgctaggattacacagccctcgcccctcgggtcccttctgcccttgtgggagttgccagtcctcctatcctcccagtacaaagctggcttccacttctgcgggggctaccacatcagcgaggactgggtggtcaccgctgcccaccaggggtcaggaaaagggtcggaaatgaactgcaggctggggaaccagcacccccatcccccggccacaggcagagccgcctctgcaggagacacccaccccaggccgtgcaccccacctccaccctcgcaggccacccagacggcagcttggggaaacctgggaggtcccgtaccctcactgtgcaggcacccccatgagcccaggcaccgcctgccaccctcactctccaggaagagccaccgcgtggtggccgggatcgtgtggtggccagggcgtctgaccttggctctcacccggaggccatccaggtgctgaggatggctaacgctaaggccacacagccagggagaggaggtggctcgtgacaccacgatgggacacacccacctctgggagaggagggtgactccgacagcccttgcctgccaggatggagcctggactctggagggcatcgtgtcctggagcagcaccagcacctcctgttgtcaccaggcgtggatgcccgcatcatgaaattcatgcctgggaaggcgtggaggccgagaccaccccccctaccccgcatctgtgtaaaacacaaataaagccattgagagcaactgcaaaaaaacaacataataatctacacttcatctacaaatatctctaacatcttttcatcaatctacgtctacatatccaaataactaaccaaccatcacatagctcgaatgattaaccaacgatcagcaccaaacaagaagccgaggcggcgcgctatccctataaaaattatctccacggtaggcagcagcacattatatagtcaatagtcagacacccaccattctttttcagagacaaacgagtgccgccaaataagacgcggatgatcatcaatataaccaaccagcaagcgccacccggcgcgcgctttatacaacaacaccagtcccggctagtggttgcgacaacaacaccctcgctcctcaggtccgagaagttactcttcgaagcggcgagcccctcactacttgctggtggtgtgcacgacacaaacatctgagtagagacgacgacaaccacaactcccccaggcacgagaacctaaatggcaagacacctacgtggacgtcgaaataactactaattatcgaatcggacattatcttaaaagctgatcaatgacacaacactagctgaaatctaaagtaacgtctgagtcgaaaaaaaatataggtgttaccacgaacgagaaatattctacgcgaacagaaaactttacgcg

SEQ ID NO: 120949 - DNA, 1402 bp, Homo sapiens
gggggaccctgggtggtgggcaggctagagttggggggaagtttaaaacaatttttattaatatataaatagagacttgggtctcactatgcggcccgactggccttgaagtttggcctcaagtgatcctcctgcctcagcctcccaaagtgctaggattacacagccctcgcccctcgggtcccttctgcccttgtgggagttgccagtcctcctatcctcccagtacaaagctggcttccacttctgcgggggctaccacatcagcgaggactgggtggtcaccgctgcccaccaggggtcaggtgaggcttgagcttgaggagttggggcccaccaggtgtcagggaatgacactcatcccccttcccaaccccaactacaccctgcaaccaacaggaaaagggtcggaaatgaactgcaggctggggaaccagcacccccatcccccggccacaggcagagccgcctctgcaggagacacccaccccaggccgtgcaccccacctccaccctcgcaggccacccagacggcagcttggggaaacctgggaggtcccgtaccctcactgtgcaggcacccccatgagcccaggcaccgcctgccaccctcactctccaggaagagccaccgcgtggtggccgggatcgtgtggtggccagggcgtctgaccttggctctcacccggaggccatccaggtgctgaggatggctaacgctaaggccacacagccagggagaggaggtggctcgtgacaccacgatgggacacacccacctctgggagaggagggtgactccgacagcccttgcctgccaggatggagcctggactctggagggcatcgtgtcctggagcagcaccagcacctcctgttgtcaccaggcgtggatgcccgcatcatgaaattcatgcctgggaaggcgtggaggccgagaccaccccccctaccccgcatctgtgtaaaacacaaataaagccattgagagcaactgcatacacctttacctctgtgtcctcaccaaggcaggtgggctgagcatgatgtggctgaggtggggggacagatgctgtcacggggacaacctctgtagaggtaagatcaggagggcttgcgaatcacccagccctactcccttcttcatacagatggggaaaccaaggcccatgttcatatgcagaacggtcagggctgggagcagcaccaggggttccaagcaccctgaagcttccatctgggctgcgggctgctgggtgggggagccacgaagggggacacacttgcccagggcaagggtcttctccaagcccctccctcccaactcagaggccaggtccaggtataattccatgtgcacttcgggagttccgcaggctgggatgagattcttttaagcaga

SEQ ID NO: 120950 - DNA, 620 bp, Homo sapiens
ggaacaagacaaggatgcccactgtcaccactctgattcaactggaagtcctagctacagcactcagtcaagagaaagaaataaaagtcatcttaattgggaaagtggaagtcaaattatctctgttcactgatgatataatattatacctagaaaaccataaaccctcctagaaaagactcctagacttcagtaaagttccaggatgcaaaatcaatgtacaaaaaccagtagcatttctgtacactggtaatgattaagctgagaagcaaatcaaagactgaatcccatttacagtggctaccaaaaaaacactgaagaatgcatctaatcaaggaggtgaaatatctccacaaagagaagtacaaaacactgaagaaagaaatcatagatgacacaaacaaatagaaaaacatcttgtgctcctggaatggaagaatcaatataattaaaattaccatactgcccaaagcaatctatagattcaacccaattcctgtcgaactaccaatgtcactattcgcagaatttaaaaaaaaacttaaaattaatatggaaccaaaaaaagcctgaatagccaaagcaactctaagcaaaaatataacaaagctagtggtacc

SEQ ID NO: 120951 - DNA, 681 bp, Homo sapiens
ggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagatttctggaaggagttatttatgagtgaagagctggagaatccattcgcaaactgatgcatgaaagtgattagcaagagaaagttgtgagacaaaacagagaagctgagaggccagaaacctctacccaggacgctgagctcctggcggatccgatgagtccctccaggacaccgtccaccctgggatgaaggcagaggagttggaaggaggcgaggccgtcacgggacaacaggaccctatgaaggtgggcccacagcaaaaggagagatgattctagagcatccagtcttctagggcagcaaaacaacctaaattttctaagaggccacccagctgagggtgcccccggggagggctgaggcgtcagggtgacggctccactgcccactcacctgcgacctcaaagcccctctcctccttg

SEQ ID NO: 120952 - DNA, 806 bp, Homo sapiens
ggcccagggggcccaggagagtataaaggcgatgtggagggtgcccggcacaaccagacgcccagtcacaggcgagagccctgggatgcaccggccagaggccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatggtcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgaggccatctgtgtggtggtggctgatggtactggagtaactgagtcgggacgctgaatctgaatccaccaataaataaagcttctgcagaatcagtgcaaaaaaaaacaaacacaacaaaaaagtagtgccatatagtgagtcgtattacaagtcgac

SEQ ID NO: 120953 - DNA, 295 bp, Homo sapiens
attgtgagtaagctcaaacatgtgaagaggctgtggatcatgaggccccagatggagacagagagaacaggggaggtggaaaaggagagacagactaggagaaaggggaggagagagagatgagatgggagagggaggcagggagagacacagagagagaggccaagagtgccaagagcaccaaggcaccagacatatgggggaagaagccatcttggaagtttatctccaatcccatagagcccagctgatgtcaaatggatcagagatgaacttacccagctcaacctttccc

SEQ ID NO: 120954 - DNA, 834 bp, Homo sapiens
gaagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgcctattttagcgtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaaccccct

SEQ ID NO: 120955 - DNA, 754 bp, Homo sapiens
ctcgctattcatcggcccatttgagtattttgttttcaattagggagatagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgcctattttagcgtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaaccccct

SEQ ID NO: 120956 - DNA, 271 bp, Homo sapiens
aaattctctgcctactctagcctagagtgatctttaactccagtaagcaccttagcattgctgtttgaccatttattcaaacaacaatttttgagtgatcattaggcagaaagtacagtctctgcccttcagggacttacaatccaatcagggaggtgaggtaattcctgttacaccggctcaactagcactttgcctccacatctggtatgaggccctgcctaagcagacagtacaatggaaacaggacaaattgactcccttcttggct

SEQ ID NO: 120957 - DNA, 381 bp, Homo sapiens
ctcttcatgaagtagatgggatctcagctgggcagtgaaatgtgagtggggtttggtcagctggtggaggttgcaggaaaattatttacataggtgaagagtaagcgcaatcaggtatctaggaaagaatgaggggttcagagtatacgaaaccaatttgagctataacacaaggagggtaggattcatgtagaagagttgtaggaaatattgctgatgtaatattttgtactcaaacagttctgtggattggtgacagattttttttttcaggtaagtaaactattacccctggatattcatctttctgtgtagctggttgagaaacaggggagtaacagtaaagaaactgttttagaataaatctggtgacagcagaag

SEQ ID NO: 120958 - DNA, 537 bp, Homo sapiens
tttccatgttgttggtagtcaagttgatgtctcctggaggtagtggcaacatccagccctgggaggagagtgcgtgcaggtacctttgtcctacattcctctgctgttaatttctcattcctgtggcaacgaaggaatgcatttaaaaaacagccacaacagcggcaatagcccttcctccacccaaggcaatcgtggacctagggagttttttgtgccacataacatgtagccttccgctaaactgacaggtttgagcgtatcgattttgagcgtatcgaaagcacaacttttagccagccattttgtcctcgcatgactacggttgcttatcctgtttagacagacagcaacatttaaaaatcgaagttcctttaaacgtattttgtttggcagtccaaatgtttctatgcagaaaacagtatttgtactattaactatgaagagtgtatggataaatgggagacatttctaataaaggccttcgttaatggttccctctgtttgacatccatggtgcttctgaatacagaaagc

SEQ ID NO: 120959 - DNA, 637 bp, Homo sapiens
gataaagtgacttctaaaaattaatactcccacctaaaattgagatttcaccatccaacagccattttaactctttaattcacctcatttccacgtgtgatatacgcagactcttttgcctgtttccacttccccatctctcatcaacactctcaatccactctagtctggaatgtacagctccccactgctgaaatatcttcaggtcagtttaacaagacgttccacccagtgaaaaagatttagtgttcacggtattaaatttagtatccaagattagcaataactcattagaatagatctttgttagtcttccttatttctaatcgagaaacgctttaaataaaaactatataatatgatgaacatccagaatacaaaacaggctgggcgtggtggttcaaccctgtaatcccagcactttgcgagactgaggcgggtggatcacttgagctcagcaattcgagaacagcctgggcaacatggcgaaaccctgtctctaccaaaaatacacaaaattagctgggcatggtggcatgcacccaagatcccagctactcaggaagcagaggtgggaggattgcttgaacccaggaggcataggttgcaatgagctgagatcgcgccactgcactcc

SEQ ID NO: 120960 - DNA, 228 bp, Homo sapiens
actattaagctggatagctttgaaagcagtgaatataaatttatatttgtggctcacacactttggaatcctagcaccttggaagggtcaggtgggcagatcatttgagctcaggagtttgagaacagccaggacaacgtggcaaaaccccgtctctacaaaaattacaaaaattagccgggctttgtggccctagcctgtagttccagctacttgggaggctgaggt

SEQ ID NO: 120961 - DNA, 476 bp, Homo sapiens
  misc_feature (11)..(11): n is a, c, g, or t
ctgatacaatncgagctcggttccccttttggggtctttgctttgttctttgattgttccagtgagccaagctcctactgcccatttcaggaaagtgaaaagcaataaggaattaaccaacctaacactacagctgtgctgaccataatttaattttgccctattcagaaataattttactgtggtgatcacactattgggttcaacatccactagcagctacatgaatttatagcaggtgtaagagatttaacagaatattgattgaaatttacttaagtctgctggtatttattttatttaaagttatatttattctctctttttattagaaatgcttttctcttatgaacacataagaaaatgataatttgaattttcttgttgtttagatatcagacatttctgaaacattctcagcatttataagagataacagacacatttgattctaagaggatatcctctagaattgt

SEQ ID NO: 120962 - DNA, 125 bp, Homo sapiens
aatatttacaggttgtcttgtgcctgttttactaactgtgcattggggatggagggtagcaaactgatcactgtcttttcagatcatgggctacacaaccataaggagccacatctaggactaaa

SEQ ID NO: 120963 - DNA, 369 bp, Homo sapiens
ttacttttttacgttaacaatctttagtaatattctccatactagccaatttacaaaatgtacattatcttttttgtactcaaaaatgtggagcatttgacttactaggaaaaatgtgaaaacaactctctacaaggataaaatagaaaattcaaaggatttatgcataatcattttgtaccagtgcctcttactaccttcggaatgtccttcatgaactcttagctgtattcatctcttagtaaggatatatccttttttaaaaatcaactttaagtgtaattcatgtaattaggccaggcatggtggctcacacctgtaatcccagcacttgtggaggccaaggcgggtggatcacgtgagtatggg

SEQ ID NO: 120964 - DNA, 299 bp, Homo sapiens
atttttaagttgctaaaattcagcatgtcagtagcaacatggctggcagctgtatctctactacagtgaagtttgccagaaaaggcagttctaatacagatttaatcaccccaatagacgcctgtccaactcactgcccagcctcaaacacaaggcctccattatagagccaaaggggccattactaccaaatcatacccagcctttgtatacagttaaaaagttacactggggcctcagacccactgaccattacaacattaatacatccagggaggggtcaaggatgcttttttttt

SEQ ID NO: 120965 - DNA, 442 bp, Homo sapiens
tgaaataactggggctcagaaaacatttattgattgaaagtaatttaatttgcacatggattttaaaattatagataagtatgcaaatattttatgataactgtataaaagacctgttaaatgcttgtccaataaagtgtactttcttcccagcatagagaaagaaaggaagagaggaaaagaaagaggaaaaatggttttcctcatctcctggggtaataattgaagtgagtgttcactccatccatgaacactgtgatattatcagataatagattaccttcttccttcccttccttccttccttccttccttccttccttttatttttccttttttctttttttctctttcataaagccatatttattaattctaccaaagtccacaatcctagattctacttaagccaagaagattttgttctctagggaatgtacct

SEQ ID NO: 120966 - DNA, 210 bp, Homo sapiens
taaaaggctaccaggtcttaatcaatgaacccaaatccccacagtgtgaacaattatctgtgcatgcactaaagagcttcattctactgtaaggagaaaaagcaaatatattaacaggtattaaagaaagcccttggccgagaaaaaatgtatttcttctcctttcttttttcatttttttttgagacggagtctcgctctgtcgcccag

SEQ ID NO: 120967 - DNA, 328 bp, Homo sapiens
aaataaataccttaatagaatttccagtgtgtagaagcttctttaaagttgagcctgaaagtttaaaataatgaattataaatagagtatataaatgcatatcaaagatctattttaagaaaatatgtacttatgacaaaaatatactttttaaaaataaaaggaagaaggctgaccttcagaagcaaagcaatgtcacagagggaaagacgttttcaagataaaagtaccttaagtatgtatctcttcagaattcttttaaaacagtcaaaatgactgatattaaggtaagccaaatgcccacagtggattatgcgcatatatctct

SEQ ID NO: 120968 - DNA, 763 bp, Homo sapiens
ctccctccacagcctcatctctcgctgcttcctcttgagcatcctcaggccatggcctgacctgtctccttgctgtcctcagcaggccctgaactttccctgaccttgggaacatcagctgggaccttcccccttcccagcatggcagtctggggagtgatttagagcaaggactctggagtctgccaaactgggatttaaattctggctcagccgcacactcgctgtgtgacatcacttcttttggcctccattgtctcctctgtaaaatgaagagaacagaatcaaaagagatcatctgtgcatatgtcaaggctgcatgctgggccttgcctatatatccataaataataactgcagttatcatgaacactaagcatcatgcctcgtgaaccattatacaatattgctgatctgaagtttatatttcagcgtatattcttgatgttaagtattatcttagcggtaaactcctatgcatgcttcagtgcccagctttgtcaccaccgcctccgggaagcctctcttcattatcctggcaggatctggagctccttggtggttccccaacataggttgtcctttaaacagagcaacctatgaacaagatctgcccctggccagacagggggaaacttctcttctgattccttctgtccacttgccacctagcacagacaggcacagggagaacaattcctcctcctcccccaacatgtgtcagtcctgatgcaactggaaatctccctcctgccacattctg

SEQ ID NO: 120969 - DNA, 409 bp, Homo sapiens
aaaagttttgtatgtatttttggtttctcaaaaggtaccatttattcatttgcaagtctgtatttcaataacttcctgtctgccaaagatctagtttaatgctgtaaaataatcctacacatcacaacccatctgtgtttcccagagataccataacaaagcatcacaaactgaatggcttcaatggcagaaatttattgtctccaacttctggagattataaatttgaaatgaaggtgtcagcagggctggttccttctgacagctttgaaagatgatctggcatgtgcctctcttctagcttctggtggtttggtggcactctttggtgctcctttctttgtagatgtgtcattccaatctgccttctccttcatatgatgtcctctctgtgtgtcttcacagtttc

SEQ ID NO: 120970 - DNA, 417 bp, Homo sapiens
  misc_feature (39)..(39): n is a, c, g, or t
ctggtgttgctcgctctagcaggatccccttaccacccncgatcacgggttcaagcgattctcctgcctcagcctcctgagtagctgggattacaggcgcatgccaccacgcctggccgatgtttgtatttttagtagagatggggtttcaccatgttggccaggatggtctcgatcttctgacctcgtgatctgcccgcctccgccttccaaagtcctgggattacaggtgtgagccaccgcacccggccagaagtttattaaaaagctctagaagagtaggaaagaaatgaaagtgcacttgggagagatccaagtgggcaacttgaagaacatgtgtccaattttgatggtcttttcaaaacaccaacttgttattttgttgatcttttgtatttttttgtttcaatttcattt

SEQ ID NO: 120971 - DNA, 517 bp, Homo sapiens
gttttcaatttatgtaagccatatagatttgaatccatgctctacgactaatcttaatctcactgaacccaaagattcctcatctgtaaataggaatattgaactatccctcatgatttattatgaggattaaatgaaggctaatcaagctagcttttgttttctaaaaaggcggcttatgtttgaggattcaggagtacctcatggtacctcaaagacaagggaaaagaaagaactaaaaccaaactggatgcccctctaataatgggctatgtcacatatgttttcttctttatcccttgaatccagttcctctgcctctccaaaccacaatgtagaaatcatagttgagtcacctatacagaaaatgatttttcttttccaaattccttgataaaaggtgggttcttctagctagggcacctgcccacacctgttcctggatgagagaggaaaataatcctgcaggaacacaacagaaagctggttttcctaagccaccaccaagagcatacag

SEQ ID NO: 120972 - DNA, 710 bp, Homo sapiens
attctatagttccatttttttttttctgtattagtgagagtcctttatttaatcttgaggaccatatagatggcattattatctcaaggatctatgcagaaaagacccggcatgtgaaaccttgctactgacagctattcgcaaaaactttctgaaagtgcttgaggatgagttgacttatctgtcagcaacttcaacttacttggaattggatttggtaaatattctactaataacctaaccaagcgatgaaagctttgcagtctcagcacatgaacagagtgactgtttccatgagaaggtgtgtcacagtctccttctgcatttgaaatgcaactgaaaaaaaaagagttgctaactgtggcaagtaagattttctgtttggctgtcaggagagagcttgtatgtttcgctagtagggcgcctgtgtccatgtatgtacttacttcctcctgtctcttctactgagtgcattgagataggctaaaagatcaaaactcatggcaaaattatcatttggacctatggatcttctttttcttatttctcaggatgtattagcactgtaattatgagaatttatcttgagaaataagaaattataagccgagcatggtggctcatgcctgtaatcccagcactttgagaggccgaggcgggtggatcatttgaggtcaggaatttgagaccagcctggccaacatggtgaa

SEQ ID NO: 120973 - DNA, 414 bp, Homo sapiens
ccttcgtgagtacctgggaggctgaggcaggagaatcgcttgaaccttggggatactgaggtgggaggatcatctgagcctgggaggtcgaggctgcagtgagccgtgatcgtgtcactgtactccagcaattggggagggaataggaaaaaagttattagtgcttagaggtctgagactaggaaaaaaaaaggacaatggtggatctggctatgcctacctcacaggattgttatggagaacaatgagatttgtgttaaagtactttgaaaagtatagtgtaacacaaatataatgtcttatttttactgttcatctgtggtttattttagggtagatacaacaagaattgaatactccattcctttaagagaaaactgggcactaccatattttgcatgccaaattgctgca

SEQ ID NO: 120974 - DNA, 422 bp, Homo sapiens
ctggtaatctcaagatcagggcacccacagattcagtgtctggtgagggcagctctgggcttccaagagggtgctttcttgctgtgtcctcacatggtagatgagatgggaggtggaggggcaaaaggcactggggtacacctttcaacatcttttgtaaaagcactaatccactcataagggtggagcccttatgacttaatcacttctaaccacctcttaataccaccaccttggggtttaggtttcaacagatgaattttgaggggagatacaccttcagaccatagcaggagggacacaattcagatcataacaatcgggatgttttacactgcaattaagcaaatgccaatgaacagtgatttgaatagtaaagacattaaattgtcttatatgaagggcagtctgggattgggtag

SEQ ID NO: 120975 - DNA, 463 bp, Homo sapiens
gaatggataaagaaaatgtagtacatatactccatgcaacactatgcagccataaagatcatgtcctttgcagggacatgggtgaagctggaagccatcatcctcagcaaactaacacaggaacagaaaaccaaatgcctcatattctcactcgtaagtgcaagttgaacaacgagaacccatggacacagagagggaaacacacaccagggcctgctgggggtagggatgaggggagggaacttagaggacgagtcaataggtgcagcaaaccaccatggcacacgtatatctatataacaaacccgcacgttctgcacatgtatcccatttttttcctttgtgttagaaagaaaaaaaaaatccataagcagcttcaagccttgagccctgaaacggttacattttaataaatattgcaggggtcggggagtggcatgcacagagtagcaacagtagcttt

SEQ ID NO: 120976 - DNA, 573 bp, Homo sapiens
taccccttgtccccaagaagtatgtggacacgacaggcacatggaccaatgatggtcatgtcaagcgtgatgaagtccatggtcctgagggacacttggaccacggcctgcatgagagggcctggaacccaactgggcggatctagaaagaattcctctggacttgattcctgaacttgaaggtagagatggaaggagaagagttctgggtagcatgttcctggcagaagaagcccactgcaagagcaaaggcactgaggaagcctggtggtcactggaaaactgggattcaagtagctgaaatcgtaagggtgcagcctagggagaagtgagacccgtggtggggggcagagccaaatctctgtatccaaacctttctatatgaaagatacagtgtctgtgtctcacaagaatctgttttcttcgggtgtctgttatttgagtgctaaccagaacagaatttctaaagatggtctttgaggccaggtaacaaggctgaggctaagaagaactatggaaggtctgttggcaggagagatgtatgattagatctgcattagcagaaggaaagtt

SEQ ID NO: 120977 - DNA, 291 bp, Homo sapiens
gttgtcaggaggccgtgcactgagcacactgcctgacacatggtcaaaacccaggtttgtgctgagctctgaaggacatgagcagacagagaaaggaactcgcaagcatggcttctgaggaacgggtgaaggaaggcccttggttgggaagagacagagctgcctccgaacacaggctggatggtgcagaaaaaggcagagtggatttgttgtgtggctccaatagggacgactgggtccttcaggagactgatggatttcagtgaaagagaagcaaggagtttctaattg

SEQ ID NO: 120978 - DNA, 631 bp, Homo sapiens
cgcaggtgggctcccgtgcttccaagagctgaatggtgttgcatttcctaaccgtcttacctgcaccctggagatagatgggggactttgccgtttcttcagacaagcaggactgtgactcacaggccggagagcatcacctctgagtgctggcggagcttcaccaagatcagggtttgcagagtcttgcctgcacttagacgcactttagacccacagagagccttcgagttttctgggggtgggcagtggggggattgcacaaaacccgtgtgttgtttgggcgtggctgttgattggagagctttgtacctgtagctggaggtggtcactgctgctcagggccgggtgatcaccattagagtcatgaggtctccatcctctgttagtgatacttgcaaaggaagtgacaccttatccttggctatgatgttgaagtagttaatcaaactctgagtttatgaaaaacatgggggatgggggagggagctagtctccctcccccaaaactccagccatctctagggtacagtggtggctttgttggtggcagggtgtgtctggggaagtaagagaacgaaggtgtgggaggtggaaggaccatggtaacccgcctccttgcgtggaggga

SEQ ID NO: 120979 - DNA, 159 bp, Homo sapiens
tagtgtttttatgttaaccagaatcatagctattaggtacataaaattaatggttattaaatagtccatctccacgctgttaatttaaaactaaaacaggaattcaagctgcctatgagaatttaaaaataatgtaattgtttgattgatttctttggt

SEQ ID NO: 120980 - DNA, 274 bp, Homo sapiens
tatgtgtatacaagcaaatacgaatgtacgggatctcctttctctttcacacaaaggaggcctcgtctaacactattctggttttacttagcaatacatcttagaggtctttccacgtcagtacataaagaagtccctcactctttcctatagctgcagggtattccaacacatggatagactgtgatttatttaaatgttcccactgaatgggcatttccccagtcctttgcaatggtaaacgttgcttataaatcgccttgcagctccacct

SEQ ID NO: 120981 - DNA, 190 bp, Homo sapiens
taaaacctgcccatatagacatgcaccagcaaagtgatgtgggaagttaccatggccctgggggaagctgcagtatggggagggaacagacaggcttgtgcatggtcataggggtcatctcgctggaggtcttcaccagtcgggcatagtgcatcagtgcaaaagctacagtgtgggcccccaggacacc

SEQ ID NO: 120982 - DNA, 859 bp, Homo sapiens
acttttatatttcatcctgggcctcgataataacagcagctatgtcactcattgcagcaagcataaatccttctactttctggttttccttctctgcttttctttagtaaatgcataatataagttttgccttgtagaatgtgcctccttcttggatttattttccatttctgttatattgctgtatgtgaatctttttatcctttattaattaaattctatttttactataaaacctatacctcctttttaaactttaaaatatttcattattagcattattattattgagacggagtttcgctctttcacccaggctggaatgcagtggcgcagtcttggctcactgcaacctccgccttctggtttcacgtgactctcctgcctcagcctcccaagtagctaggattacaggcacccgccaccacacccagctaatttttgtgtttttagtagagatggggtttcaccatgttggccaggctggtcttgaactcccgacctcgtgatctgcccgcctcggccttcccaaagtgctgggacagtagttaaaccgtccctttgagcagactatattttatatacatacatttgagagtaaaatcagtgtttggagacaacttaaatgtatagaagaataggacagtctgagcagaaaaaaataggtagaaagcttcagcatattctgtatatgttaagggtagggactggaaatggtatataagaaaccaaaaaagaatcatgaggaattcatgatgattgaaatttcaggcaacatggaaagtgatcaggagtaacttcaggattttaagtctgggaaatctgaagaatcattgacaggaaaggagaaaaagagaaa

SEQ ID NO: 120983 - DNA, 507 bp, Homo sapiens
ttggccaggctggtctcgaactcctgacctcaggtgatccacctgccttggcctcccaaagtgctgggattacaggcatgagccaccgcgccccgccttcaatatatatatcttctgaaaatcctcatttgtctctttccacccccattttgtttatcagatgcccatttgcccagaggtcccttaatcctgacaaaagtctccgtagcattttcccactggcatttttttgaagagttgagcagagctttaataagaatgaaatctaatgcctttctgattctgcagccgagttcaatactgtgtgtgtcataatataaatttagttcaaacaatgtcttgcagattggttctgagcttgagtgtagcaacacaatgatggagtctcattcactcatgatgtgtcacaaatagttaactattcccacactcaaatatcaaatgactcacttattatgacatctgtattcgcattcactcacttgcattccagtatcctttcttttg

SEQ ID NO: 120984 - DNA, 139 bp, Homo sapiens
gatttgaatatactgacatttaaaaataacaatttttcttatttgctctatgcttttcaagaacatttcttatttgattgcatttattatagtaaaataacaagtagtttgttcccaaattctataataaatgcaatgt

SEQ ID NO: 120985 - DNA, 760 bp, Homo sapiens
ttcaggataaaattagaaattactcaacatgcaaagagacaggactgtaagactaacatttaaaacaagaaaatcatccaaattatctaaattttggaatgagcagacaattacaatgaagcagctattataactatgctcagtgaggcaaaggaaaatatgctcataatatgcaaaaagttgataattctcagcagataagggcaaatgataaaacccaatgtaacttctaggactgattaatacactatttcaaaggaatatgtggctctctcctaaaaattaaacttcactacctaccaggtcactgttgatttcatttgagaaacttgagtttgggtttctctaaaggaacatgtcatagtagaaagaaacagtcctgaaacagcaattgaactaaagatttagaatagtaaaaaaaagcaacgagttgttgcctaagcaaattgaccttaaacaagtctatttatcttatttttcttagctgaagaagggggataataatggtattcctaatattccaagcatagtttctataacatggtaacacttattgtattatctgtaatgataatgatgattgtttttaattgtgttctgaaagtgcttctttttaaaacaggagtatctagggagatgacacatcctagccgggttttggatgttacctaagaggacagaggccaggacccaagagtaaagtaagcaaaagagaaacttccaaaggcatagatcctatttctaaaactcaactcagaat

SEQ ID NO: 120986 - DNA, 443 bp, Homo sapiens
aaggtcttcgcagtgtcttcgggttctgtggtttcaccaaaatagttctaactgtggatttctttgtatttaccatactcaggatttctctttcctgaaccagagggtttatgtctttcattaacattattagtctttctcattttgagtatttgccctgccatttcttttttctttttcaggaatatgaataaatacattaggcctttgttttgctttgtttctgtgtgctgtcttcagggtactccctcaggttggtttcccagttcactaattttcccttcatatttatattaactgctttgtaaactatctattgagagccaggtgcagtggctcacacctgtaatcccagtgctttgggagactgagatgggaggatagcttgaggccaggagtttgagaccagcctaggcagcatagtgagacatcatttcttaaaa

SEQ ID NO: 120987 - DNA, 447 bp, Homo sapiens
atcacagcgtgtcttttttctgccaagatggacactgggcaccatggtcacaggcttcttgggtgctactaatagaaggctctctcttggctttctctgttgggcagaagtctgtgaatgccattatagctaagactctcccattctggccaggaaaggaagctggaaggacttggactcactgatttgtgctgacacccattcagccctgccgttggaactctttaatgtgcttttcagtgagctagtgtttcagaacctcatgacagggcaggctgatttctcagatgcatacttctctgacctctggcttcccctagctcactgaggctcgttctgcctgttgatgaggctctcctggcagatttgacactggacccaagagggcagaagaatcagctgttaagctggtacagggctcaaagataaataagaagacactcagca

SEQ ID NO: 120988 - DNA, 385 bp, Homo sapiens
ctctgggttagagacagataagtctaagtgggaatgttggcctcatcacttaatgaaaagtttccctaaaacttggatttctcatccataataatagcatttacttcacagtattcttatgagaaataaataagataaagaagaaaagaccctgatacagaataagtaagcaataaatgttactgtttagtgtttttaatgttttcttttcttcctgaacaaaataatcttaattctatacatgtactttgcaataaactggaatgtaccaaataatacatgatacctatttgtctatctggtattaaactggcagactcaccaaacaatgccagccccttctctaagatgaaaaagacacagaagcaacaaacatttcagctaa

SEQ ID NO: 120989 - DNA, 415 bp, Homo sapiens
aaaccttacaccacccaggtactctaaaaccatttaccaaaaagagtgagagtgagcaaaagtggcaacacgttaattggtgaatgtaggtgaagtttacatgggtgctaattgaactattcttgcatttttttctataggtttaaaatttttcaaaataagtgggggtaaagatgaaatttggatatgaccctttcctgtttaatagtgttgcctgaaggttaacagttgaactctttagcctactagttaaggatccttatgattcagcccctgtttatctttccagtcttatctttttccatcacatttctcaaactagtttaaatgttagctatgccacactacttcctatttttcagattgctcatgttctctttcaccctcatgacttcgtacacattatatgtgccct

SEQ ID NO: 120990 - DNA, 500 bp, Homo sapiens
tgtcaacatagaatcatatcacaaatcttctaatgttttgctggtttgacagggaaggactatatctttatgttttttgttataatttttttaaattaaaaaaaatttttataccaacgaggctggtctcaaactcctgagctcaaggagtttctctttatgttgttttagtctgcatttctccgatcactaacaaagttgatcacttttacctacgcttttaagacatttcttctggaaaattcatgttcataagcttcgtccattttcttctttggttgtttatcttttgattaatggtttacaagatttttaacaacaaatacttcgattattgatattatcttacatatttaaaacctcctctttctcaagatccggaaaatatgtatctatgtgttcttctaatggttgttagttttgcttttcatatttagcactataatacatctattatttctttgtgtttatgttgtgaaataaaaatttaactgaaaaac

SEQ ID NO: 120991 - DNA, 229 bp, Homo sapiens
tagaatgtttttcagtgtcacattctttgtacagcaaaatactggaagtaacccacatatctatgaataaggacttgattgaataagatggtcatctgtgcagtggaataccatccagctaggcatggatagatgtgcaacatacattgtgaaggagaaaaagtcagtggcaaactgtagtatcctagcccccttttttgttgataggtaatgcctggctaggaaatga

SEQ ID NO: 120992 - DNA, 394 bp, Homo sapiens
tgccccaagtctatgttaagtcctgcctttttggtcttgtccccaacctttccttctgcccccacaactttctaagggtttgtcatcattggcatgctaataaaattgtcgaaggaaggtaattccaaactggactggggaaaggctggcttatttgtgtggaatagagttgttttaaatcactggtaagaattgatttaatgtttactttcttctccctgagatttgatatcagtattttatggtatgtcctagaaacatacaggtttaagtttaaaaggtgaagagggccaggtgtagggggtcatatctgtaatcccagcactttgggaggtcgagggaggaggatcacgtgagctcaggagttcaagaccagcctaagcaacatagtgag

SEQ ID NO: 120993 - DNA, 820 bp, Homo sapiens
agaaaaattatgataaataagtaaattatcttatattagcaagtaataattagtatggaaaaaacagagagattgtgagtgttgaaggaatattgaaattttagatgggatggtcagggtaggcttcacttagaaggtgacatttgagcaaagagtttaatgataaggaagcattgtgaatatcttgggaaagagttttgcaggcagggataatagccagtgcaaagaccctgaggcaagaatgtgctttcggctgcacaaggcctagttcatgcatccaaacaagaggttggagcagtttatttcctctctctttgaggtcaggatggattttgggaactgaagtggactgagccaacaaggcagggatcaatatccagcagctataaggagaagtggggatgccaaggctgagactaggactgggcctgagaacagtagtatgaactctgccacttctcactcaaactatcgtctagcttttctctttttcctggatcttctttgtgcctaatcgatatgttatttgtaagcatgaaatctgactttatgaactctgtgataatgtacaatgttttcaagttgtttcactaaaggagtaattataaagtcttaattgcttatcttttatatcaaagcattgaaataacatttaaatagatcaaagtgtttagagaaagatgcaaattggctttatcacaagaatgtgggagaatctggactttgacttggcatataagttgggttgcctgtccagtaccaccttaactcctgaaaaataggggctcctgctcaaactgaggctgtacctatcacaaac

SEQ ID NO: 120994 - DNA, 575 bp, Homo sapiens
tacagtgtctacccaccatattttgagacaaatgagacaagtagactgaggggcggtaatatccaatgaaggaaaggaagcttgctgctcggcccaactcaaagcctctgaggattcaagaaagcttgagataagactgaattgcttttgcccactctaccttattttcaggaattgaagtggtcctatcaccaaaaaggactaagaagctgacactgtaatggtactctaaatcctcaagtctctcctgagaagacagtgtagcccagtggttagaaccatggtttgaattctgacttcactaccagttagcagtctggtgatgaagtctttggaagacctaattattcatcggaacagtgtggacactattattgttatacaataatattgttagaagaatcaatagacgaatgcaagggaagtgctggtcctgtaacaagtgctcgttttattgatttattgattgattgacactcagggtcttgctctgtcacccaggctggaatacagtggcacagttacagctcactgcagcctcaatctcctgggctcaagcaattctcccacctcag

SEQ ID NO: 120995 - DNA, 784 bp, Homo sapiens
atattatggctgaggaaacagccagtgagaaatctctatggtaggaaacagttcagtgggttttaggaacagaaagatgaacagagtaggtaggcacagtggatgcttgtataaaatgacattggaaaacattctagatagaaattcttcttcaaagtaagcattcctgtgttctaacacttaaacagtgttaataatacaagacattggctccaaaattacattttattaaatgttataaactaagaacgggtcagtcaggaaaacaactgtcttttgcaatcagtttttgcaatctgtaaacagtagattatatgtagtggatttgaaagctctaggatggtgttttttttctcctcaacaattggaagtattattttaattgtgtgtgaagtgttagcaatcctcagaacacctcagcacattagttcagtgtcttctactcaaaaccagaggtacttgaatcctggaggtactccaccttccaggatggagactggcaaacagcaataaaataataatttcttaccttatagcaacaagctacttaattcagaaattcctcatctgaaaaactcaattctcttgagcagtatcttgacctcttattgcataggcttaggagtcaaatagtctgggcacaaatcctgactttcccattttctagctgtgtcgttttgggcaagtcccttcttccagtgtcctcatttatttcctctgtaatcaggatgatgtacttatcacaggcatttagaaaagcatcttgcaaacaataaatctttaa

SEQ ID NO: 120996 - DNA, 388 bp, Homo sapiens
aatgttaaagaaggggaaaacatcacgattatatatgaaacttctagtcatccacctgcagtgattatcctgaaaagaattgatctagccaatgaagttactatgtgttcaaagaagggaacatttactttgtatcatgtcactcaaaatgattcaggggtatatgtaatcagtgcttccaatgaggttggggatgattctggacagattgcaatctcagttatgagtaggttgaatttactcatccctattttctttaatccttaatgcctctgggccacctttaattaagcctagccctgggaaattggtcccctaacatttctgtaattcttttgttaattaattgtgaccttttaaagacacatcaaacctgcttctctacttt

SEQ ID NO: 120997 - DNA, 450 bp, Homo sapiens
cattctggccttctccccttgcttacatgtaacctcccactttaatagtgagaaaccaggctcctgtcatttgtcatccatttgcttaactgtctagttccaatatacatttattctctatcaatatcagaatcgctatcccatttcctgtaggaaacagctacaccacccagatcacatgagttgtttgcagtttctcttcctttcagtcttcatgcattttctttgtttctttttctttttctttttctttttttttttttttttaagagagagggggtccggctcttttggcccttttggcccgggtgggggtgggggtgcagggggcgcgacccgggctcaccggaacctcaattcccagggcacaaggcagattcctccggcctcagcctcccgagtagcggggaccacagggcaccggcaataaggcccagataattttgggtc

SEQ ID NO: 120998 - DNA, 437 bp, Homo sapiens
cctcccaagtagctgggactacaggcacatgccaccacgcctagctaatttttgtatttttggtagagacagggtatcaccatgttggccaggatggtcttgatcccttgacctcgtgatccacccaccttggcctcccccaaagttggaattgcaggcatgagccaccacgcccggccgactttacattttaagagcataaaactacttttccctgtatggtttttttttcccccccaagagacatggttttgctctgtcacccaggctagagtgcagaggctcatgatcacaatcactatagcctcgacctcctggacttaagccatcctcccaccttagtctcctaaagcactgggattacaggtccccatctattataagatgtaattgcacttaatttgtagacatccttcaagtgatatgtgggtgaccat

SEQ ID NO: 120999 - DNA, 389 bp, Homo sapiens
attggacctaggtgtagaactggatttaattataatccaattcattaacccatgcctggcccgctgtgatagtttcctgttgatgctgtaacaaattactgcaaatttagatacttaaaacaacacgaatttattttcttacaattctggaagtcagaagtccaaaatcagttacactgggctaaaatcaaggtgtcggcagggctggttccttgccttttccagcttctagaggctgcctgcattccttggctcttggccccatcctccatcttcaagaaaagaagcatagtatcttctttcttctctgcctctgtacgtacatcgtgattctcctgccaccccttttcatttacgagaaccttttgtgattactttgggcgaagatt

SEQ ID NO: 121000 - DNA, 444 bp, Homo sapiens
acattcaggatcagctctcccaggacccaatctaaaggatccctcaagagtgtgtggctgggcccttcccctcttccagtcattaggccactgttgagcacctactgtgtgcactggggacactgaggccccaaaaggagacaggacttgagtagtcaagtgaccagtgaccagtcagctggtgtcaaggggccctggaactcaggtctcccaccgcccagggctctatctcctctcctgagctcccaagctgggagggggtatgagagtggtgcctctctatcccccagctgtcgggagcctttgaagagcccagcggcggtgctccccatgttgccccgcggtggagagggctggtttatttctcctgccccacagagccctgacctgtgtggcctccgtctctggagaaccccccacttccccactctcctggccgccaca

SEQ ID NO: 121001 - DNA, 438 bp, Homo sapiens
tttgtcaagattgtgctgggttcagggttataatggggaatagtatacacatagacataggttctgccctcatggagcttacaatttggttctcatttcttattatggtaagcttgtattgcctgtcagtatttcactgatttgattgaatatccttacttcccatcttctgtcacagaatcttcctcattcatccaaaacgcaacatgtccaaatcttagtgaatgctttcagtgctttgggagtggttacattccattaagattaaatccaagccaagcaagtaatacttacaagcatgcacaggagaatatgagatgaggagagaaatcctcatacttagttaatttcttgccaagtagagaaattttcagtagagccttaagttacctcagggatggctgaagattctaaatatgagattccaaagtccaccgt

SEQ ID NO: 121002 - DNA, 461 bp, Homo sapiens
cagccacatagaacccctttcttgtgcctagtagaagtggtcatcattggtcatctctttgctttggtcatgaggtcccttcagtttacattgtctttcccattttctcccaaacatctatcaagcttgtccaacctccagcccagggaccacatgcagccaaggacggcttggaatacagcccgacacaaattcataaactttcttaaaacattatgagattttttcacattttttttttttagcttatcagccatcgttagtgttcgtatattttatgcatggcccaagacaattcttctcccagtgtggctcagggaagccaaaagattggagacccctgatctaaatactccatgtacatgaaggtcactttcactgctgtttcttcccagaaatgtctaggtccttcaggtagaagtaatctttttcttcttgtaattatttttatgttcttttta

SEQ ID NO: 121003 - DNA, 347 bp, Homo sapiens
ggcatgcaccaccatgcccagctaattttgtatttttggtagagacggggtttctccatgttggtcaggctcgtctcaaactcctgatctcaggtgatccacctgcctcagcctcccaaagtgctaggattacaggcgtgagccaccatgcccggtgattgctttcttttctaatattttcactgccatctcacttttaaccttctctaagagcagacacagcagctgagcctgacacccatttcagtcaacttctctattccactcaacatacccataacacaaagagactaaatacctaaaccaccaccatctaaatcccatgagttggtcacaatatgtggaga

SEQ ID NO: 121004 - DNA, 695 bp, Homo sapiens
catcttttattttcccatttagattccccatttgtttgagattcagtgttaactttattgttttcttttaaaacagaattctaattattcatttaccagaaatgtcactattaaggttttctttcttctgagttcaaatatgtatgtcattcagtaaaacaataactttactttgagaaaaatactgattgtcaacatacatccatagtattcagataaaatatgtatataaaatgtgtcaaagttgtaattttactgtttttctacatattctcttatcacactactgactggattttaaatcataagcagcacactggtttggattaaataactctctgtcttagatgaactattactcaaaacatttttaaaaattgtcaaatggcttcttcctaccactatcctttcctgtttcttaactcttatccctaaactttctgactttatttgatacagtcattatcaaacaacatatttttgataaagttattattacaaaacataaactatattttgtttttaaaattagtcaatttgttctgataagtttatatatggcaagataactcagtattctacaacacattttctttattctaaggagcttaaaatagaaaaaaaaatagggctgtctttacaaagacaagagagtggaaatttctaatctgaataggcttgatgaaataatgtaa

SEQ ID NO: 121005 - DNA, 438 bp, Homo sapiens
catgaagttatattatgaaacggatttcatgaagtaaatattacattagttacatattcatatttcatattctgttctgagctaattattgcatatgataatagtttttttgttgttggttttttttttttgagacggagtcttgctctgttgcccaggctggagtgcaatggcgcaatctcggctcaccgcaacctccgcctcccgggttcaagcaattctcctgtctcagcctcccgagtgcctgggattacaggcatgcacccccacgcccggctaattttgtatttttagtagagacaggatttctccatgttgatcgggctgatctcgaactcctgatctcaagtgatccacccccctcggcctcccaaagtgctgggattacaggtgtgagccaccgagcccggccaataatgatttttttaagaaaatata

SEQ ID NO: 121006 - DNA, 435 bp, Homo sapiens
atagctcaggatgaccaactggcaacagaaaaatctgcatacgtattttctagatgtgggcttatggagacatatggggccatacctgtcttgtgagctacgttctctcatgcttaggtttcaagcggggtggttgacaaaacatacccagctcacgtaactaacgataagtcatttgcccgggtggtcctttaaggccaaccttgacgtttcacacatgtgagcctgattgaccagtgaatggagaacactcttcgtgggtctgctgaggaagaagaacttggagagactaatcaccattttcctactaggttcttaatggctttagaaactgagtttctctctagactttgatgagaagcagaagaaaaagcaaccaggaaagaacaatatagtgctctgatatgtctcagagccaactaccatgaataccaa

SEQ ID NO: 121007 - DNA, 284 bp, Homo sapiens
agaatttagcatgtcacccatatgtttgatttaaacacggccaaacaatgtgtttgctgagtgcttgactgacagcccagatgatttagcaggaagcaatttgtgaatgaaattagataattttagaactgagagggaccatatctgtcatctagcctctgattttaacagttgaggaaataaagttccaacgaagttatgattttcacccaggcaaaatagggagtaatgaatgagctgagacccagttgcaagcttccttatccagtggttttcccccttaa

SEQ ID NO: 121008 - DNA, 240 bp, Homo sapiens
catcatagtgcatgaggaatttgaaaagacccacaaatattaatatgtctagaattatgtggacttattgatttaaaatcagtaaaaaacggtttataatagtaattgatggatactattcaccaatctttgatacctaaacctacctgttacggggtatgggatcttttgaaaagtttcacctataccacttaagggtccctctgagcaataaaggacaggactgtaatgacagcacac

SEQ ID NO: 121009 - DNA, 851 bp, Homo sapiens
ctgacctcaggtgatccgcccacctcagcctcccaaagtgctgggattacaggcgtgagccactgtgcccggccagtggtagtcttttaatgtggtctccgctctctaacttcctttttagctacagaggagagcataagagaaaacatcatcatcgcttctatttactgagtgcctagtatatactaagtgctggaattattatatttaatctttgcaaaaagcactactgaatacacaaacctcgagagcaggtctgcgtccgtttctctcttactatgcaaactaagtctagtacagtgcctggcacatggcacgccctcaacgccgtggatatgatcatatccattttatacataaggaaaatgaggctggaagagttcacacaggtctcagtgtaagtagcagagtcaggatttgaaccaaactgttccgcaccagggagaattttctggcgtctaaaagcactagtgaggagaggagaaagttttaaaaagtaagattaaagaaaaaagtaactacttgtctgtgtggaagctgaggtggaagaagggcttcatggaaaccctctctgatgaaatcatccctcgtttttgaacagcaattttggcttttccagtttctgtgtgcgctgttggtgcaggtgtgttactcttcttattttgcagatgagcaaactgaggcacataagttacatgagaaagtaggagatagaggactggaacatgatacttcgaataaagaatgtctcagcccctgggcaaccgcagggagtcgctgagaaacaagtttccccgggagtagactcccagctcgctcaaatccttcccattccacatcgtgtctggagg

SEQ ID NO: 121010 - DNA, 255 bp, Homo sapiens
aataagtttcttgagcaatgcagcaatatccagcaattttagatagacatttaccttttgacctagaaatctcacttctacgaatccatcctaaagacacactttcagctggatgtggtcgctcatgcctgcgatcctaacactctgggaggctaaagtggaagaatctcttgggctcaggagctcaagaccagcctgggcaacataggaagaccctatctctaaaaaaaataaaaataaaaacggcacacagtc

SEQ ID NO: 121011 - DNA, 411 bp, Homo sapiens
tttttgtgatgcatgtgacaaatcaagttattcaacagttctagtctttatattctttaaagaaaatgtctgtatctctgtgacttacatttattatttttggaagattttttcttataactttggtatttcacttgaaatatttggtgtccttcatttgcttttctttttcttcagtacaggcaggtagagttcaaatgtcagtagctgagatgacaaactttttctaaaccttaaaaataatgttgttagaggaaaggttggaaataatttgtgagtagattttaatttccgttttttaaagacttaattttttaaagagtcatttaaggttcacagcaaaattgagaggaaggtacagagatttcccctgtatcccttccctacatatgcataccccccccccttttt

SEQ ID NO: 121012 - DNA, 181 bp, Homo sapiens
tatgtaacaaaacttcacatgtaccctcaaaccccaaattaaaaaaaaaatagccaggtgtggtggcacccacttgtagtctcagctacttaggaacctgaggtgggaggactgattgaacctaggaggttgaggctgcagtgagccctaattgtgccactgcattccagcctgggagaca

SEQ ID NO: 121013 - DNA, 333 bp, Homo sapiens
tgtgcacctgtgatcccagctactcaggaagctgaggtgggaagatcccttgagcccaggaggcagaggttgcagtgagctgagattgtgccactgcactccagcctgggtgacagagcaagagcctgtctcacaaaggaaaaaaaagagtaggggcaggattcccactgaggatctgctcatctgacttctggaacaaagaagtggacaatgaaagaagtggagctcaaggcccctgccttatggcccagaaactctttcttggactgggctggggactggcgtgtcctagctggctgcacctcacagggcacacatgggggagactcagca

SEQ ID NO: 121014 - DNA, 372 bp, Homo sapiens
taatgattacctaaccagctactgtgtctggtatatgacccataaaggaaaaaagtggtcacaactgaggtcatctcagaaagaatagttttcctgtgtagttgagcgtaaattgttctccaagatgatatggagaagtggaagaatgtcttttttttggctttaggaaatacattattcattctctacagaaggactgattgacttttttcctgtatatgaggaacggattattaggcaaagatattacgtagtaaagtttacttaaactagggtaagattttggactgtgcctaatgatttggaagcttacttaatcactattctcaatagctacctaatgcccaagagtgtgactttgtagctaggatg

SEQ ID NO: 121015 - DNA, 722 bp, Homo sapiens
acacatgtcgggacaacctgtctgcagaaaggagctacccaccatgggtctcctcttcgctgagagccagacagatgttgggataacatgtctgcggaaaggagctacacactacaggtctcctgtccactaagagctggacactcatcgggacgatctgcctgcaggaaggagctacccacttcaagtctcctgagagctgttctgccactcaatgaagcttctctctgccttgctcgccctccaattgtccacatacctccttcttcctggatgcaggacaagaacttgggacctgcccaatggtggaactaagagagctgtaacacaaacaggggcaacgtccccctgctcgccatgttgcaggtgatgaggagagaagagaggcagctcttcggggagccagacctaggggctccccaagccagggctgtgacaccctctttggggctctgcagttcctggtgtctccaagtttctggatgccaccacattccccttgtctaggtgctggtgcctgcagcagaagccacttgtggtacatctgatctagcctcagccttgcacggaggcagcacccgtgccagggcatggagctgcctgccccaccgcagcagccactgtgcactggcctgcctgtgcacagtggccagaccccaagcttgctcgttcacaacccctcgccagtgtgcgcctggctcacccgtggcaggcatgggatc

SEQ ID NO: 121016 - DNA, 233 bp, Homo sapiens
atattcccgaggaagccactcccaatttccccatgaaatatgcaaaaatacagtaaagaatgatcaacaactacccttgaaagaccaaggttaataggcaacggatttccagaaagactcaaggattttataattactgagacaatcttagagcaaaattgagattcttaatatctctttagtctatacttaattattttatacaaaagtcctgtttttcttattctctctcc

SEQ ID NO: 121017 - DNA, 376 bp, Homo sapiens
taaaagagacattccaaaatgctggccaaatagagttacaaatgaacaaagactgaaaacatttgactactcatcaccctctctggaaacacttctaaaagatatactcagtgagggaaaactgaatctaaagggaagaagtaaaattcaagaagcaatggggagcaaaagaccataagcatcctggtaattctcatcactgaatgtaagaggaaaaaaaagtatggatgggggttaaaaaggagcataaataaaaggaagatgtgaggaagatgaaagttaaagtgtttaaggttcaggaaaaggaaactgatattattggattcagacaatcaaataggcaatgtttaaaagatgggggaggggaaccatgata

SEQ ID NO: 121018 - DNA, 181 bp, Homo sapiens
ttattaaagaaaataataaaatacacaggtagagttgtctttctacatttcatggtctgcaaatgtgtttgggtgtttaatacaacctagaaattctttgatgagtgccaagtaatttctttctccaattccactagtgattatttttaaatgtctaagttctcgtcaaaattttgaaaac

SEQ ID NO: 121019 - DNA, 468 bp, Homo sapiens
gcacgaggttgacaaagacaaagagagaatcttgaaagcagcaagagagaaacaactcatcacatacaagggattctcaataaggttcataactgatttcttatctgagaccatggaggccagaatacaatgggatgacatatttaaagttctgaaagaaaaacactgtaaaacaagaattctatatccagcaaaactgcacttcaaacttgagtgaaaatgtaagacattctcagataaacaaaagctgagggagtctattaccactaatcctatcctagaagaagtactaaaaggagtccttctggttgaagtgaaaggacactagactgtaaatcgaagctatatgaaggaataaagatctccagtaaagaaatctacatgggcaaacataaaagcaagtcttattaatttttggtctgtaacttgactctttattttctgcatgattaaaaagacaaatacata

SEQ ID NO: 121020 - DNA, 126 bp, Homo sapiens
tgactcctctcctagttttctctagccactgctcattctcctttaccaactctttttttcctgggggttgggagggaatgttgacattcccagggttttgtcacaggatagcttctcattctacat

SEQ ID NO: 121021 - DNA, 347 bp, Homo sapiens
aactgaggcaactgcatggtgggcttgtcacagccttccagcagctcatggtagagcctgaaccaagcagagaggtaagaactagaaaccagttaaaggtcaagagcttcacttcatgatagccaaaaggtggaaacagctcacctgtctatcatcggatgaacagatacacagaatgtggcatatctatacagggactattatttagccataagaagaaatgaatggccaggtgcggtggctcacgcccataatccaaccacctcgggaggctgaggtggatggattgcttgagcccaggagtttgagtttgagaccagcctgtgcaaaatagtgaaacctcatct

SEQ ID NO: 121022 - DNA, 278 bp, Homo sapiens
gtcaaggccattgagatccggcaaggatagaggttacaggaagggagtgctggggacagacactcaggaagtggactggtcaggccaggcgtggtaactggttggttgtggggggcaaggtggggaagcccaagatgatgtctgggctcctggcctcggataggtggggcccaggggagaagcacaactggagcaaggtggtgagttcaggctcagacatgaacctgggaaggcccacagcctggatgcacacatggcctggggctggatgagtgtgg

SEQ ID NO: 121023 - DNA, 480 bp, Homo sapiens
aaaacccatttctacaaaaaattgctgggagtggtagtatgcacctgtagtttcagttacttgggaggctgaagtgaaaggattgcttgagcctgggaggtggaggttgcaatgagctaagatatcactactgtactccagcctggatgacagggtgagaacttgtttaaaaaaataaataaataaaacataacaaaaacaactcttatttgtctcccagcaggggagaaagatggcagcaacttttattctattttattaaacagctatgttgagatagacttcacatactataaattctaccctctgaaagtgtgtaattcagaggtttttagtatatcacaaagttgtgcaaccattaccactacctgattccagatcaatttcaaatggatatctaatttgttaggagtgacaaggtcaccgaagacaaataagtggggtgaggtgacaacattgctagtttacctgcagtgatca

SEQ ID NO: 121024 - DNA, 249 bp, Homo sapiens
gagctcggcccttggtgcacgcaccgtgtagggccaacgcaccgtgttgggccacgcaccgtgttgggccaacgcaccatgacagagaccatttctttgtttccagtgctttctgcataagaggactaaataaacctgtattgaattaatgaaaaactgaggtcaagaattcttttttgaatgacctttcagggtctccaaacagtttccagtttactgggggaagttgtgtatgtatgggactcactg

SEQ ID NO: 121025 - DNA, 327 bp, Homo sapiens
  misc_feature (217)..(217): n is a, c, g, or t
ctatcaccctcattcaatgatgcccaattcatgaccaatcatttcgcatttctatcccagcttttcaccttcccccgatcattttgaagcaaaccacagagatcacatcaattcaaatatacatattttgatatccctaagagacaaaaatgattttttttttagagacagtatctcactttgtcatcaaggttggagttcagtgagccaagatcgnaccattgcactccagcctggcgacagagtgagactccatctcaaaaacaaaaacaaaaacaaaaacaaaacataagctgccatgtcgttggtaacctaatctcaaaagtg

SEQ ID NO: 121026 - DNA, 282 bp, Homo sapiens
ggatccccggtgtttatcgatgccacacatatttattatttcttggtttttcttgggagggagtttgctctgttgccaagactccgtttcaaaaaacaaaacaaaacaaaacaaagtttctaaatatatcctgggggacattaagtgacctattctcctgagataatattcgtttactctccctaactgcagtatttggtaataaccatgccacaggttggccttttgctttcagaaaacattgaatagcttagtccaaactttgcatactcatgacatgta

SEQ ID NO: 121027 - DNA, 327 bp, Homo sapiens
tgctcctttctggttccatcattatcccaaagactcacttggaacattccccttccaaatcaaggcaaaaattaatgagctatcattttccccataaatcttttgtgcagacactactgaatcagtgttcctccttgcttccaatcctaagggattctatatggttgaagtagtaagttccctgttcctggaggtgattaagcagaggctgtacgaacatttaattggttgttgtaaaaatgaatcccgcattgaaggttggctcagacaacttctaaagttccttccaatcccggattccatgatacaatgtgtttactgcaattg

SEQ ID NO: 121028 - DNA, 189 bp, Homo sapiens
gttggccaggctggtctcgtactcctgacctcaagtgatccacccgccttggccacccaaagtgctgggattacaggcgtgagccaccgcgcccggacactttacttaaaatgttctttattaaacatttttcaaagctgtgggttttttaattttttttttttttttacaaaaagtagagatggggtt

SEQ ID NO: 121029 - DNA, 384 bp, Homo sapiens
catgttagccaggctggtcttgaactcctgacctcaggcaatctgcctgcctcggcctcccaaagtgctgggattacaggcgtgagccactgtgcctggcttcaaaataggaatatgaatcaagaacttagactttctgcttgagaaaattatgagaaaagaaattgcagatataaagctgaagaaaagcttacttaagtccattttcttaccactactgaggtaacaaacaattgaaaagcagtgggtaaaattctaagtttttcaacaaagcttagcattttaaggaaaaaaaaaactgtattacaacattagagtttgcttcttcagatattcctcaggttacttttcaaattaatgtcttagaagcgttatgattgtata

SEQ ID NO: 121030 - DNA, 358 bp, Homo sapiens
gatgggcagtatcacgtgaggtcaggagtttgagaccagcctgaccaacatggagaaaactgtgtcttctaaaagtacaaaattagccagacatggtggtgcatgcctgtaatcccagctactcagaaggctgaggcgggagaatcatttgaacctgggaggtggaggttgtggtgagctgagatcacgccattgcactccagctggagcaacgagcgaaacatctgtcatcaaaaatgaatgaatgaatgaatgaatgaatgaaatactactatctccctgatacatccccaccctaagcatctgatcagacaggtagtgctggtggacagatggacagacacctaccccatatgtc

SEQ ID NO: 121031 - DNA, 499 bp, Homo sapiens
ttttctcaatgcgtaataaatttatgaagcattgtcacttgggacaaaagcaaggacactgtcaacatcaaaaactaaacgtgtaacagctcaagtcccatagcagtgtaatgggtgaataggggcacccacagccttagacagtactctgtgtgcaacaaactgaggcaagaaatcacaaaaaaagaggagagtcaagatggtcaaccagacacagtcaggacgatcttttgcccacaaagcagaccatcaagtagaacagcacactataaacagatctttggaaagcaggcactgacagtggaccgagaaaggatgcaggctgaaacgggagaaaggtgggaaccccacccaggattgctgaggaccaggactcatttctggccctgggtggttcccagggaaggggtgagtaagataggcatggagaggtccactgttgccatggtcctccaggatcctagctgcgggagatcctacagcccccatggacacttga

SEQ ID NO: 121032 - DNA, 717 bp, Homo sapiens
agctttgttccgttgctggcgaggagctgcgttcttttggagaagaggcgctctgatttttagaattttcggcttttctgctttgctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtccca

SEQ ID NO: 121033 - DNA, 800 bp, Homo sapiens
ttcggtcagttcctacaccccataagcaactactgtcttgattagaaatagaattttcatttacttcagtcaacataatttcttttagattagcccatgttgtatatatttgtagttcatttctttatcgttgagtagtattttatggtatcgtatatcagaattcatttatctgttccccttaactcttctgagtaaagatgctacgaacattcttctacagatcttttttgtgaacataagtttttatttctattgcttacatacataggagtaaaattgcttggtcattgggtagatttatcttcaacttaataaaaaatcatttttttttccaaaatggctatacagttttaaactcctaacattaacgtatgagagtttcagttgttccacatgcttgtattgtttggtgtcgtcagtctttaactactatagtaggggtaaagtggaatttcattatggctttattttgcttttctctgctgactcctgatattgagggtttttgttatgactttagttttgtaaaatgttaaattaggttgcctttttattactgacttattaagattatttatatatattctagttatggatccattgtcaaatatatttattaaattctcctagcctgaggtttatattttcgttttctcagtgatgtattttgatgagactaagtacaatttatctttttttcttttatgtttagtacttttgtgtcctaagaaatctttgcccaagtcatgaaaaatattattctgtatttgctttagagagcattagaattatagatc

SEQ ID NO: 121034 - DNA, 392 bp, Homo sapiens
agctgaacctcgagactgctcgccaaatgaggctggtctcgaactcgtgaccttgtgatccgcccaccttgccctcccaaagtgctgggattacagacgtgagccaccgcacctggctgctattttcttcttaaagtcattagtaatatctgccagaacagttttagtggagtgagagagccacagctggaatctagagaaacaggaagtgggaggtgaggaaatcaaggaatgagcaagttgtattctcctgagatagctgactatggcagggaaagagaagtgtaagggtgtgtatgagaaggatcagggttaatggtagtatgttcttaggttatggggtgagactgcctcgccaaatgagactgccacgccaaatggggatcctctag

SEQ ID NO: 121035 - DNA, 430 bp, Homo sapiens
tgtgaggactggttaacattgggcttctcctgttgcatccccttgcacagatgctgatatcagatggtcttgtagctgttaataccttgtttacatcagcttatatttggggttcataggatatctttcatctttttgtctagttttattgtagatttttaacaaattttggtttggctttcctaatttttttgagggagaggaggagttttgggcgattcagttttaaatctactatctttttttgtactttcttttttttttttttttttgagagagagtctcaaaattagtattattattcaattcaattaaaattaattaattaccattctccattataaggaaccaagactccctggagaattggctgttcccagggctaggttagggaactttcaagttgaccctggggattcgcccttgtcgt

SEQ ID NO: 121036 - DNA, 408 bp, Homo sapiens
ctgcagtgagttatgatcacaccacagcactccagcctgggcggcagagcgagaccctgtctcaaaaaataaaataaaagttgaatcacccacgttttagattatgagcttattaaaacttaaacaggctgggcgtggtggctcacacctgtaatcccagctctttgagaggctgaggtgggcggatcacgaggtcaagagatcaagaccatcccggccaacatgatgaaaccccacctctactaaaaatacaaaaattagctgggcgtggtggcgcacgcctgtagtcccaactactcaggaggctgaggcaggagaatcgcttgaacccaggaggcggaggttgcagtgagccgagatcgcgccactgcactccagcctggtgacagagcgagaccccacctcaag

SEQ ID NO: 121037 - DNA, 290 bp, Homo sapiens
cactccccacagggtgtattgggggctgggggtaagcacgtgtcatggggcaccaacgctggtcccctcaagccaagactccctggtgtggactcagctgtggcgagaggacagtttagcactgggaagttcatgccgcaacatggccttcttctgtagctgtgggtctagggccgtggagacctcttgggtgtttctcctgattctctgccagcctcctggggctgtgtgcacaggcgttggccacttagctcccttctagcctgggccgaggggaaggctcatgtcct

SEQ ID NO: 121038 - DNA, 354 bp, Homo sapiens
gaaattaaatatagtctattttgggctttccagatctaaaaaccctttaaatgcatgtgcacacacacaaatatatacacagctagttttctgccatttattcttagggatggacacagtaaaaacatctttattttttacatcttatatgccatctgtctagaattttactagatgaagcatcaatgttaccatctctgaaatccatatgttcttattgaaagcttaaaatttgtcttctctgtagtcatttatcatcttttcaggggtctacagtttctcaaagattaataatactaccagatcttctagtagctactttgatatttctttgtttgagcctagttaaaaaaa

SEQ ID NO: 121039 - DNA, 717 bp, Homo sapiens
ggtttttattttattaaaattgtttaaaacactcttactttgcaaaataaaaagttgccagccctgtttttctcccagtcctgtgtctcgaagctgcttctttgtccgatgcagatataaataaggcgctcttaccttatgccgcttcaacaagtccctagctgcgctgagctatgattgcaccacttgccctccagcctgggtgacagagcgagaccttgtctcaaaaacgaaacaaaacaaacaggaaaacaagttcctagctgaacttacctcctctgtgagtgtaggggtgccaagtaggggccagatgctggggatacaagagaacagcagagacacaatttgcaacttaccatgcttctcagggagaagttttttccagcattctatgggagttccagttacttcctcaccaatgcttggtattgtcatgcttttcaattttagccattgtgaagtgatatcttctagcattttttccttactgcttctctaatttcagaatcttctagtattttaaatttgcatttctctgttggctaatgatgtggagcatcttacatacttattggccatatcatcttttgtgatgtgtttgttcaagcttttggccatttttaaattgggttgtttgccctttaatgattgattatgagtttttttctgtattttggatactagtcctttataaggtatctaatgaaatattttctt

SEQ ID NO: 121040 - DNA, 370 bp, Homo sapiens
tagggagcctgcatgcttgtggatctggtccgtcgttatggtacgtctatgtcgtgggatacttctggctgaagcattgctcagtaaattgctgataaatgacttccatctggaatatacttggtcagcaatttaggaagccatgcagatttattttcaagaaactcaaactacttttcagacccattacccttgtgccaactaagtaaaatcccccctgctcctattctttgggagtcctgaaccgtagcataaaggaattcacaaaacacttgcaggaattaataattgcattctcgctcttattatgcaaagccttattagggcagagaaattaaggtttccataaattacagttccagaaggtccg

SEQ ID NO: 121041 - DNA, 176 bp, Homo sapiens
gttaatatggcttagtgataattgagtttaaaaagctaggggacagataaaatctcaggtcattcataagttttcagattgtgcacaagcatttacaatgatcatggggaaggagtaggaatttctcaggttaacagagaagtgcaaacagtcatgagacagaccaacagttttct

SEQ ID NO: 121042 - DNA, 587 bp, Homo sapiens
catggtggctcacgcctgtaatcccagcactttgggaggccgaggcaggcggatcacgaggtcaggagatcgagaccatcctggctaacatggtgaaaccccatctctactaaaaatataaaaaattagccgggcgtgatggcgggcacctgtagtcccagctactcgggaggctgaggctggagaatgtcatgaactcgggaggcagagcttgcagtgagctgagatcgcacgactgcactccagcctgggtgacagagcaagactctgtatcaaaacaaaaacaaaaacaaaaacaaacaaacaaaaagccctctgttatttactgtcctgagattaggaagtcaagcctaagaaacactctccaccaggtttcacctgcagtccctaggaaaacaagcaggtatacacttagacttctctgaaactcttgttcctaattatagtctcaaccattaatattaatcataactgctaacccaaagctttaaacagtttattgcatttacttgcacacagaaacttattacaaacttccttttttccttaattaatttcaacaaaaaataaaaacttaacgcgctgca

SEQ ID NO: 121043 - DNA, 500 bp, Homo sapiens
ccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattt

SEQ ID NO: 121044 - DNA, 445 bp, Homo sapiens
ggaagcagttatatgtatttgtctcaggtgagcctcagagggatgactgtgttctgtttgtcctttgtcaacaaggaatttccttgtgggcaaattgtgagggagatatgtagctttttatgtttgtaactatcttatttaggaataaaatgggaggcaggtttgcctgacacagctcccagcctgacttttcccttggcttagtgattttggggtcctgagatctattttcgtttcataaacttcagtaggatcactctggctgctgtgtagagaatagggtagaaagaagagaccagttaggagactacagaagatgtgattaaaatttggatatatatcggaggtagaactgaggatcttgggcccgtgctacagaaagagaatagagctgttattaattgagaatgaagaaaactggaggaacaggttttggtttcttttt

SEQ ID NO: 121045 - DNA, 673 bp, Homo sapiens
agcggcttaatttaagattcagcatttatatttcaggaagtgacttgaaccaatacaggatgtggaggtctgatttgacagtaatctacataaagaaaacctggggtttgtgttgaccacacagttggcttgatgtgaaccaactgtgtggttcctctgctgaagaaattaatcctatataacaaatgccccaaacctaatgcaagtgcaacctgcattaacagaggattgtccagctcttaggaagttatagtccagctgctcttcactggtagaccacatcttaaaagtaatattaattcttcagagagggtcagccaagatggtcagtgggtctggaaaccatgtaacattagaagcctggtgaaaaagaggagtcggggacatcctttctatccaagaacatttaaaagggatgtcatgtaggaaaaaacagtagttttcctgtggttaagttggccgaaataggttaaatagatgcacattttagctaaatggacacgagattcttttatttcgaactaccagtactattcagcatgttatgggtttcattaggatgtagttaattccctggtttcagaagtgttccaacatagaattcatttaacagatctttaatgagtactattatgtgtcagacactgttctaggtgctgaggatagactgaga

SEQ ID NO: 121046 - DNA, 538 bp, Homo sapiens
ggagtgggccatttcctgcaggccccaatactcccatgccagtctagctcagcaggcagagaagactaacccttcgtggggctgggtgcggtggctcacgcctgtaatctcagcactttgggaggctggtcttgaactcctgagctcaggtgatctgcccgcgtcggcctgccaaagtgctaggattacacccataagccactgcgctcagcttaatttttaaatttttaactttttaaattgtctttagagatgagatcctgctctgtcacctaggctggagtgcaatggcttggtaatagctcactgcagtctcaaactcctggactcaaatgatcctcccacctcagctttctgagtagctaggaccacaggtgtgcaccacctgtgagacagagtcttgctctgttgcccaggctggagtgcagtggcgtgatctccactcactgcaacctctgcctcccaggttcacgccattctcctgcctcagcctcccgagtagctgggagtacaggtgcccaccaccacgcccggctaa

SEQ ID NO: 121047 - DNA, 838 bp, Homo sapiens
agagaatgggatgatatatccaaggtgcagaagaaaaaaacttgctgccaaggacattatgcccacaaagctatccttcataaatgaaggagaaataaaagtctttcccagacaagcaaaagctcagggaattcatccccactagatcagccatacaagaaatacttaagggaattctatacctagaagggaaagaacaataactaccatgatgaaaatacatgaaaatattaaaaaaaaaacaacactgttaaataagatttgagataaaaactcaaatgttaccactacaggatactaccaaaccacaatgatgaacaataagagagaaagaaaggagcaaggatatataaaacaaccataagtcaaccaataaaatgtcaggaataagtcctcacatatcaatagtaactttgaatgtaaatggattaaattttccacttgaaagatgtagactggtggaatggattagcaaaacaaaacaaaacaaaaaaagaaaacatgaaccaagtatatgctgcttacaagaaactcatctcagttgtaaagatacacgtcttgaaagcaacaggtggaaaacatattctatgcaattagaaacaaaacaagcaggaacatgggaacacttgatatgttatgtaaagcaaatattattagatctaaagggagtgatagactccaacacaacaatagctggggacattaacaccccattctcagcatcagacagacatctagacaaaaaattaacaaagaaacattggatttaaactgtacattagactaaatgtacctaacagacatttacagaatatttggttgaacagctacaaaatac

SEQ ID NO: 121048 - DNA, 212 bp, Homo sapiens
ccattttctgttgaaattttccatttttttatccattttaaaaaaaggtcatttcctctaatttaacatatttttgatagctatttgaaagtccttgattgcaaatttcaacatctagtcacttacagttctgtaatctgcttctttcttgattgtgagccgagactggaccactgcactctagcctgggcaacagagcaagactctgtctc

SEQ ID NO: 121049 - DNA, 169 bp, Homo sapiens
ttgggtcacaagtcacagatggaaaggcatgggccacagtgggggactgggtcccttcttggcaagaacccaccgggacacagtccctgcctgtcattctgccttgctggctgcaggcccaggaccaccggccagaagccatgagagatcagggcaggacacgggcagc

SEQ ID NO: 121050 - DNA, 592 bp, Homo sapiens
acctggctaatttttttgtatttttagtagagaaggggttttaccgtgttagccagaatggtctcaatcccctgacctcctgatccgcccacctcggcctcccaaagtgctgggattatgggcatgagccacagtgcccagcccagatttttgtatttttagtagagacagggcttcaccatgttggtcaggctggtcttgacctcctgacctcaggtgatccgtccgcctcggcctttcaaagtgctgggattacgggcatgagccaccgcgcccagtgataaaatataactttctcagcagggcaccaatgccctgtgcatctgcccctaatccccttcttgtcaaccctgcaggcgctctgcactgttcctgcaataagaagcatcttctctaccttctggcctttgcacatgctgggaccaccaccaagaaggctcttcttgacctcctctaccagctaattcccactcgtcctttggatctcagccaaaacttcccttcctgctgcccctagaccagggtgtttcttccattacccaccccacagcaccacagcacctgcttttttttttttttttttttttttttt

SEQ ID NO: 121051 - DNA, 242 bp, Homo sapiens
catgggagtcaggcccctgcccttgagtgggctttgtcgcttacatgaagtcgggctgttcatctttccttgttgtggcattggaactcagccaagcagcagcgatttaggaggggcagtagccgcagggtgccgggtttaatgggaaagatgctgtttacttagaatatgtgttcatttggagtggctttggggcttaccccaggccaccccttaggaccaccactgattaggggtcagaa

SEQ ID NO: 121052 - DNA, 265 bp, Homo sapiens
gtgtgtcgagtaaggaggactacttctgtcatttgggtattggacttctatatccttgctggtctcaaaactcctggcctcaagtgatccgcttgccttggcctcccaaagtgctggtattacaagcgtgaaccaccacgcccagccagaagtaagttttatataaagaagagatcttaaattttttgctaacttattttatattttagcaaattatcattggtgtgcttagaataacattaatgatgaggctaaaatttaagtg

SEQ ID NO: 121053 - DNA, 207 bp, Homo sapiens
cacgtggtatcttttttcgtccaactgcttattttagaaacatactgattttggagtgagaattatttggaaaagtcgttaagatatttagcctttcaggctagtctataggcaaaaacatcgttctgagaaggcaacaatttctgaggatttatgttgatgacaatcatgttgaaatttgtgttagttaattgaaccattttcata

SEQ ID NO: 121054 - DNA, 104 bp, Homo sapiens
aatgaaagggagaatgggacagaagaaatacctgaataaacaagagcaaaatacttttcaaaattggcagacggcgtacatttcagattcaagaagtttagtta

SEQ ID NO: 121055 - DNA, 227 bp, Homo sapiens
cccagccccatacccagctccaccaagatcctcacttctttcatcatttgcccatttttccccaggctatgtttgatcttgctctgaggccttctttcttgggaggtatagcgagagtagctgcagaaacctctgggtggcaccctgcccccacaggattaccaaagaatgacatgtgtggaagaggctcaggcctgtgttggcaggaagaagtgactcatttttca

SEQ ID NO: 121056 - DNA, 192 bp, Homo sapiens
tccatgatgtgcaggaggctatcatgcctacttacatgatattctgaaggaccatgaaaatgtttcaatttttttaatcaagagcaaaaatgaattcctctataggcacaagtgtgtttgtattaatattatgaatataaaaacaaggctagccatggtggctcatgcctgtaaccccggcactttgggagg

SEQ ID NO: 121057 - DNA, 252 bp, Homo sapiens
gatttgagtttgcttttgcgaggtgcctgggcatttgaatcaggtaccgccttaaaacaagttcaaggcttgggattccctgatatcctacatcatttgagcaggaaggtctctcgtcagatatcccactttgtgtgggcctgactttgtatattaactttctgtgctgtaaagatgttttaaaaattttatcagtgttttgttttgttttgttttctctaggaggttgacccaaataatatagcctgtttt

SEQ ID NO: 121058 - DNA, 480 bp, Homo sapiens
cagggatagtacccctaagtttatttagtagttccttaaaaaatagttatgtcaattcctctgctgtactgattttctctcctgaatttgttctaccccatttatggattaactgaatacatctagcagatttagtctgaccaggccagataagaatctttggctgctttattctaaaatgcactatgcagtgtttcagaaagtacacccagtgtcacataagcttttttagaggccacagaacccatgatctgttaatactttccacataggctatggttggttctgcatccccatcctttacttggtacttgggcttctttgtgcacaaggacaggaccttataactatccctgttgttggattcactgtaattgagggtttgttttctctgtatcactcttcagcattacattgttaatcacagcaagtctgtccctttgatcatcatcttgctctgtatgtaactaaagtatcttt

SEQ ID NO: 121059 - DNA, 766 bp, Homo sapiens
aaggcaacaaggatatgtgccactttcaggcttggcccatagaaaccttacatgagtaatcctttttctccatatggagttttggagtttaatagagcaatttctgagtcctggtggagccacaagatggaaggaaactagatccctgaatgaccacatgggaagctgtctgctaagtaggaatatctacattaggctttgcagtagtgaaaagtatgttttgttaagccattgggatctgggaatttgtttcattgcagctaaaattacttgccttatatggaaatatagctggcaagtccgaaggcttattttatggaggggaaaaactgtgggtcattgaactaagggatgccaggcataaagtatagataccatatcaaaaacaagggacttaagtgactgtgtgcataatgcatgctatacactaaaacctccagccctcttcccctactttgaccacagaatgctgtcaggatctctgtgttccaagcctgaagtgggaagaggcttctctagggactctaatctccagccaagaagacagattcaaagattctgataatgggagttttctaacacatggtctgatcaagtcaatgctaacgggctgcattgcttggttgagagcttccagtgagtttcctcattcctcacttttattcatacaagcaacaaggattatcagacattaggaaaggttctgatatgaaatacagagaccacaacaaacaaacagaaggaatgcaacttagaggaagaagag

SEQ ID NO: 121060 - DNA, 398 bp, Homo sapiens
  misc_feature (238)..(238): n is a, c, g, or t
agccccagtggactaggataacaagcatcgtcctacaatttctaatttggctttgaatcactgttcctataatctccagcttgccttctttcctccagctgcttattttctccaactagcatttcacaattccttcctacgttcgttcactgaatacattcaggctgaaaaccaagtatctgctacaatgctgctgctacaacactgagcaagacttgggcgggttatggacacactnccactaagtgctatgaaaggagtggagtgggctggccatgggaagggtggcaatgtgggctaagtggtagaatttcttaccaaccatttaacttctttctagtcccatattcccactgtcttaaatttgtgagtttatataatggtctatactacctgta

SEQ ID NO: 121061 - DNA, 235 bp, Homo sapiens
catgaaatcaccccctcaatcaagataatgaacagaaagctggaggctgagtgagctacacctagtccagcagcctttaccaggtccaaggtaacaggatctttatctataatcgtctctgtgttcctggggcagataactgtgagagaactaacagcaaggtgacttgcaagctaagaaataaacagatttctttcttttctccttttcgtttttttttttttttttttttttt

SEQ ID NO: 121062 - DNA, 766 bp, Homo sapiens
atgcaatgcccagtttcacatatgtttttgcatcactgtctctttttttcttgagcttattccagagtgtcttttaatatccattccatgatcaaatggctgaactattaaaatgctgtccagaagtgtaaagcaatatgaagatgctagaaaagttgaagagacacatatatggtagtccaagaccattacacttactgagtccattactaaaaatgatgttcacttaacatcaaaacactcaggattacccaagcacaatatactgatttgcacctctgcctttgttcatgccccttgttcaggagaactgctttcatgtgctactgtccatagatcttctctatccttacagattaatttcttccttttgaatgctatgtttccatactttgacattccttctgcaccattcagaccatattttagttcttttttatggtatctctcacttttgattgtcaccccttaagtcaaagacaattttttcatctgtgtcttctcaacacccagcacagggctatgtttggtaaaaattaggtatccaagatgtactaaatgaaaaaatcaaagaagcaaaaatttttgaaatttcaaatgagcttataaataagctctgttatgtacttattgtaagaagtttgaaaatagagaaaagtattaaagagaacagaaatctctaaaaaatcccaaaataaccacctcaggggagttcttaagttagaagccacatctctcatggtacccctgttgatctgcaggtctc

SEQ ID NO: 121063 - DNA, 609 bp, Homo sapiens
gatacaaatagacatctcatgttcatggattggaagacttaatattgtgaaaatgtccatactatccaaagttatctgttcattcaatgcactccctatcaaaataccaataacattcttcacagaaatggaaaaaacaatcctaaaatttgtgcagaaccatggaagaccccaaatagcaaaagcaaatcctgagcaaaaggaataaagctggaggcatcacactaccagacttcaaaatgaaggcaatagtaatcaaaccagaatggttaaaaacataaaaacagatatgtagaccaatgagacagaacagagaaccccaaaataaatctacttatttacagacaactgatatttgacaaaggtgccaagaacattcataggggaatgataatctcttcaataaactgtgccaggagagctagatatcaatacacagaaaaatgaaactggactcctatctctcaccataaaaaaggtcaattcaaaatggactaagaacttaaatgtaagaccccaaactatgaaactaccagaagaaaacacaaaggaaatgcttcaggacattggtctgatgaaagattttatggagaagacctcaaaagccca

SEQ ID NO: 121064 - DNA, 451 bp, Homo sapiens
tgtcagccacagccctcaccacacctgccttctttttggggtgttctcaactttcctgatgagacaaagcctttccagctcactctttagcaggtagagggggcagttagagcatgcaccgtgctcctggtactactgccgaaccacgtaagcttgccccagccaaaagcagattctgtttgctgggcaccccctgccagtccctgagctcagtgctttgcaaatataatgcaatttaatcttcactaaatccagtgattgcaattttccagatgaggaaactcagggaggttgagagacttgcccaaggtcacacagtgacctggattcaaaatcctcttgatctgattctggagcccagctcttcatcactcttccgttcagtccctttccacgcccctaaacaggatgtaatgtggcaggaagacaagttgagacctgtgtctgagct

SEQ ID NO: 121065 - DNA, 255 bp, Homo sapiens
gtgtgctcttgagcctgtgtttagatgttggcgtggctggtggcatcactgaatggctgtgctacaggggtcttagtacacagtgagcgtgtgtatgaccgctggtatctggccatgtgtttgtcgagatgctacagccacgccaacatctaaacacaggctcaagagatcgagaccatcctggccaacatggtgaaacctcgtctctactaaaaatacaaaaaatagctgggtgtggtggcacatgcctgtagt

SEQ ID NO: 121066 - DNA, 559 bp, Homo sapiens
catggtggtgcacacctgtagtcccaactactcagaaggctgaggtgggaggatcatttgaggccagaagttaaggctgcagtgagtcgaccctgagccacttcactgcagcctgggcaacaggaaagaggcccttcttaaaaaaaaaaagagagagaaattttaaactatttttaacatatcccacacattggaatactactcaccaataaaaaaggaatggaactgattaaatcatccaataacagagatgaatctcaaaaaacatcatgttgagtaaagaagccagtcactaaaagctacctgttatatgagtccacgtatgtgaaaaatccagaaaaaacaaaatcatagtgacagaaagtagatgagtgggcctgggcccaaggtgggagtggtgaccggctacaagggagcatagggcccttctaggtgatggaaagtgttgtcagacttgtctaggagttggctgcatgcccaggacttttaccgacattcaccaaagtgcacacttcacgcaggtgtattttatggtgcacatatctcaacaaaactgttt

SEQ ID NO: 121067 - DNA, 593 bp, Homo sapiens
gggttggtgttcatctgcttgcagaggaaagccaggtacttcaacttatttctgtagaaattgccagaaatgttgatgccctcacagcgtacgaccaccaccttccagcccaacattacctgcttagccacgatggccgccaggcggcccaggagatggcctcgaccatggaggactgggacctgcacctccgccatcttcggcagccgcctgggaaagcacatctttttattgttctaatcgttaacagataaggaaagtgccacaggcactggtactagtaacaatagctaatatttctatgacatgtattgtcacttaaaaatagtattaaggcaaaaaattagccgggcgtcgtggcgggcgcctgtagtcccagctactcaggaggctgaggcaggagaatggcgtgaatcggcgaggcggagcttgcagtgagcctatatcgcgccactgcactccagcctgggcgacaaagcaagactctgtctccaaaaaaaaaaaaaaaaaaaaaatagtagtattaaaggccgggccctgtggctcatgcctgtaatcccagcactttgggaggctgaggtaggtggatcacc

SEQ ID NO: 121068 - DNA, 213 bp, Homo sapiens
cagcaggtgcgtaacagtaatggagaaaagtcactgatacatgagtccaagatgtcatcacagtacccttataaggtactgcaggacatgttaaaaatagtgtggccaatctcaattacagtaaatgaatgctatcttattaatattatatgataatattaaatgatgttagtaacatttaatgtaatataaatagacaaaactgaaaatgtc

SEQ ID NO: 121069 - DNA, 309 bp, Homo sapiens
gatcctcttccccaactgggtaccgagcacaggaaatgccatcaaatctacagtttagcatggaagacaaacagatgtaaacttgtcatcttgacttatgatcatggtagaggtctgcatggaccactgtgagagatagagaggggagcaccacttcagccttcgagaattaggatgccttctcaaagcagctgaccttgggtacagtcttgaggtttagacgtttgtggggcaggggagggtatttaggaagtcccactaggcagagggaacggtgtatgaaagtttcatctgactacatatgagagt

SEQ ID NO: 121070 - DNA, 375 bp, Homo sapiens
ccctccttcaaaaccgtctcaaatacatcactgtgccataattctgctgctgtcaataagccagtggcagtgtttggcctgctgtggctgatggagtgatttagtaatcgtctattggcctccttctgtggcccacagcctgtgctaggggctccggctgtgtcagtgaatgaaacagtcccaaatacctgccctcctgaagctgacatccttgtgaaggttttcctaaaaattcttcactctgaaggtttgtggtgcacttcttcattttgcttatcactgaaggaggcagagaggaggctgttactatctcaagaactttgcaaaaggagtttggttttatgtttagaggcttcaagcatacattcactcatt

SEQ ID NO: 121071 - DNA, 346 bp, Homo sapiens
ggagaatgagaaggaccagctagagagatgcaggagaaaacctaagaggtattaactaagaagcacaagagtgttttttcaatgagcattaagtagttaactatgttgaaaactgctggggggaaagataactgagaagtagctacgtaatctggcaatatggagaactggtgcctttaacaaaagtagttttggtgggagtagtagaggcagaagccttactgaagtatgtacagaattagaagtagggaagaaaagaaactacaggccgggtgtggtggctcattttgggtggctcccagcactttgggaggccgaggcaggaagatcacctgaggtcaggagt

SEQ ID NO: 121072 - DNA, 818 bp, Homo sapiens
cgctcctcgtcaggaggagggagagcaacgggacttgctggttgggccctaacctccacaacccctccttctcgcctcgctctttcggcttttcccctcagccctgacgtacgaccgggagcgcgcccgcaattcacgctcagagaaagccgaagatgagaggtggccggggcaagagaggcgggaacaaagttgccggcactggcgtgctcgctcccgccagggccggcaggccgcaccggaagtggcatgatgtagaaaccgctcggcttccggcgagggtgggactccgtgtgaagaagggttaaagaaaggagaggattcgtgtgccgcccactgctgttgcttgagactctgcccgtggtggcgcgcctgtcgtgcttgttgcttgcgtccagcgcgcagtgccggttccggctctgcagacgccgcactgcctgcctgttgagcgaaaggtcacagtgagaacaagtgtttctggagactgcgagggaaataatgctgttggtggccttctggagtaggcagttaccccccgtgtaccttcagtcaagccctgggagtggaacagctgcgaaaggagagaaaacaccccgcaaaacagggtggagatggcgttggtttaacttgtctcacgtacgccaaagttcgaggccccattttttttttttttttttgagactgagtttcgctctcgttgcccaggctggagtgcaatggtgcgatctcggctcaccgcaacttccgcgaggccccttcttatcctaaaaaacacacttgggaatcacagctcaagcttcggtaacactatttacttt

SEQ ID NO: 121073 - DNA, 602 bp, Homo sapiens
tcactacaccatgcacacttcacatcactccaattaatctgaagaacagtgctacgagatggtattccatacccccattttataagtgaggaaactgaggctcagaaagattaagtactttccccagaatcatccaatttgttgctccaaataaaatccaggtaagagccaggaacagtggcatgcctgtagtcccagctattcaggaggctgaggcgggaaaatcatctgagcccaggagtttgaggctgcagtgagctatgataatgccactgcactccagcctgggccatagagcaagtcctgtctcaaaacaaaaagcaaacaaccaaaaaagcctgcaagtatgtctgactctgaattagaactctgataatgaggcttttttcatcaagtgcctaccttaacctaattaacacaacttaatgcagcaaacaaataaactattgcaatactagaattgggaggcaggccggttgtggtggctcacgcctataatctcaacactttgggaggccgaggagggaagatggcttgaggccaggagttggaaaccagcctgggcaacatggcaacatagtgaaactccacctctataaaaa

SEQ ID NO: 121074 - DNA, 346 bp, Homo sapiens
tgacttctctctttttcttataccctacatcagtccagcctttgcacttgaccttcagtatatatcctgaatctgaccacttcccattatctctattgctgtcgctccagtccaacaaagaattacttctcagcctcctaactgaaaagaggaggacttctagtcttctcttcttgcactctgtactgtcaggatatgcttggttatgctatggtaaccctcccaaatcttcgtgatttatcccaacaaagtgattaaagggatttcttgctaaagccacttgtctgcaggtcaacacctccaccctgtctctcctcactctttggacctaggctgtggtggcctg

SEQ ID NO: 121075 - DNA, 227 bp, Homo sapiens
ggattcctaccttggccagagtggaccagtgctaaggagggatagacaacactctgtccaggtttgtgaatgcacagctctgtttcttcagattttgtgtttgtgttgactgttattgggataaaagtcttctatccagagaattcattaattgccggatctttattgtaagacagttggtggatgtcacttgggcagccccagtgagccatacttacagttttcac

SEQ ID NO: 121076 - DNA, 558 bp, Homo sapiens
ccttcctctctacgacatttttagctacactcgccttctgtcacacctccaaaataccatgcttcctcctaatgctgggcggttctcctgcctcagtaactggaattacaggtgcataccaccacacctagctaattttgtatttttagtagagatggggtttaaccacgttggccaggctggtctcgaactcctggcctcaagtgatccacctgcttcagcctcccaaagtgctgggattacaggcatgagccaccgtgcctggccagcaacttgctttctaatgtagaaaaaaaaaaaaaagtcatctgaccaggtccagacttggacggggactatacaagggcatgaatacaaggatgcatcattcattaggggccaccaatgtgacagtctacccacatggagcaacaggccttctgaaactctagaacacaattctggtctttaagactacaaaatagctgaagcatgtaatctttctgcctgatttggctacttctactctggacacattcctgcttgagaatcttctataactctttttttctttttttt

SEQ ID NO: 121077 - DNA, 496 bp, Homo sapiens
acatgcattctggatgctccggcggcgtcactcactacggcatcggaatgaataggagttctcacttgtgtgttaagaatgtgcacttaggcctgttaaaaaattatgattacccccaaaatggtgggcttgtatgaccttttacatttttaaagtaaagccttccatctggttaaaaaataccttttataaaagcccctttacggtgtttgtgttccttagtaaatgctagatttgttccttagaaaatttgctcttgagcaagtctattttgacctgatgtaattgaatccaaagggagaaaaacattaaattaatgaaattttattgaaaagacatcttatttatatgtaatagtttggtgtcttaattattattattctcccaagttatattatagttttaaacttaattttcaaaaaaagacaactttcagtcacctaattacatgcaatgcagcttcttttcagaagtaataccttatttaaagtaattc

SEQ ID NO: 121078 - DNA, 360 bp, Homo sapiens
ctcttttcacctttctcttctcaaggtaaacttcctctgtgaaacctccgctgatgccctgcagcaaggttgaccacttcctgagtgttacttcctctcttggtgcatatgtctggttgcactaaccaggctgctgctagcccaaaggcacctttgtgcaaattagaaaaagacaaccatccccatcccttcttcaagatactttatagtacttccaactgttggcaaactgtcttaataaagatacaaatctttgatttctctaatgtgcatggtgccctacaagggttgtgcagtgcatagccgtgcagttgcatgtgatagatctatgttataattatttgtttaattgtctgtatt

SEQ ID NO: 121079 - DNA, 1565 bp, Homo sapiens
ggccaagctgatttcaaactcctgacctcaagtgatctgcctcctcagcctccaaagtgttgagattacaggtgtcagctaccgcgcccagccccatcagccccctttaatctcttttctgcactatctccttgcaaagcaggctgttaaacatctctctgacctccattggttaaataatactaatattttaagtcatttgattattcagaatcctttcgatacaaaatttaaaaaggaaactaatttaagttagccttaaaagtgaattgatttgataaccaaaagagcaatgggagaatggcctttggtcagctagtgtccttgtgcttctctctgctttaaccttgctgtgtgctggcttctcttatgacagcaatggctcccataggcatttacacacagcttgtggaaaaataagggtgtccttctttcattaccaaggagcaattgtgtgagtaattttgctttcaagccaatccatgaaacagagaggattaggatgacaagtgaattattaaataactttcagagaagttgttttttatacaatacactaaaaataatataaaaagtacctatttattgaaatctagaatcaactatttttaattttgttcacacttgttttaactcctggttttaaaagacgaatattccacataaatacgagatgttgactcacacaggctcccttccttttacaaagagtgtgatgggaaaatcccaggactgtacaggagaacatccctcaaaaactgggaaggagctgagagaccaaagaatgacttgggcaattccagcttgaggagtagatgagttaattaggattcaccaaacaggacattctcgggcagcatcaggagaactctagagatccacccaccacacgcctctaagctgcttttaagctcgattttgtggctctttggctgccgcatgtgatgagactcttttccttggtatgttcccagatacactctaggatgtttgggttctcagggacacctgctcctcagctgagcaccgtggccttggctcatttcccagcttttagggttcaagcagcgtacatacagccttaagtaaactggtaggagaaacatcaccctacaaaggaacatattatttttactacataggcaagcttgaaaaaagcatagagatgattctagctgcaagaaattgaaaatcagtttcgaatagtaaggacaaacgattatctgacagtctatgttattttcagacccatgtatattccctgaggggatgatgtctgtagtttgaaagattcacgatggaattctacttctggctatgggggacttacttttatcacaccaacactctcgttaaaaacatgggtaaatagtggatatttttcaaaatcatctatttgaaagtatctaagaaacatcaaagcaactggatttagagaagccaagattcaagatagaaagccaccatgtttgggtgagtctagcctttaagaccatctataccttgaagcgtttgccaattcgtaagtaacacaggctgcaagcccacccagaaagaagaggcta

SEQ ID NO: 121080 - DNA, 289 bp, Homo sapiens
ggttgcagatgctgactacagcaaagcaaatccctattgctgatatgattttgacatgatactacacaagttaccattactggaactggctacaggggaataagatatggatctagttaggaaaatgaagcaaaaggtagggccttcatctcacaaacaggaagccattcaatcattaaatctagggcagatactcagagatggactgtggccatgacaatgtgatgctgagtcacctggccatgcatggatcttcttcaatacctggtaagaacaggactggtcccag

SEQ ID NO: 121081 - DNA, 433 bp, Homo sapiens
atctgtgagaagtatgcgttgagatcctctgtctgaaagaaattgtgttcaaagtgttctattacactgttatttggagcatgccattggaaaacccacccccaccccccctcaaaaaaacagaacagtaaaccaaaatgtgggccatgaaattagcaacctgggactcaataatacacttgggaatattcttccacaccgtccagatttcatttgatgttgttcacattgcaagagtaaaacttatttagagctacagaagacaaaaccctgaagagttaagaacaaacgcaaggaaataatttttattgtttaaagcccggaatgactgtaactttcacacaaggtacgcatctatgtttttgggggaggtgatgtagttacagctgactaatatttttaaaataaataaataaatttggcctttaaaact

SEQ ID NO: 121082 - DNA, 373 bp, Homo sapiens
agcacgcggctcatctgcttgggtgcccggcttctcttagcttgtggcctgtgtgctcctcattttctggctacctcatgaatccattaaataatattgtctttcctcttttatccaatattgacagttaggtttcagggagaacatgagtcgggtatctagctgaccacactgccagaaatagaagtctcacctgtgtgcacaccaagctggagtacactggcgcaaccacaactcattgcagcctaggcctccccagctcaggagatcctcccacctcagcttcccgagtagctgggactataggtgcacgccaccatgccctggcaatttttggtatttttagtagagattgggattttgccatgttgcc

SEQ ID NO: 121083 - DNA, 808 bp, Homo sapiens
agcgtggtgaattccagcttcttcctgaccctgagcccacccccaaggtggccctcaacctttaagagtgggagagcaaaattgacggcttcgagcgcttcaccaagaagatggaccacagggcactcagctcaacttctcagccaatgagttgacatgcaagcagattatggtgacgggctttaagaaagagcatcagaaggtggccagctcttcagcctcagccaggtcttggagctggaccaggccatcacttcaccagagatgccttcaacaccgtcggtgagctctttgccaatcagcccagccaggaactggacccagtcatggacctgttagtgctgtctctgggacaccaggtcatcatcctggacatcatccacatacacaaggaagctcttaccaaagtcatggagagcaggcaacatgtggcagaagggaagacagagatgcagaggctgatgacatcagaatcacaggaacaggatttctttggacactgtggctgaaattcaccacttccatccaattccagtgagaaacatggactcacagatgcagcatttcttgcaacaagagatactattttttcaaaaggtcacccaggaattgatagtgttgaatgactagatactcgattgtgcactgtttccagttcaaggatgctttctacagcagaataataacactagcaaagagatagtgccaggtattggcggtagtacaaggatggctttgttctcaattgaaactcggctgaacatagaattgtgtaggaaacagttaatatggcgatagaatagaaaca

SEQ ID NO: 121084 - DNA, 686 bp, Homo sapiens
ggcagtgatgctgctgtcgatctaaggatcccggtgtttatcgatgccttctgacgggctttaagaaagagcatcagaaggtggccagctcttcagcctcagccaggtcttggagctggaccaggccatcacttcaccagagatgccttcaacaccgtcggtgagctctttgccaatcagcccagccaggaactggacccagtcatggacctgttagtgctgtctctgggacaccaggtcatcatcctggacatcatccacatacacaaggaagctcttaccaaagtcatggagagcaggcaacatgtggcagaagggaagacagagatgcagaggctgatgacatcagaatcacaggaacaggatttctttggacactgtggctgaaattcaccacttccatccaattccagtgagaaacatggactcacagatgcagcatttcttgcaacaagagatactattttttcaaaaggtcacccaggaattgatagtgttgaatgactagatactcgattgtgcactgtttccagttcaaggatgctttctacagcagaataataacactagcaaagagatagtgccaggtattggcggtagtacaaggatggctttgttctcaattgaaactcggctgaacatagaattgtgtaggaaacagttaatatggcgatagaatagaaaca

SEQ ID NO: 121085 - DNA, 630 bp, Homo sapiens
agggagcaatgcagatgagtatctaggttctggaagagcaaccccagcagagaggacggctgtgcaaaggccctgaggcaagcgcataccagatatggggctggagaggaggaatgaggaggagagctgtagaaagacagggcctcaggggggctaaggactactgtatggactctggcttgtactgcttggtgggggccgctgatgggttgtaagcaggagagagacaggtttccttgtcattctctgccaccccatcccatcattcttcctggtaatctcccttgatatcatttaataaatatggctcaaagccctctcagacttctggtgatgagttataaactcaaacaatcttaagaaaaccggcaagtcccacacctactgccccccaaaatcagtattagaccatcttccctcactccaaaaagcaaggagttgaatcttttttctcttaagagctgctgaccaagagaagaaatagaaaatgttaattaataagccaggcgctatggctcatgcctgtaatcccagcactttgggaggccaagacgggtggatcacttgaagtcaggagcttgagaccagcctggacaacatggtgaaaccccttttctactaaaaatacaa

SEQ ID NO: 121086 - DNA, 384 bp, Homo sapiens
tttctgtaaatgaagttttattggacacagctatacccattcattccaatattgtctatggctgctttaacactgccacagcaaagctgaatagatatgacagaaactctatggcctgtgaagtctaaaatactagctggaccattacagaaatagtttgtctacttctgatctgtatactgataactccaaaaatctatatcttcatcactgacctatcttctgagctctttatttacttatcaaccggacatccctagcctagaagtacttcagtcttatcacactcaaaactggattctaaggtaccagctgctgccattctctacctcataccctatgccctagggatgcccagggatgtggcatgcatgctgccattct

SEQ ID NO: 121087 - DNA, 354 bp, Homo sapiens
tttctgtaaatgaagttttattggacacagctatacccattcattccaatattgtctatggctgctttaacactgccacagcaaagctgaatagatatgacagaaactctatggcctgtgaagtctaaaatatacttctgatctgtatactgataactccaaaaatctatatcttcatcactgacctatcttctgagctctttatttacttatcaaccggacatccctagcctagaagtacttcagtcttatcacactcaaaactggattctaaggtaccagctgctgccattctctacctcataccctatgccctagggatgcccagggatgtggcatgcatgctgccattct

SEQ ID NO: 121088 - DNA, 778 bp, Homo sapiens
cgcgcgggcgcccccgccggaaggtcagttgcaaagcggtcggtcttgggcctgggaccagaagccccctcccgaccgcgctacggagcccggcgctcaggtcccgcaggccgcctcgatgggacctccggaggcttccgcttcttctcttccccctgtgctctcttaggcggctccacgggtcgcatctttcagtgcccagatagactgaagtgcggccaagcggagttcattcactattcagccagtacttgggggtcgccgtggccgggcgcccttctaggctccgcgcatcccgtgaagaaggacggagccctgttctcacggaggatacactttagtaggggagtgtttgcgtgataggcagggaaagggaaagggaaaggaaggcgttgtggctgccattgatgtgctgtgctgctcccagccttctgcttaaggcctggacagagttgggtgggtatcgccgtgaatggcctgtccacgccactgccttcatctcgctgaagatccaccagctggccgaatttccctggagtctcattccaggcgttggctgggggctgggaggctggcgccagttgagaagccgagcacccagccccacttaatgagaagttaattggatcctcgaggacccaaggtccccggtggcatatagatctccagccttgggcaggctctgctcagtccctggatgaagaagcctggaggttcctgagatatatcagcaccacccaggttgtgtttcaggctcaaagaagttagagaagaatgt

SEQ ID NO: 121089 - DNA, 424 bp, Homo sapiens
atggctgaagaggcctcaacgaacttaccatcatggcagaaagcgaagcagaagcaggcaccttcttcacaaggtggcaggagagagtgagtgccagcaggggaaatgccagatgcttataaaaccatcagatctcatgagagctcactcattattgtgagaacaacatagagaacactgcccccatggttcaattacctccacctagatcctcccacaacacctggggattatggggattacaattcaagatgagatttgggtggggcgcaaaacccaaacgtatcagcacccttgtcaaaggttatttgccaatatatgcatgagtttatttctgagctctctattctcttttattggtttatgtgtctctttttatgctaacacaatactgttgatttctatagctttgtaatatagtttg

SEQ ID NO: 121090 - DNA, 407 bp, Homo sapiens
aagtccaacccaccttcagggcattcgctctacttccttagataaagcctctgctggggttaagatgttctgtctccgctgcccccactctgcaggctttctcctcccgctggctggtgcagagaatgggggagccattaggagccacagacactgagctattctacatggaattctttttattgtttgatctatttcacatgtacaaagctttgaccttccagttctaagaattcctacttagaactggtaggttctaagaactcctacttagaactggtaggttctaagaacctccctggaccgattctggcacatgtctcttctgaactcacagagcttgtgccttaacaatttagagtcaactgactttgctgtcctctctaatgtgttaagtttcagtccgt

SEQ ID NO: 121091 - DNA, 316 bp, Homo sapiens
ggacgacgttttctcacacgtcgtgaatgcgatagacctgtactcctgctctggagggaaagggatgacgaaacccctgcttcttagggctccattcagcacaggagttcctgctgctttctagcacagttgccaatccacaaaagcacctttatggaggcattcaaactcttcatgtgggtgccaagaattcgataggctccttttcattgctttatttactatcttttcacaaactatgtgagtttttctctttctttaacaaaccaaacattcaaatactccttttttacatttcactttaactatgtgacat

SEQ ID NO: 121092 - DNA, 680 bp, Homo sapiens
atggtgtctcaccatgttgcccaggctggtctcaaactcctgagctcaagtgatccacctgcttcagcctcccaaagtgctgggattacaggcatgagctgtgggattacaggctgtacctggctgataatagtttgttaatactatataaaaaaaattttctgtaatggaaattgatttatttcccaatttttgtaggttttagataaactggaatatggaaacaaagtaaattttagcttaatgagtttcagctgtgttgtttgagtagcttgaaacagcttaattttaaattttattctgataacacagaaccaaggagaccatatatattcaatggtgtgtatgtgtgtgtaaataattttcaggtccaaattgtttaagcccttggaagtgtcaagagtctgacatggccgacctgcctggtaacatccttctttactacacagcaaaggtcagagtaaatttgtgaactgtccatctagttataactatgttgtgaactgcagttccttttctattccttttgtcatttcattgggtaattaaaaggaggggtttgaattgccatcaaaataatcatgaattttcaaaggaaggtgagaagcagtaaaaattaaggtatacctcctccacgagggtccaaatattatcattatgtcatccctgtggtactaatg

SEQ ID NO: 121093 - DNA, 1769 bp, Homo sapiens
cttttttaatttttatgtttttgtttttgtttttttgcatttcttcttttctcctcagttcattttcgattctttgtttttaaaataacaccattggcctggcgtggtggcgccacctgaaatcccagcattttgagagtttgagatgggtggatcacttgagcccaggagttcgagactagcttgggcaacatggtgaaaccctgtctctaccaaaaaaatacaaaaactagcaggacatggtggcatgtgcctgtagtcccagctacttgggaggctgaggtaggataatgacttgagcccgggaggtcaaggctgcagtgagccactgcactctagcctgggtgacaaggcaagaccctgtctcaaaaattaaattaattaaataacaccataatttatgggtgtgtatttatttatagctttagccacatataaactcttaaaatgttatagtgtattttattacttctaagtaacctatgattttatttttacttcatcttaactcacttattgaagaggttaatattttaggtagttgaaatgttttcctgttttaattgtcagtattaatttctagttataaatttggactaaagaatgtgacctgagcaatttcttcattttggatattactgaagttttatttgtgaccaatatttgaaaccatttcatggttcctgaacaagaaagcatggtatgtgcttcaaaatacaacattcaacttatagctgtattcagtgttgttaattgtattttgaaagtaaaaactaaccattggtttttgtctacctgatatatatgtgcctgatagtatcttgttgtcccctgctatgttttggtttctgtcaatgtatcatattttaaatcatagttattttataaaatgtgattgtgagttattatttaaaccatgccttctttagaggttggaccttttatcagtgtgaataactctttttgtcccttggatatcaattaaattgaattctaatttttttttttaaccttacctcaggtgctgtttggctcctgcagccaaatacactgatgatttaattaaaatgtttatctcccccaaattttaagaactttatttgggttatttggaataatgtataaaatatctatatagattattatataattcagggggaagcaaattatcagaacaatttcatgttatacaaataacatcagaaaaatatcttaaattatatggcatattctattgattcatccacaaatttataagtccttaccacctttcattatattggtactaggcattatagtagtgctaggcactatagtaatgctggggtataaacaagaataaaacaaaataagttccttatttcaggtaacttacagtataggtcagtggttcttagcttgctttttaattatgaattcctttgaaagtctagtaaaataatccaacaccattattccccattgcacatacccccagatgttttagacatattttcaattgctccatggaccttaagaaaacttggttggtgtgcagtttggtgtattatgggtaagactggacctggtgttagaaaatctgcatttgaggctttgttctgacagtgtctagtgtaaacatgggcagaccacttaaacctctctttagtcttctctgtagaatgatgataataccatctaattagcaggattgttgttttattcagtgagacagcatatgtaaataacttagtaaaataaaaagcaacgtgtttataatggtaaaaaaa

SEQ ID NO: 121094 - DNA, 333 bp, Homo sapiens
tactactactaaattcgcggccgcgtcgacagggaggtgccgggaaataaaggggctgggagtcagagggatctgttgcctcaggaggcaaaggagcctaaggagagagctcacggaacctgtcacatggaaatgttgaaaaccgggatgtggcaacgagagcccaccctcctggtaacagggcttgcaccagcagctggagagtcaatgtcaagggcagagggagatacagtctccattactggagagctcccatttgagggtgacacgggcctcagctcaagaagggatccaggtcacgtcgacgcggccgcgaatttagtagtagtaggc

SEQ ID NO: 121095 - DNA, 435 bp, Homo sapiens
tttttagacaagtatgttttttccctcattgagaaggaatgtgtgagttactcagtgtaaaaatagacattctcctccatttcataacttgagcactagaattctaaagaccaaaaattaaagcactcaaaaagaattcctggctgggtgcggttggctcatgcctgtaatcctagcactttgggaggccgaggcaggcagattgcctgaactcaggagttcaagaccagcctggacaacacggcgaaaccccgtctctactaaaattcaaaaaattagccaggcatggcaacgtgtacctgtaatcccagctactagggaggctgaggcaggaaaattgcttgaaccgctcagacagagcaagactccgtctttaaaataaataaataaataaataaataaataaataaataaataaataaataaaaataaaaa

SEQ ID NO: 121096 - DNA, 256 bp, Homo sapiens
gcaccatttgacactgtagtcccaaaatatactaaatattaccctcatcatataaaagcattgcttccatttatgttgctgtacacccttgaaatgaaaatgtcatctcttggacggggaacttgcatgagaattcggacatctcaggtctaatcctgcttgtgcagctgatgtatacgtgatcttgatttctgtttatgcaggtggtctaaagctttctgctcttttcaggtccacgaagactccttctcactta

SEQ ID NO: 121097 - DNA, 649 bp, Homo sapiens
gtgagactctgtctcataattaattaattaattaattaattcaggctgtgggatactgctcagcaacttttaaaaaggggcaaactttaaacgttttagaaataaaacaccctgaatgactcttgagaattactctgagtgaaaaaagccaatcctaaaatgttacctattgtatgattctatttatataacattcttgaaatgacaaaattatagatatgaagcacagattggttcttcatattgtcagggcctgtggatggtgtggggctgaaagtagatgtggctataaaaggtcaacatgagggatcctcagggtgatggaaatgtgtatgttgactaacagtgccagtattctggttgtaatattgtactgtagttttgcaagatgttatcattggagggaactgagtaaaggatacatgagctctttgtattatttattatgtgaatctataattatctcagaatgaaaagtttatacatgagctgtttattatttcttattatgtgaatctataattatctcagaatgaaaagtttaaaaactacaatttggcagcttttcaaaaagttaaacatagatcctgtgacctagcaattctacttctagatatatatcctagaaaactgaaaacatttgtctgtg

SEQ ID NO: 121098 - DNA, 151 bp, Homo sapiens
tttgtttaaattcaaaatgtgatggttaaaaccattttgcttttaaagaggtgtgtgatttaaacaatcagtttcaagttgtataaataagtgaaaatgagcccaaatacttttttagtcattatcttttacagttaaaatctatatataa

SEQ ID NO: 121099 - DNA, 400 bp, Homo sapiens
cggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaattgcagagcctggcttggtggtcctggagaggaggaggaaataaggctcccagtgggaggctcatggtaccagagtcctgtccactgactccagtgtcctgtccactgactccagttctctctgcacttggccactgtcctgccctctgggacaccctcaatgtgaggaggcagctggtgggtcttaggtgggctgaggagaaaagcagtcactgcagtacccgcacagaggg

SEQ ID NO: 121100 - DNA, 301 bp, Homo sapiens
cagtggtgcgatctcagctcactgcagcctccgcctcctgggttcaagcagttctcctgcctcagcccccagagtagctggcactacaggcgcctgcgaccacagccagctaatttttgtatttttagtagagatagggttcaccatgttggccaggatggtctcgatctcttgacctcgtgatccacctgccttggcctcccaaagtgctgggattacaggtgtgagccactgcgcctggcctaaggagataattatttaccacattgtagtgaattcagtcaggcagctaatttctctc

SEQ ID NO: 121101 - DNA, 271 bp, Homo sapiens
gtgatggggaagctgagaggccccagggcaggtgggtggtgggcctgtagggtgaggtgttactttcacactcaagtcagaacaggtgtgctggggttttgaccttctgcagcaaaatttccctcctcagaaacttagtatggtgttcggtttcaggattaatagaacaaaatgccagctgcacagcatgtgttcctgtaatatttttcattatatggctttgattatccttttgtgaatctctcacaactttaagttgttagttcttaga

SEQ ID NO: 121102 - DNA, 362 bp, Homo sapiens
ggctcatctcagacctatggggcggggagagggctggagattgaatcagtcaccaatggccaataatttaatcaatcatgcctaggtaattaaacctccataagtcccttctaccctacagggttctgtaaacacgtggaggtcccgggagagtgaagcactcagggcatggaaactctgggggtaccctcctccacccccgctcaatacccttccctgggcatctcttccatctggctgttcctgaattgcatcctttataataagccagtaaatgtaagtaaagtattttcccgagttctgtgagctattccagtaaattatggaaactgaggagggggtcatgagaacacccgattttt

SEQ ID NO: 121103 - DNA, 475 bp, Homo sapiens
cacatttcctttccaaatttcttcttgcccatgcaccatttcctcttttatgattgtaacaaatagccctcatcctaattggtgaattggaagaaatgactctgagaataattaactctttgttaattgtaaatttggaaaggcatggaaagagacctttttcagcctatgcaggaatttaatctagcacttataagtacaaaatggctttcgtttagtgtgtattttaaaagcgatgtccaaactggtgagtagatgccaatttcttaatattcaaaaaatataatattaaaagcctttctccattatcaatatagtggaaattctttgcaatataatccccaagatttctgactttctacatactttattatatttatttatttatttttgagacagaggttcactctgtcgcccaggctggagtgcagtggtgtgatctctgctcactgcaagctctgcctcctgggttcaa

SEQ ID NO: 121104 - DNA, 321 bp, Homo sapiens
cacagagcggtatgctttgtctttctttcttgtgcacttttatagtttatagactgatggttttctgttcatttgacttaaccaaatgtgccaggccctatcccaaagattagggctataaggctaaatagggcaataatagacttcgtgtcatattgttgaggatgtaaaggggatgacctcaccctgggggacttcagggagaaaaaagggggaacattatgcacagacttggagacatcaaatgcaggagacacacaaggagtccaaaggctaaagtatgacccaggtgctgatggggaccagatcaaggtgccatga

SEQ ID NO: 121105 - DNA, 295 bp, Homo sapiens
tttctctatacttgtccgagctggaaagtggcctgggcactctcaagtcgaccacgtgtcctgcatcccgggggcctagattagcttttcaatttctcaccagaataacagcagtttacttggataaacaatttaaagtcagagctatcaaaaggagatcataaatcatttacaggtttacagaatactaacagagaaactagcatctaagagttaaaggaagaaattggaatataggttttttatgtcttcctagcattgtcatggatttgctattatccagacatatgacttt

SEQ ID NO: 121106 - DNA, 180 bp, Homo sapiens
aatgctggcttagttacattaaagagaggaaggctgggatgaggcccccctctgagtttctaaccagtaactggagtttgagtactgaatcagagtaactgggtcttggacttcaaaggccgcagtggttttcattcattgccagctcagttcttgcaaaggtgagaccatatatataga

SEQ ID NO: 121107 - DNA, 359 bp, Homo sapiens
ctatttcagggtggcagggacccagttgtgaggcttaattatcagagacaaagttggctcaatttctgtgatagaccacagagatgcagtagcaatcggagggtactgacacttagaaatctgtggaggcttattactggcttcctatgaataaaatagatgggtggccaaaaatgacatgacttgattaatataatccagaaatcactatctctgatggaaaaaaatgcaacttcacagaggtgctggtataaatccataggcagaacccatacctaagccagtttacagatcctgagccccttgagtgaggagagagtcgaggaactattgggatagtatcctgaaacttgacctca

SEQ ID NO: 121108 - DNA, 788 bp, Homo sapiens
agagtgctgggattatagtcgtgagtcactgtgctcatccctattactatcttaataattcatgttagaaaggagatattaatggctgctttgcaaattatttatgaaatgttatctttttattaatttgtttacttacaaactactaaacaaaaagcactttttcccatcagtatttagagtcataatctatcttgctaaatgtcagacgtatatatttaaatatcacatcctccgtttcatttactatgtgactaataaaaacttaatagacactaattgttgtcaaatttgccaagaaaagactctcacaaatcttgttagtttttaacattctgttcattttggagcatataatgtatccccagcagggactgtgcttagaagcaccagggacttcttggaagaaaatatagttggcagatcttgggtcaaccagaatcatcccttgcacagattgattctggacatactgtaggtaatagccatatttttatactgtcagaatttatgtcgctttgtgatccaattgttctagacattttgtctatcaaattatggccatctacagagaggaatacagtaacagcttgatttctcacgttagaccaatagcacaaaaaagctcattccaacttttccatttttttctgtgaaggtttgggaaatttgctggtaaacctcatctagtgaccataatggtggatatattagcctatcaggaaaaatagttttattattttcttaatttagagctctcctctctcctcctgcccacacacctccca

SEQ ID NO: 121109 - DNA, 341 bp, Homo sapiens
cctgggaggcggaggttgcagtgagcctagatcacgccatggcactccagcctgggtgacaagagcgaaacttcgtctaaaaaaaaaattagccaagagtggtggtgcacacctgcagtcccacctgctcagaaggctgagatgggaggatcacctggccccaggaggtcgtggctgcagtgagccaccactccagcctgggtgacagagtgagacctgtcccaataaaagaaaaaaaaaagcccaacagtatatgctcccttatatggaagtacaaatctattaagtattcttgcaaaaacaaacaaaccaaatctgttgtctctgactttaattaccag

SEQ ID NO: 121110 - DNA, 131 bp, Homo sapiens
agaggagatttgaatgagtcttgaatgatgacaaatgatcagttcttttagtgggtacatgtcagttcagtataaacatttgagttatggacacactgggttcccaaactgtaagttcaggatctaagact

SEQ ID NO: 121111 - DNA, 474 bp, Homo sapiens
tcctgcctcggcctcccaaagtgctgggattacaggcgtgagccactgcgcccagcccctgtagagaattcttacttccaagtgagaagaccttggttcttgggggagcagaatatctgacctgcattttcaggggcagaatgcaagccactctggcactgactctcagagtattgtggtactggactctccctttcaatactctggctccgctaatgcctgtggcagttgggacacaggttgcccgtgccagagttgctctcttcctcctctaatatttctcactttgtcatcctggattctgaatcccagagatcaagactagctgtagtccagcagaggagcaataaatcattgctcccacatcctttcctccaggtttcctgccctttaattaccacatagccactgctgaggctgcatctctgtgctgtgtgtcctggggacaaaagcccttgttgatgggatgtgtgc

SEQ ID NO: 121112 - DNA, 497 bp, Homo sapiens
catttctgtaccttaggaggaagaaaggtgatcaaaggacgggatcaagaaaatagctagacaactggacattatacaaataaaaactttttgtgcttcaaaggacacagaaataaagtgaaatgacagctcacagaatgggaggaaagatttacaaaccagtatctaacagactctagatccacaatatataaagaactctcatagctcaataatacaaagacaaataacccaactgaaaaatgggcaagggatgggaacagacagttctccaaagaagatatctaaatgaccaataaacacctgaaaagatgctcaacatcatcagtcatcagggaaatgcaaattaaaaccacaaacagatgccacttctcggaatgaaagcactggaaattaacatgtgttggtgagaatgtggacaaactgaactctcctgccctgcttatacgctgctaagtgggacagtgaaatggtacagccactgtgggaaaggaaag

SEQ ID NO: 121113 - DNA, 467 bp, Homo sapiens
gaaatgaatttaagggcatctaactcaacagaaagggaggcgggcctagtgaggttaagctggtaggtcgttagagatggagctggcctccatttatccatttgtaactagaccttcaaagaccatctaggagcattagtataaaaggtaaaaatgatcttaggattctgttgttatttttgtgattaaaaaaaaaaatccttcagagtttctttagggaaaagagggatcaagcttagtaaccagggtcttgtggtcatttttaaatgttatcttttacaaatactcaaatacaaatttctgccccaagtgggagcagaacagcacaagaaagagagaccactcaaaatccttctgcatctgccccagcccttaatctttcctaaggaaatgttgagcctagagggagctcttaagggtaccttttcaacccagtggcctgagattccaccataaagcatgtgggg

SEQ ID NO: 121114 - DNA, 293 bp, Homo sapiens
tcgtagagatgagatctcactgtgttgccatggctggtcttaaattcctgggtgcaagcaatttgtctaccttagcctcccaaagtgctgggattacaggcacaagttatcacgccctgcccatttcttatattttacattttttgtatgttaagtattttggtggtgactgcctgttgtcctagacacccaggaagctgagctgggactacagccatgtaccaccactactcttagataatttttatgttgccagcgctggtcttgaactcttggctcaagccatcctccca

SEQ ID NO: 121115 - DNA, 610 bp, Homo sapiens
cctcccttctcccaaagtagactgtatgcaccacaggatactggatacctttttagtttatgtaactctacaattacccatcttaaaatatatggccccatccaacatatccaacattatttttcacaattcctcagcataaaacctcagaaatgcctctttcatgctctgtggtattccctgcctctaagcatttttcaagatctccccattgtctggaacattctccatcctttccatctgaatcctgaaagtgcctcaagattcagaaactctacctcctctgtcctccagttattccagccaactctgctcactctctaccctaaactcctacagaatttagaatgcatatcattatgcatgtggcaattaattatttttgttgtttcatttaagttttaccttcccaattacacttgagcagaggatctagcactgtatacggctgattaaataagtgcctgataaatgtttaaaggaataaatgaaagataaaccctttttaaaaaaaagcaggagcctcatcttttacttacagtacttcatttggaacctccctcctgtttgccaagcaagtaacaggcactcaataaacatttcttgacac

SEQ ID NO: 121116 - DNA, 247 bp, Homo sapiens
gtgaacaagacagccaggctctgcatgcatcagatgtacatcaagttagaaaacaagcaaataaaatgatacatagatatacgtaagaaattatggaaagtactgtgaaagcagaagcttgcaatagagaatatggacaggggggtttgaatgggaagacctaatttaaatcatatgatcagagaaggtctctctaaggaggtaacatttataatgaatcctgaacaataaaaaggaaatctgcaat

SEQ ID NO: 121117 - DNA, 329 bp, Homo sapiens
  misc_feature (304)..(304): n is a, c, g, or t
ccgttttagcaccgtggtacagccattctcatccaaacccctgaagccgttatagcaccgtggtatgccacacacacaaaccatacatgcatacgcacaaataccataccatcccactcacactatacatgtacacatgcacacagacacaccataccacaaacacacgcacaccaccacatacagatacataccatcccacttacaccatacatgtacatacataccccacacatgcacacattcacacagcatcacagacacaccacatacagctgtgcacacactgtaccacggtgctatnacgccttataccacggtgctaaacg

SEQ ID NO: 121118 - DNA, 812 bp, Homo sapiens
  misc_feature (787)..(787): n is a, c, g, or t
cacattccacaccatgcacacacacccaccacaccacacatgtacttacgcatgtaccacaccacatcacacgtgcgcactccgcaccatacatgtacatacacaggtacatcatgcactcacataccacacatccacatacacacatgtgccacaccacactaaactcacaccatacatgcacatatccacatacacacaggcacacaccacacagaacatgcacacaccatagaggcacccacacacaaccaatcacgtatgcacacactcgcaccatatatatgcacatacatagattcatacatcacacatcacagtacaccaccccacacaggcacttatgcaccatatgtgcacatacactcacaccacacatgcacaccaaacatcacatacacactcgcaccatatgtgcattgcgcacatacacaccacacattacactacacacaccacaccacatacgcacacatgtccactcatgcgcagacaccatacagatacaggtgcacacatataccacacacacattataccacgtactatgccacacacacaaaccatacatgcatacgcacaaataccataccatcccactcacactatacatgtacacatgcacacagacacaccataccacaaacacacgcacaccaccacatacagatacataccatcccacttacaccatacatgtacatacataccccacacatgcacacattcacacagcatcacagacacaccacatacagctgtgcacacactgtaccacggtgctatnacgccttataccacggtgctaaacg

SEQ ID NO: 121119 - DNA, 153 bp, Homo sapiens
ttagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacat

SEQ ID NO: 121120 - DNA, 875 bp, Homo sapiens
catggtggctcaaacctgtaattccagcactttgggaggccgaggagggtggatcactggaggtcaggagttcgagaccagcctggccaacatagtgaaaccctgtctctactaaaaatacaaaattagctaggtgtggtggtgcacgcctgtaatcccagctagttgggaggctgaggcaggagaatccctcgaacctgggaggcagaggttgcagtgagctgagatcatgccattgcactccagcctgggcaaaaaagagcgaaactctgtctaaaaacaacaacaacagcaacaaaaaggaaccatgaactatttattgtcttcccttcctaccatctttgtttcctatgatcttgggctgtccaccatacccaagaacttgcttcatctcactagtggagaccacagaatgaggatagtgaccttgggtattgggtcatttcacttgaacagaaattttatggacattgtaacaagggaatacattttagaaaggttcacttcacggaattttgagcaaagaaggcaatttacttttatcagtgattcttggtgaagagaatgaaaccatctccatgaagagcggagaacgattttgcagaattcacagtcacaagcattttcacacgggttttcaccctggtcaaaggttccttctcattatggctgtttataatatcacaaatgacattttattagcctataacacagcttagccttataagattacattacatgaaaacaccaagtgttccttacagatttgccacgtgtgatggcacatactttatcagggaaactgatttttaaatttgacccttaaaacttgtcaacacgtctttttcttcaagctctagtgttccttaagaaaa

SEQ ID NO: 121121 - DNA, 433 bp, Homo sapiens
ctgtgggacaactacaaaggctgtaacatacatgtaatgggaatactggtggttttggggaccagttggaggtggccaggtgggtgctatctgatggttttactgcctttgccacatacaactgtttcctcatgttgatgccattttcataagttggagttctgcgtgtggggagacacatgagccattgccatctcacttagactcttcctaattcacacaaacttaaactctagtggtgtttcctgagcttaagagaaaatgaagaaagcatttcacatacctgttttggggtcctccccatttttcctaactctgcacagaatttagaagcagggagttctttctatatttactaacataacacacatccgtaccccgcacatcctatggcccgacatccgtactgcccggatcctctaatcacccgcac

SEQ ID NO: 121122 - DNA, 297 bp, Homo sapiens
acaaaggtagagaatctgtctgatggcggaagcaaatgaatgcccatcacatgcactttcctccaacagagcaactcggatgctgtgaaacaatgctaagtcagtctcagtgtctgttgcagtaatattgtacatactgtaggtcttaatcataggaaattacatgcccattgccctgtgcatggaccggagcgcacttatggggggccggtagtcctcctttcagacatcttttttttctctgccccaacaagtggcctttccatagaagactgcccagagaaccctatggcaacc

SEQ ID NO: 121123 - DNA, 446 bp, Homo sapiens
aagtaggtacctaacaggcactcaataaataacttagactaaatgtaattttttaaaaagactcatctgctaaaacagtgctttttatcctttggtgtgtcatgggtgcctttaaaactgatcaaatgcacatgctgctcatctgcatacccacctgaactccacttactagggtggctttccacccaagttgagaaactgtgttccaaacatttaaacttggagatgtctcctcctagctttactctcaggacctggatcagcccccacatttcatccctggactctgagagcaggtttcaaatcagccttcctgccacttcttcaaattattatctgagtcctctttctaggatactaaacgaatcatatttcttcactacttatacacctgaatgagacaaaccctctcagacagaggtaaggcctgctatacgtggcttcct

SEQ ID NO: 121124 - DNA, 413 bp, Homo sapiens
ggcagcgagggtccttgggagtcactcagaggcatgtggaagattcacgcgggttaaagctgagctgattatggaatgaaaactcactgtgtcctctctcctctctcctggtctgcagcattacttaggaataatgtggcctcaacttccttctctttctttattatttttttcttttttgagatggagtttcgctcttgttgcccaggctggagtgcaatggcacgatctcggctcaccgcaacctccgcctcctgggtttaagcaattctcctgcctcagcctcccgagtagctgggattacaggcatgtgccaccacgcctggctaattttgtatttttagtagagatggggtttctccatgttggtcaggctggtctcgaactcccgacctcaggtgatccacccacct

SEQ ID NO: 121125 - DNA, 236 bp, Homo sapiens
aaatgcctacttatgagttaaggtccagatcaaacaaatgccatctctcccatgaggcctttccctacttcccgagggctcgtcacccttgcctttgtgttctctggcccatcactttgctttcgaagcattaagtagtaataaaacgtatttctgaccagctgggcaatatagcgagacccccatatctacaaaaaattttaaacattaggccaggtgtggtggctcacgcctgt

SEQ ID NO: 121126 - DNA, 229 bp, Homo sapiens
ggacatttgcaaaagcagaactgactggtggaaagtgtgggaatgaactgctggaaatctggtcctcatggaccatgtgtgtttgatggatatgagacaaatttggagagaagttttgcaaatattttctttcattggacattctactctctgattccctgggttcgactactctagggacctcatgtaagtggattccagagtgaatatgagaagagactgctgtttg

SEQ ID NO: 121127 - DNA, 252 bp, Homo sapiens
gtttctcctgtgctgtcactcaacaatcaacacagaatacttctgtgacctctggtcaccaaaatttgtgtggggatttttccccaccaacaatcaatcagttcttttctgcaatggatagtagctgggtgttctctaattcaattctcacactacctggagagcctcggatcccacgaggactgagtcccatgagactgagccccgcttaggatgctgattgcgagccccaggtggtttttactggctata

SEQ ID NO: 121128 - DNA, 782 bp, Homo sapiens
tacattggagtagtttttaaagcaatctgtggaaactttgctaaggagattgtattgtcatatgctctgcagtttagcctgcatcttttgccatcgtttatggcaaacagagttaacatatttttctgtgaagagccagatagtaaacatgcaaggctttgtaagccatacagtctctactctgtctttgtagtgtggaagcgcttaatacataagccaggtgttctcaaacaggggccatttcgtttctcatacctacaccccagtaggcatttggcaatgtccagagtcatttttggttttcagtatgaagggtgggtgctgctggcgtctggtgagcagaggccagggatcctgctaagcgtcctacaatgcatagtacaactgcccccaccccccaaaaaaagtctcatccagaatgtcagtagttctgaggttgagaaattctacctataagcaaatggacattgttgtgttccaataaaactttatttacaaaaaataatcagaaggccacatttggcctgtgagctatagtttgcttatctctattttaaatagctttttgctatatgataatatagttttctgtatttgttcctgaattgtctcattcaccccaaatatttttccaaattttcttctattttatgcctttaaacctttactaaatacaaataatacacagaaacaatagcccctgtgtaactaccacctaataattaagcatgttgttttattgttttgattaaaaatttataaaagaaataaatcatttcaga

SEQ ID NO: 121129 - DNA, 246 bp, Homo sapiens
tggttagggaaggtttctctgagaaggtgacatgtaagtaaaacctgaaggaagggaaagaatgagttatgggtatttgggagaagagccttcatgcagcgggaatagcaagtgcaaaaacctggagatgggcttatgcttccctatgttcaggaaaagccagtgtgactggaggagagtgaatcagcagggggaggagatgaagtcaaagaagttggcaggagaagatcttgttataggaccctg

SEQ ID NO: 121130 - DNA, 451 bp, Homo sapiens
agagacagaacagattagtggttgccaagggctgggagtggggagaaatggggagtttaggtacagagtttccttttggtgggacgaaaatgtgcagaaacaagatagtggtgatggttgcacaatactgtgaatgtactaaatgctattgaattgtacactttaaaatggatgaaatggtaaattttgtgttatgtgtggtgatacaatcaaaaagtactgtaagatcactggaaaatattttcggacaacttggaaatacttagtatatatcttctgtacttttatgcataccaccctttagtacatataaaaacttttttttaaacaagtttgagatcacattatgaatacttctttttcagcctttttgttttccattattatagcttagccatctttccacttaactaaaaaaattgacctcatctttctttagcagttatgagta

SEQ ID NO: 121131 - DNA, 674 bp, Homo sapiens
gagaacaaaagatattccttctcatcaaatataagttgttacaattttcggttctttggctcttacaaatgtgcagtaatttttaaaaactaaagtaggatgagctttttttggtctctttgggagtcttattttttttcattgctggataagtgaggagtataattttaatacgttaaattttaattgttacatcatattggatgtgattttttgtggcagagctcccaaatcttgaaaataaatttgaattataaccatcattaccatttttctattgttacagaaaagtaataaacgttgataatccctaaatgtaattggagtgaattctttatctaatttgttcttgaaagctgatggatgaagtatcttcttttgtgctctccaaagagctctttaagcttaacactttctttccctgtgtgtatttttccccctttggaacatcaggagaagtgaattgtcaatatgtagaaaaagtgacccagtaaatgagtaattcaatttaatttcagtaaaaatccatcattattatgaagattcaatacatgataactatttttaaatgaactatatctggccccttaaagagaagtggccaccagagagaatagaaatgaatttcagatgaagcattcttgcattatctattcaaatatccgtctcttcca

SEQ ID NO: 121132 - DNA, 450 bp, Homo sapiens
ctctctttctccaccgcacgagccatttcaaaggcaagaataggcccctcctgaccccgctcaggcaggcctcagggcaagtgggagtcactggaagactcaattcctctctctgcgtttccacccgaggcaggtccagtcaccagagagagaagcagccacctcctttctcacggcagctggcaaagcaccgggtggaggacagagccggtcggcccaactgtagcttcggggctgcccttggctggtctctgggcagagcccggtgctgagggcttgcagtgggaaaggcacagcttgaggaatgggcatcagattcccacctgcggccccggaggggaacgggtcaaatacccaggcggccacacagacgtgcgggccaggaagggtcaggccccacagtccgcagggagttgcaggaagggagtggcgtggattccacaggcccca

SEQ ID NO: 121133 - DNA, 191 bp, Homo sapiens
tctgaaaatatgtggatatgcatgtgaatgactgtatgaatagggaaaaatattctgttgtgtactaaaaaatagataaatctttttacatgagtcagtatcctacaatttgacatttattttggcaataaagtatcaattaggatataaggaagagccatgtaaaaaagttaataattacatacactcgt

SEQ ID NO: 121134 - DNA, 364 bp, Homo sapiens
cgccgcgctgcttctgctgctgctgttgctgttgctgctgctgctgctgggattgcagccgccgccgccgccgctcgccctgcctcctcccccgccgccgcgcctcctccctcactcgccggcgcgctcgcctcctcgctagatggtgtgcgagccgcccgagaattagacacactccggacgcggccaaaagcaaccgagaggaggtgtagtgtggtgccagggggagggaggggagggagggagggaaagcgaagaggaggaggggaggcaaaaacaccgaaaaacaaaaagagagaaacaacacccaacaactggggtggggggaagaaagaaagaaaagaaacccacccacccaccaaaa

SEQ ID NO: 121135 - DNA, 468 bp, Homo sapiens
tccactcacaattctcttccatctctgcctttgtcccccacctacactgtcattcccaggacccacaaaacaccagcatctcttaagacacacacacaccaatcagggaagctatttcatcctccactgggatgcacgatgcagacccaggccacgaacctggtcattgcctgacattgtgagggagtggagagccctgctttatgccgcacggtggcagagaactggaatattgcacgccgggaaagtccatgtgttctgtaattatgcctcatgacattcctttgcagttaatgagtagctgccggtttccagtcacaagggtggagcataggagtggagaggtggatgtataaagaactgggatgccagaagaggaaagagcatctccctcccctaagctatagctatagctaatttttgtatttttagtagaaacagggtttcaccatgttggccaggctggtc

SEQ ID NO: 121136 - DNA, 693 bp, Homo sapiens
ctggcaccagaagagagaaatgtgtgtaagacagagggaacgccgagtgttaagcccttgcggtaggaaagggcagagtgttctgcagcgcggagaagactggtctgactgaggcacaacgaacaagagggagagtggaagaggggaaggcagaggtgaattcggggcagagtgcgcaggcctcatggggcatgggagagcctggcctttgttcgaccgaaatggtaagatacccaggggctctgggcagggaagtgacactgatacaggagtgctgggaagggaagagcgtggtccctttaaatgacacagaagcagggaagggaagtgctggggagagaaaggcgggtccctggctaggactctacccccacggacctaggtgaggacaagcactcctgccttcccccaaatgttgcatttcccaagaccacgctggcccaccacaccagcatcctgggcctataaaaacctgagaccctagtgggcagacagaagtggctggatggcaagaggaacacattggtggaaaaagacacaagcggctggtcatggagagcaggccggcagaagagcatcccgacaggcaccggcaagccagcaggccatcaaccaccgggacgaggcggagtttggccagggccgctgagcggcccaactccaagggaaatctatctcccttctggctccccc

SEQ ID NO: 121137 - DNA, 548 bp, Homo sapiens
tcacagctactcaggaggctgaggcaggagaaccacttgaacctgggagatggaggttgtggtgagctgcgattgtgccattacactacagctgcactccagcctgggcgacagagtcaggctctatcttaaaaaaaaagaaaaaagaaaagcagaatgttctacacggatgtccctgcctccttggtagctccctacctccttacccaggaaggaggaaggtggctgctgagtggcccagagcaggaagctgggcactgaccttgactggagcctggaaggagagaaggaagaggtggggaggcctcacagagcaagctgcgctatgagattgtgaatttttgaggtttggcgagatgccctgcacggcatgatcaggaaccttttatgtgctgtgtgactttaacccagggcttttacctctctgtgtttcattgtccttgtctgtccatcaacagggggttgtggggagggataaaaacaacacctccccagaggtttcagtgagctgagatcacaccattgcactccagcctgcacaacacagt

SEQ ID NO: 121138 - DNA, 729 bp, Homo sapiens
attgtcagaaagatatgttgaaaattcccatgtgtagaaaacaaacaacgcactgctgaataagccatctaccatagaaggcataagggaaataggaagatatttcgaactgaagaaaaaaatatgtcaaatgttttgagatgcagctaaagcaatgcttcaagggaaaacattagctttaactggtagtattaaaagaagaaaggactaaagttaattctctaagttcacacactacacagctggataaagaagagcatattaaattcaaagtaaatgaagaaggtgatagcaaacattagagtagaaatcaatgaaacaaaaaacaaactaatgaaaatgcatgaaaacaaaaattggcttctttgaaggattgagaaaaatggctaatctctagctagattcctcaagtaaaaagaaagggtaaacaaattgcctgcatcagaaaaaaagagggactatcaacaaagattgtggagacgtaaaaagaataatgatggattattatgaacaattctataccaatgaatttgacaatttaaacaaaataaaaaaatacttccatatataaactacctaataaacacaaaaagaaagtataaaggctgaatattcatattaattaaggaaatttaacttttaattaaaaatattcaagcagggtgggcgcagtggctcacacttgtaatcccagtactttgggaggccaaggcaggtggatcacttgag

SEQ ID NO: 121139 - DNA, 287 bp, Homo sapiens
acaatagcagaccggctcatgtgtcagtcatcccctcatctgtcattgtgtttaagaaataacaaagtgatttcattaactctgactaaatcaaaataatatttaagctaaagaacctgtcttggctgggtgcggtggctcaacacctataatcccagcactttgggaggccaaggcgggcggatcacgaggtcaggagtttgagaccagcctgaccaacatggtgaaaccctgtctctactaaaaatgcaaaaattagccaggcgtggtggcacgtgcctgtaatc

SEQ ID NO: 121140 - DNA, 999 bp, Homo sapiens
ctctacctcccgggttcaagcgattctcctgcctcagcctcctgaatagctgggattacaggtctggctaatttttgtatttttaggagaaacggagtttcgccatgttggccaggctggtctcgaactcctgagctcaagcgatttgcctgcctcggcttcccagagtgctggaattacagccatgtgtaatcccatggtggcaatgttgagccaccttgccctgccaaccattttactttctttctgtgaaaccgaatactcttaagtacctcatgtaagtgagatcatccagtatttgtcattttgtgtctggcttatttttagcatagtatttccaaggttcatccatgttgcagcatgtgtcagaactaacttcattcttaaggcagaataatattctcttatttgcatgtatctaccacattttatttattcattcagcgacgggcagcagcctgtagatagttttgttttcatgtattgaatggtcctttcccccagtggagtgagtaaatgcatccggaagcagaattctgttgtttcccattcatcactgtgtgccaggtgtctgagaagggggtcttataggagcccacgcagaaaccaagctcacctcagtctgggtgtggggcagtcagggaaggcattctggaaaatgtagctgactcgaaataagcacctattgaaaatagtgtgctgagccctggaacattaaaaatgtgttcctatgtggaaatcagaaatgtatgggtcccagaagagaacttgtgggtcagcctgctttccagagagtgccgaggccctttgaatggtgaacattatgcaagcattcttgtatggccagtggccagcagggaggagggcagagaatgactgtgcctccgggaagccggcgtcaacttcccgacacgcttcaggatcatctctttgtatagaaccatgggatggatcgctgcaggacctactggaaaaaggaggtcatctccaggactcttt

SEQ ID NO: 121141 - DNA, 139 bp, Homo sapiens
gggctgtacaagtgtcctctcctgcttaagttatttatataggtggctgaaaacgctttgcttgtacaaactagaaactattagattaggccagcagagacagccagaggcaatcttttaacaaagtgagtgggattca

SEQ ID NO: 121142 - DNA, 301 bp, Homo sapiens
ttttttttgaatctggaaatgtctttcattattgtaaagaataattttcctgctgctaacactgaggcagactgaaacatacatagaagtttaaatcattgcttatgttattctttgaattatatatgttctcactgaacttaagtgtgtgtgtgttctcaaagatgatatttctgaagtgcctacaaatgtgaaccaaacttcactaaaccatgctatgtgacttctgtggccactattaaaaagccacagtcattaatatcagtataaatgtcgacgggccgcgaatttagtagtagta

SEQ ID NO: 121143 - DNA, 399 bp, Homo sapiens
cccttgaatctgtggttggctgggtagaagtacagctgcactgaggactatttccaactagctgtcttttggcactgggaccttaactttaatttgtggggtctgtactgtcaacccaaaaggaagaggatgaagcacaaaatacgatttaaagagtttacctgagccaaagcaaagacagctgccgaaaagacttagacccaagtaaccttggatatgagctccatttggcctttgttatgtgcaggtttgtatttaaaggtttcagaaaaggggggtggggagacagacagtaggttgatacaaagttgttagaaattctcactgatttacagaaatagcattgattagtgactggctagacacctttaagctacaggtgtggattatactgtctgg

SEQ ID NO: 121144 - DNA, 372 bp, Homo sapiens
ggtctcgaatacctgaccccagatgatccacgcacctcagctccaaagtgctaggactacaggcatgagccaccgtgcctggcctcattatttgcatttctgattattagtgatcatgagaatgtttttttgtttggctacttctgtattttcttttaagaaatgtatgttcctgtcctttgctaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctt

SEQ ID NO: 121145 - DNA, 576 bp, Homo sapiens
agagctacttgtggcaacagcaagtggtttcaagaaatgaacacgtagctcaaggaggaggagtcacattcctcccgtgaaagttcttttctcagtcttttaaatttaccattgggtgatttttaacagccttattgaggtgtgattgccgtatgaaaactgctcatatttaaaatgtgccctttgatttctgaactttgatgtctgcacacacctgtgaagccatagtgacaaccaagaagacccacagatctgtggctcccacggggtccacaggcccttggtcaccaccccccctcctgccccaggccaccagtgagctacttttttcacgataaattagttgtattctgtagaattccgtaggagtaggatcacatagtatatgtttttcccttcggcttttttcacagtgtaattatgttgagtcacgcatcaatggtttgctcatttgtgttgtggcgtggcagtcggtagtccttcagcacgctgagggtgtgtgttgagtcacgcatcaatggtttgttcgtttgtattgtgtggcagtcggtagtccttcagcacgctgagggtgtg

SEQ ID NO: 121146 - DNA, 284 bp, Homo sapiens
gcatattttcgggcttccccacctcaaaaaaaaaaaaaaatccgtgacatttcttttcctggatggcaaaatgaaaacatttcatgaataaatctacaaataaaatgatatcactttaaagatgtgaaaaatctaggtgtactttgaaaaagattttcattttaaataggtagccagaagcagatatgtgcaattgaaatgtttactattcatctgatttctttttctaagaaacacaaaaatcatgacattagaaagaattcaattaactctcctcagtgtgt

SEQ ID NO: 121147 - DNA, 407 bp, Homo sapiens
  misc_feature (348)..(348): n is a, c, g, or t
ttttgggtctttgctatgtgatacatgcagtaaatggtgatgtacagggtataagtaatagcacaacaaaggccagattggctgggcatggtggctcacacctgtaatccccacactttgggaggacaaggcggaaggattgcttgagcccaggagttcaagacctgcctgggcagcatagtgagacccctatctctacaaaaaatttttaaaaaattagccaggtgtggtggtacatgcctgtaatcccagcactttcggaggccgaggcgggtggatcacaaggtcaggagatcgagaccatcctggctaacacagtgaaaccctatctctactaaaaatattctntaaaaaattagctgggtgtggtggcaggtgcctgtgggcccagctacttcggaggctga

SEQ ID NO: 121148 - DNA, 291 bp, Homo sapiens
gtgttagagtaaggctagctgaagggaaaataagcttttaaaaaatgtcaacttctccaaaaggattcattgaccactgagaaggtcggaaagaagccagtaaaatgaaaagagctgaagggcgtaggttccagaacattcacatctgcaaggctgattcactgctgtctgtcgaggacgatgtccggactcccaggtgacagcacctgaggaaacgctccagagaggggtgatatttatttccttatttgtgtggttttttaaaaagatagggtcttatctcgtacacac

SEQ ID NO: 121149 - DNA, 529 bp, Homo sapiens
ttactatctggccttttacggagaaagttcactgtcccctgctttagtaaattgtctctccaaattttctatccaaataactgtaacagcaggaaaggcaggtggcctcatgagaccaggagggtagcctaagctgcaagccataaacaatatatgtcttagggtttgtatgtatgaattttgcatccgggagccaaatatattagtgtgttaatacaaaaatattttctcggctgggcgctgtggatcacacctataatcctagcactttgggaggccgaggcaggcagatcacttgaggtcaggagttcaagaccagcctggccaacatagtgaaaccctatctctaccaaaaatacaaaaattagccgggcgtgttggcatgcacctgtagtcccagctactcaggagactgaggcaggagaattgcttgaacctgggaggcagaggttgcagtgagccgagattacgccactgcactccagcctgggtgacagagtgagactctctctcaaaaaaaaaaaaaaaa

SEQ ID NO: 121150 - DNA, 275 bp, Homo sapiens
ccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgaggggg

SEQ ID NO: 121151 - DNA, 234 bp, Homo sapiens
ttactggggagagtgagcagcttccagcgcatgaaagacagagaacctgaattttagcagagggacccacaggttctggctctggtacccccacaacctccgagaccaccatgagtagccgggcagagccacccccatcactctgttgttcaggctggagagcagtggtgcaatcacagctcactgcagcctccacctcctgggctcaagcaatcctcccacctcagcctccca

SEQ ID NO: 121152 - DNA, 355 bp, Homo sapiens
actggaacaatgaagctcctgctctgcccatccccacggtctagagcaaagagtctcagtcttggctgcacatcacacttacctgggagcttaaacaactttgatgcctgggtcccagcccaagagattctgatttaattggttctgggatgaggcctgggcatcaggcattttaaaagctctcccagtgcttccaaagtgaaaccgaggtgagaactactggcttggagtatgactactcaaagcatggtccatggtctggcaacattcatctcctgggagtttgtcacaaattcagaatctcaggccctactctagactttctgaattataatctgaagatccccagatgatc

SEQ ID NO: 121153 - DNA, 409 bp, Homo sapiens
gattttctgtctactataccatcaatgactgacagcagagtgctatctctaaatatacttgaagatttatctatttctgttttgttctattagttttcactttacgtgttttgaaactaggtaattagattaaacagatctatatttagattatgtctactcaataaattgacctctttatcattatgaaatgtctctctttatccctggtaatattcttttgcccaaagtcaacttttcctgatattagtacagctaactactccagcatttttatgattagtgtttgcatatattttctttcccaacctttggctttttacctgagatttcatatttaaaatgggtttcttatacacatcaagtaactcagtcttccttttatctaaacaatcttttaattgaattt

SEQ ID NO: 121154 - DNA, 389 bp, Homo sapiens
aagaggcttggccgtgtcacaaaactttggtttagtgatctgaggcaccatttataaccaagatctcattctattttgtcaaacccttccctatacctcatttataacaacacggaagaggtgtaggagatggtgtgaaggaacagggactagattgatagggagacagaggttctctcacgtgaacatcacagggtaattcaagcacatgtattttgggacatatgtattccagggccaacataaactataaactcattcactgaagcaagccaagacataattactaattgtttaaaaatttaaaagttattctagtttcagagaaataaaagtgctaaattattatgagatgtaagagagagaactaaagggaaaaaggagagaat

SEQ ID NO: 121155 - DNA, 312 bp, Homo sapiens
tcatgatttaaaaatttaaaaagaggtagttcccaatgtgtagtatttgaagtgtacagattctccctagctttttgaaagttattgaaaatgttttaagactaaaaagagaaataatgaacaaaactagattaaagtcagttgttattgttgtccactgtgtcctgaaccccacccctgccttttattctactcaaatattagacctagtttagataatctatttgtaacatgtgaattcctagatgatttttttcatctattgctgaccacaagagggcatccagtgaacatgttctaagcattcttcca

SEQ ID NO: 121156 - DNA, 285 bp, Homo sapiens
gtgctgtgatggagcaagtacgagggaccgtgagaacaatttggaatagtatctaacattcgactggaggagtcaggccaattctatttagaagaataatccgacttagttggaagcagaagaatatctagaaattatctggtcaaaaagggaacagattgtgtgttccaggcaaagaaaatagctcattgacgagagctcgataggttcaggcaagtctagacagctgaaaagttgagttttgtggtgtagaagatggtgagaggtgagacttgaggtaagtaa

SEQ ID NO: 121157 - DNA, 906 bp, Homo sapiens
atttagcctacatgggaatgtagacttagagaaggtgagagagggagaagggaagagacctgtaagatctataaaacctaagagatacgatgagtggaggtgattaattaatgggaaacagcaagcctgggaggaagctcttcatcatgtgtcccacatcttcctgtccccccccattggtcttaattctgtaaatggggggaagtgagtaccaactgggtttggcaggaagcacttttgactccttagttttagttgttaaatgatgtggaactttaaacagttcaggaggtggagttagtgtggttggaaaggcaggcagtgaggtgtggaataaagaacaagggctttgataacttcattcctcatgttgttcctggataagtcatttcatctttcttagccttaaatttcccaactgtaaatgtggaaataatgtccatctcctagggttgatatgaagggttaataagatattttaaaagcctaatacttagaaagtgctctgtaaatgttagtataaatgttagcttgatccttggacagttaaatctggaggtgagattggagtagatgatttctagaagttccatgtttgctttagaagccttagtttagaccaggtgcagtggcttatgcctgtggtcccagcactttgcgaggccaaggcaggagctcaagaccattctgggtggcatggtgagaccccccatctctacagaaaatacgtttaaaaaaattaggcagatgcgatggtacgtgcctgtggtcccaactacttgggagactgaggtgggaggatcacttgggccagggaggttgaggctgcagtgagttgtgatcgtaccactgcactccaggatgcactccaacctggtgacagcaagatactgtctctttaaaaaa

SEQ ID NO: 121158 - DNA, 359 bp, Homo sapiens
atttctctcccttaattatggcaaagttattaaatttgagctcatgtattgagaataaaatcagctctttcatgcctctctcaccttgacctttccctcatggtattcaaagtcaatgccggtaagtacagtgcttgtggctttgtgatagccgattttttactcactttttctaagcattaccataaaacctgacatcatgccttcagtctgcctgttgtggagattgtaataagtgggggttggcttaaagcgcattagtagattttgagtgtagtttacttgctcaagatgatgagcaaagtgatctatcattgaatccatactccttactgaaggtaatagttcaattttgtttt

SEQ ID NO: 121159 - DNA, 659 bp, Homo sapiens
ttacaaatcaagctagcaaactgctcaataaaataggtgttatccttctacctagactgacaaatatatcttttcaatgtcttggaagaccaggtacaactttagaactcctacaatgttcatagtccttccacagaaatgggtggtttaaagagagacatcatcctgagccctggtaatcaatttgccttcctcccccctgcctgctccatcctacatcaagaggggccttgtgatatgtggacacccaagctcgctctctgtctctctctctctttctctctctctctctctctctctctcacatacagacacacacacacacagagctatcccttaaacaaccctcgtgcagagattgcacaaccagtagcaatgacagccttcaggaagatggcttcaaggatccatgcaaactgcagataccagttcagggccttctggacagcgaatgtgggttcccacataaccaaatcatggtctaaaaatgaaaagagagtaagactggaaggcccaaaagtcacctcaccccataggcatggctctgaccagagaagaatgacagcagagtaccatctaaggcccaggacagaggccagttgtgttcatatactaggtctatattttagttgtagagctgaaaaaaattggaggaaaat

SEQ ID NO: 121160 - DNA, 410 bp, Homo sapiens
ttgccatggaaagaacatgtttgtcaggcttgggttaaaatcttttgatctgagagctaaagggtgagtaagaactagctaagaaaagggggaggagaaaggaacagaaggtctgaggcaaggggaatttggcaattttgaggaaccaaaagaaagttgtgtgactggagccctagggtgaagtagatcgtggtgaaaagtgaagctctgggggaagaccgggtatgattggtagaggtgttctctttaacctcatggcacggggaagccttgaacaaggatttaaatggggaggtgaggtaatcaaatttgttttgaaaagacccctggggctgtgctgccgagtatatccctgagaagggtttgtgaggatagagaaactaatcaagacattttttgcagtgctctgg

SEQ ID NO: 121161 - DNA, 451 bp, Homo sapiens
ccttttccatgctccatcctttggctgcctctgcttgggcacttgtcccttagatccattccctgaagattcactcagtttggtcacagtccagcccttctgcctcttgcagacagcctactctgatcactccagcctttgctaacctctgctttctgagaactccaactgcacgcagcagtgaggggatcatgtgttcctgggatcatgtgtcccaggacagtaggaatgtcaaacatcctgcctgtgctgtcctcacctgcttcttccaggatgggtcagatggtccctgttacacagacaaaatatgagtcatcagaaaggctagtgtccctctccttctagatggtgcagtctgtctgggcagcaagcatgcttttcctgcagagtaggggctagaagcacaggctccggagtcagagggacctgggaccaggcacccagacacact

SEQ ID NO: 121162 - DNA, 338 bp, Homo sapiens
ccttcacctgcagctctggccagctgagctgctgcgttttaggtgttgacatcacacattatttaactcagatgacctgtatttgttgagtctctcgaaggttgcctagaacacctgatgctggtgactgagggcaaatgaacagctacctggcagtcaggcctggagcagccagacacctgcctctttctatcagctcagattcccaccctcaacagttcactccaggggaaattttctgacccagtggcctggagcccttttataccagctcacgggagctggtggttaactttttggaaattttgcaagctggttgttaaaccacagccactact

SEQ ID NO: 121163 - DNA, 203 bp, Homo sapiens
caactttttgctttctcccttttctcctgtcttataaactagggaaaaggggaggtgggggagaagctgggaaggacaacaggagaagtggtggtctcaaaaaaaaaaaagggaaaacgctattccagcataggttgatgagccctgaaagaaatgaggccagtggtaagtgagtccgggcttacgggactccgctgatctag

SEQ ID NO: 121164 - DNA, 375 bp, Homo sapiens
taggtgacagagcaagactccgcctcaaaaaacaaaaacaaacaaataaaataatctgcagtttatctttggtggatcccttcccctttccctcgcagggtcctgttgcacagcaggcgtccttagggctacctcatggcactcctgagcactgcagttttcctatcttttgggtccctgcataaagataaggaggagggttatctagtctgagacccagcctgcataattagcccgctcaaagcctcccacctccctaattactgttatcatggatacacccactcagcaggccattcctacattcctatttccccctcctttgcacagttccctagggggctggagaggtgatgtgggaacccaaatcccttc

SEQ ID NO: 121165 - DNA, 227 bp, Homo sapiens
tgaatactccattaattactagcattaaattgagaataccaacagtagtatgtatgtatgcatttatgtatttattttgagacagagtcttgctctgtcacgcaggctggagtgcagtggcgcgatctcagctcactgcagcctcaaactcctggacccaagtgactgtcctgcctcagccttccaaatagctggagctacaggcatgcactaccatgcccagctgc

SEQ ID NO: 121166 - DNA, 396 bp, Homo sapiens
cgtgaaagcaggagactgtgcaaatgaggatgtcactgagttccagatcgcgtggatttccagaaagagcacgggcagccctagtgaaggcttctgtggagaaactgatggtccaccaggaaggagggctctggtctgggcacttttttcatgttggagtcagtataaagatggaaaccaggccgggcatggtggctcacgcctgtaatcccagcatttagggaggccgagacgggcagatcacctgaggtcaggagttcgagaccagcctgacccacatggagaagccccgtctctattaaaaaaacacacaaaattagtcgggcgtggtggtgcatgcctgtaatcccagcgacttgggaggctgaggcaggagaatcgcttgaacccgggagg

SEQ ID NO: 121167 - DNA, 371 bp, Homo sapiens
ttaacaggcaattcacttgtttggatccaaattgaagactgtcacacctacaggagggcagtggatcttatctcaattattttctttagtttaagcctcagctgcaaactgctttcagtttctcttgcccatatggtacaggggtcagccagagacttggactgagtttaaacacggaatcatgggttccctttctctagctgtctccaggttttccccatcccctcactctctgactgttcttgttgctcccagtctccttttccttgttcttctggcttgaaagatggcagattttttaatttgcattttagctgcctggtattaatgctgcaactttggctgtcctcaaggtaaaaccacacacacaa

SEQ ID NO: 121168 - DNA, 259 bp, Homo sapiens
tcaacagccctgaggtggaaattaacccacctgacagaagaaagctaacttcagaaggagacttgcccaagattacacagcttgaaagtgccagaattacctctagtcctcagttcccattaatacgacagaggccataacacttcatcctaagggaaagaggggactaggtcacacgggccctgaaatccgttccaagacacccctgtccctgcagaacaatccctccaagaattagttctcaccgcaggtgaaatgg

SEQ ID NO: 121169 - DNA, 379 bp, Homo sapiens
acgctctctctgtggggtacggcaggtgcaggtcttggctgccttctctgctgccctgcaagcaggagttgtcactcagggctggggaggatctgcattatagcttctgtactggtagaccatgggtgatcagtggagagtttcagcagggtggtttctgtgggcatgaaccagcctgcatactccctccctatgttgcagtttcccctaacccatggcaacttactcagctggcatgtatctgtgtgggtgagttttgctttcctttgccacaccagtgtgagggagtgcagtccgaccccctccacccaccaactgccattgcaggcagagccttggcagacacagccagccttctccaaccagcagcctgcccttg

SEQ ID NO: 121170 - DNA, 728 bp, Homo sapiens
tgctgtggctcacacttgtaatcccagcacattgggaggccaaggcgggcggatcacaaggtcaagagatctacaccatcctggctaacacggtgaaaccccatctctactaaaaatacaaaaaattagccgggcgtggtggcgggtgcctgtagtcccagctacttgggaggctgaggcaggagaatggcatgaacccgggaggcggagcttgcagtgagccaagatggcgccactgcactccagcctgggcgacagcgagactcacatctgaaaaaataaaaaaaaagtagtacctattcacttgaacacatcagggatatggtctcatttaaaagaggccatcaagaactcggatcctttctttctaagccatcttattagtatgttgcttccatcctcaacatcataacatgctgctggaactccagccatcatcacctagttccaagcagaagggattagagcaagtgacaaaagagcactccttccactaagtcagttctcagagttttcctggaagccccacacaatgacttctgccacccctaacttcaaaggagctgggaaataatagtgttctagctggtcactcaacagaagggggataatgtggattggagaggcaactagcaggctacactctagtcactaggtaaagaccacttttcctcaaaccagcaaacgcatatcaaaaatgtgggagaaaaaatgcattcacaatagca

SEQ ID NO: 121171 - DNA, 372 bp, Homo sapiens
attaacactggaatcatagactgagtaaagcagattgctttccccagtgttccttccccagtccattgcaggccagaacaaaaggcctggaaaggtagaacttgctccctctgcctgactacttgagctgggacatcagtcttctcctgccctcaaattggggcttacaccatcaagtgcccctggttctcaggccattcgactcagcctggaactgtaccaccagctttcccgggtctccggcttgcagatggcagactatgggacttctcatcttccacaatccatgagccaattcctcataataaattccctataataaaggtcttataatgtatgtatttatacactattggctttgtttctgaaggt

SEQ ID NO: 121172 - DNA, 147 bp, Homo sapiens
gaacacattgcgtgtgtgtgtgtgtgtgtgtgtgtgtgtttagggtgagggaccaacagtaacaccccacccagcaagtcacaactaaaatcctggagagttctttactcctttcctctccctgtttctcaggcacttcccagcaag

SEQ ID NO: 121173 - DNA, 386 bp, Homo sapiens
gtccccttgtgcagctgttcctgccccaatctgccctcactccagatgccagctgtgggcatgggcaggtgctcactgtggcagctccctagggttgcaggggccatgcccaggctgtgctttctgggccccagaccctgcagctctgaaactgccccctttcttgggcccaggctctgccctggctcccagggccttgtggccagctgcaggcctcaccccgcctccaggagacacccagcctcggcgttccttggttttcttctagagagacccactcctcctctgccctcccgggagatgccacgcatggcccttgcccccgggtgccttccccagaaccgtcacccaccccgggctgctctcatctgccaccctcaggcagc

SEQ ID NO: 121174 - DNA, 278 bp, Homo sapiens
aaaatgaaagcaagtttattaagaaagtaaagaacaaaagaatggctactccataggcagagcagcagcagggactgcttgactgagtacactatggttatttcttgattgtatgctaaacaaggagtggattattcataaattttccaggaaagggtcagggatttctcagaaccctcagttcttttagactatataggttctccttttagaccatatagggtaacttctggacattgccatggcatttgtaagctgtcatggagttagtagaagtg

SEQ ID NO: 121175 - DNA, 716 bp, Homo sapiens
agggatgtgctaggcaagagagcagaggaggctttgcaggcagtgtgctgaggagttaatgaatccaaaggctctctatctcagagcacttgaaatcattactgagcacgggcctttattagtgacttaacacattgtggtagttcctgcccagctccaggctgagccagtgccccgagcaggcaaagagactgtccattaagacagtctatggctcttgacatgttaatcagaaggttccattctcaagttgcctgatcccagggggaaagagagacagaaaaggaaatcaaggcccaagggaaatttagccctgaactgagaggtgctagcaaattagcagctcagactgcctgtgagctgcacagaggcccactcaggaagctgcacagtggagctggtgctgcacgggggatcctggatttttagaatctccctcaagcccactcttgacatccctgttctcctccccagcctctctggcagcaaagcgcttttcctccgtaggagagaatatatttccagatctttaggaggttagttagtttaggggtaaaagaaagtctcatttatcatataatgcagtgagacaatcataggaattttagtatttgtcacccaaacatggacgtaaaagcttgttgaattaatcatgagtgatgggctgttgaattagtccctgtgcttctcatgattttatcttattttgctgctgc

SEQ ID NO: 121176 - DNA, 259 bp, Homo sapiens
cagcctgggcaacatagggagacactgtttctattaaaaaaaaaaagtttcgtggaacttaccattaaaacctactcggacccagagtgttttttgtgggaagatttttagctatatagactattcagtttatctgttcttggttgagagttactggtttgtgttacacaagtaattttctcaattcaactaaaaatgccatttctccctttgtttctgaaaggtatttgcgtaggtatagaattataggttgacttca

SEQ ID NO: 121177 - DNA, 190 bp, Homo sapiens
acaaatgaagtaacatttcccttttgagagtctccattaatatctgcaagtgccgtaaataaaggcaaatatttccgaaacagatacgttaaaaatatcttaccatgactgcagagggcttttgcgctgaccttcagacgtcaatgtacggatgtcaagtttacagtgccctccaatttcaccactctgg

SEQ ID NO: 121178 - DNA, 364 bp, Homo sapiens
ggatttagaggtgaagtgccctatccaatgtcatgtagctagtaatgatgaccaggctgggatccaaacccagctctgcccaaacccaaagctgctgtatgttgccatatatccctccctagggcccttgctcctggctcagttctgatgagaaagtcagtggacttatttctcccttagtccaaagcagggagcaaagtagacactagctaacaagactcattggttccaaaggttcaggacagggcgtgaacagaactagttgtcagagttggaaccataaaatgcttagggacacaggcaaacagcgagcactgtaaatacaactggctgggcatggtgtctcacgcctgtgatcccagca

SEQ ID NO: 121179 - DNA, 646 bp, Homo sapiens
taagtctttgagtacctggatgtgtgtttgatatccttcagcattgtttttgtgttttatagttttcggtgtacaagtctctcacctcctttgttatatttattcctgggtattgtattcatttggatactattatacatggaagtttttcttaatttaatttttggatagttcattgctggtatgtagaaacacaatggattttgtgtgtaacatttattgcctttaacagtcatttactttcttttttccatgtgcaagctgaatcacgtgggtaaataagaaagtggaaagtggaacactaaagaacttgatctgtaagatgtctgatttccctgaatgtgaaaactatgaaatatgtttttagcatagtgttgaactattatcttactatacttgggctattccatttctggtatcacgttacatatatttggtcattattaaagaaggtagatcatttcattttctttaggtttggagagaagtgtcaatacgtaattcattttcaaagttacaattattttgcaacttaattttgatgttacacagaaagcctcagggataaaccatatttatcgcagagtctggtacagagatccatgaataataaagataaaattagaacagaagctaatttgaatat

SEQ ID NO: 121180 - DNA, 676 bp, Homo sapiens
tagtttattagtaatttcctctttaaaaatacatatatatgtatttttacatttatgcattaaaaaatatatatgtatctttacatttatatattaaaaatacatatatacgtatatatgtgtatatatatacgtgtatatatgtgtgcatatatatgtgtgtgtatatatatatgtattttttttcccccaaagttgttatttctctaggatagaggtctggaagtagaattgatgaaaccaatgggtatgtacatctaaaagtttcatagatactgccaaattacctttgcaaaggctgtgctaatttattcccattaacactgtaggagaatacttatctccctatactcttgccaacactggataaaaacggtctttctaactcttgccaatctgatgggcaaaagtattatcttgttttaatttgcatttctctgattactaatgatgatctggcaacctttctttcattctatcataaggagtcagactattccttctcactgaagagcttttctactgaataagcttattttaaagagctccattaattctcgataagcataatcttattggtgctcctcaattactgtgctactataaatttggtttacatttaaaagatatgttgatgagtttgtttattcactgcctgaccaaaaaaaaaaaaacg

SEQ ID NO: 121181 - DNA, 437 bp, Homo sapiens
agtataaacatattctaggagtaagatatagcataagcaaagagaagcactaatcatttttgtgggtttctgagtcacacgtgcctgacattttagaaggtctaagaaaatgtagaataagaatgggaggataaattgaggcttgctttccaaggttcccgcttcagttccctattcctttgtaacaaactatcctaaaacgcagaaggcttaaaataacaatttgttttttctcaaaattctggggattggctgggctcagctaggcgattctttggttggggtaatttatgcagctgcattcagctggtagctcatctgggcctccaagatgtgggtacttcagttcttcctgtctgtctctttctctttctcatcctccctcctctctctccacgtgacctctcatcattcagccatttggcccaagcttcctg

SEQ ID NO: 121182 - DNA, 460 bp, Homo sapiens
ctgtcaggctttctcttagaacttctgtgagaatcaggtgaaataactgattttaacgtgttttatgaattgtcaaataatataacgtactagcagtgatactgcctaaggaatgacacatgtaactttgtgaggacagggtcatattgaaacaagatattaagaatcaaggccaggcacagtggctcaatcctgtaatcccaacactttgagaggctaaagcaggaggatcacttgaggtctggagtttgagcccagcctgaacaacatagcaagaccctcatctttacaaaaaaatgaaaagttagccagctaactatggtggtattcacctgtggtccccagatactcaggaggctgaggtgggaggatcacttgagtccaggagtttaggttacggtgaactatgatcatgccactgtactgcagcctgggtgccagagcaaaaccctgtctctct

SEQ ID NO: 121183 - DNA, 289 bp, Homo sapiens
ctaagagtagcagaagagattgttatttaagtaggagattctaaagaatatcatttcttgctgagtgagaccttctccattgtttttcagtatttccttttaagttttactttattaggagacaggtgtatgcagttgacatgtttcaaatattgatttaaattgtgaagggatttgacattaaaatgaatattttagtgaatattctggagcacttagttggaacctaacgtatttgtgtaaatgctcctgtgtccacctgttgcccacatctactcatccccacgtc

SEQ ID NO: 121184 - DNA, 648 bp, Homo sapiens
gaaaaatataaaataaatagcaagatgatagaatcaaacctaaccatatgaatagtcacactaaatgtaaattgtctaaacactccagtttaaaggctgaatttgtcagattggatataaaagcaagatccaactatatgcttgcctacaagaaatagtttgtaaacaaacaggttaaaagtgaaagaatgggaaaagatataatatggtaacctagtcaaaagcaacttggagtggctatattaatattaaagtatatttgagagcaaggaatatttccagggataaagaaggtcatttcatttataatggtaaagaggtcagttaagaggacataatgatgttacatgtttatgcacctaataacagagcttcaaaacacatgaaacaaaacctgatagaaatgcaaggagaaattgagaaatccagtcataattggagattttagtaacccctgtcaataattgatagaagtggacagaaaatcatcaaagatatagtagacttgagtaactgttaagcaacttgacctaattgcatttatagaacactctacctaaaaagagtagaatacgtatttgttcacaagtttatccaaaacatttgcaacgataaactgtattttgggccataaaggacttttttttt

SEQ ID NO: 121185 - DNA, 590 bp, Homo sapiens
caatgccacagtagaataaatctgcatgtatttttactggtctacaccttggcaacaatacacatctccatgatgggacagaactgaaataattttgccctgtgtgtacatggctgtttgtttttaaaaaattttctgactcaactgtgactgactacataatactgggactgacatcctatcatttggatacatggatatttagaactgaaagctcatgagagacaatatggagggcaataaactggcatgaaatgccttatgtttttccataccagctaaaggctcttgatcctctttttctcttggccttagaatgaggtgactgagtgaagtgaaacgaaatgcaagtttcatttcaacttaaaagctggaattctcaaatgccaaataattggagatttgctttctgaggtttgatcacaaaacattttgtaaatagcagaaaactgaccacactttatgttgttcactgtgttggaatagaatttaaagacaggaaggcctgcagagagcttcaggttagtttctcagatgtcttgcctcctgtttccttcaaaatgatcaggagagattttaatctctatggt

SEQ ID NO: 121186 - DNA, 300 bp, Homo sapiens
tggattgcaggcatgagccactgtgccccgcctatgagtacagtttttagatgataatgattatattatagctcttggaagatgttttatagtcctaaccatggcaaaatggggggactcggccaggtggggtggctgatgcctgtaatcccaaagtgctggaattagaggcatgcactaccctgcccatccttcaaaaccaatcattttaaatccagtagttaatctgtagtatagggtggttttaattaaattaaacttacagccaattttgaacgtgactgctacggacagggctaa

SEQ ID NO: 121187 - DNA, 806 bp, Homo sapiens
ttaaacctcatttcataactaagcaaaattcaccttagtagaataatttaaaagctctttacagatctttaattaggtcaaatttttacgtggtctttgggttaggaaaaatgtataaactattatactatgacccatttagctgcttgattatagaaaatattgtaaaacagcccttttaaaaaactgatttaatatacaatgtgcaagatttgcttctgtggtataatacaatccaactttcataatttgaagtttgataagctgcatcttgatgccttcccctgtgtgcaaggaatatagaaccccgcactgtaatagcatgtaagtgtgtgttcttgtctctgaaagcacagtgatataaccttttgccattgccaacaagcatcatgttaaattaattgaccttggttcacttgcactatgatgcaattagcaattatcttcagacgtcaacattttggttacatatcctaaatagaaaaagatgcctgacccaaaattctgctaggaatgtagaaatatattttttttggcaaattatttttcctgctgtgaatatctctatactttggttatgcaagataaatttgtattagagagccaaagtaaaaacccatattaacgaccagtaataaccagaatgatcagggataaaaggcacaggtgtaagggaaaaatatctttggacacatagaaagttatagtgaatggctaaaataaatatgcccttctttagtactaaaaaaaattgctaatgggaccaaagggattaggaagcaatcaattgatctctctgggatcta

SEQ ID NO: 121188 - DNA, 565 bp, Homo sapiens
ctctttgaaaagatcgctctggctgctgtgttgagtggattggtaagggataggtggtgaagactgaaacagggtatccagttaggaagctatcacagtgatccaacccccagcttctgttgaggttgaagaacatgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggagtggaggttgcagtgagccaagattgtgccactgcacttcagcttgggcaacagagtaagactctgtctcacaat

SEQ ID NO: 121189 - DNA, 735 bp, Homo sapiens
ctaaaggttagagaaagtgcttgttccttctttcctcaatgagagcagagcattctctgtgggaagcatatgaacatttctggcttggtcctagtgcttggcctggggtgctgattattttctgcttgggtcttggcttcccctcagggagctgtttcttatcccttgggtctcttgtgttcttttttttttttttttaatttatttttattttttagggtgatgaagggtttttttcccctttctttttttttctttttgtttttttagacagagtctccagccggggtggcacagcgagacacagtctcaaaacaacaacaacatagaagaaccaaaaccactttaaaacaagaaagaaacggattcatttaataaggcgtacacattacactttaaccattgtgaccataccatcttaggcatttgtgtccaagataaaatataacatgcttccacacacatttgtttaacgaacgcggtattcctggtgagaaaccacctgaaatgtccttccaagcgggccacagagagaaccaccctgggtcgtatactctataccaacgagaatacttcttcaacgacataacactgtgacacagacctactgatacacaccctaactctttgactttcccgggacccatttactgcctgagctgcacaacaaggccgactacaaaaactccgcccaaggtgggttcccactttttgctgcaaccttcggacgattac

SEQ ID NO: 121190 - DNA, 857 bp, Homo sapiens
ccctttgctttcactagaacctcaacctggaggcctacccctgtgaattcagcagatattatgacatgcccaaactgctgactgagtgtgctccagtggctccttcgcactgatggccaggtatgcttctgacaggaggactgatggggatggatggtgggggacagctggagcagagcagcaatccatactcattaactggggacacaataatccattaaaggcttagagcaatcctaaatgtgagtgtaaatgtgaatgaacgccagataaatcaactaattgaagaggcagctccacatctgaaatttcaaatggagctttagatactatcatattcactttcaacagtttccttacttggaatttacaagatgccttcatatccttttcccatttaattgtccttagtccaatgtgaggtgcttattaatatcccataatagaaataaaaatactcctgagttgttcaggtatcaaggggtggagctaagatttgagcccacatcacctgactcctaattttacatttcttccacatcttgccataaaagcatgaattgaagtacctgtgatttgttgatgtgcttatacttatagctgataagtacagagttatacaaagaatcatggaacctgaggaaactgaggcttgagttgattcaactgaaatgtacaagcaaaagtgctttaaaatgatgagatcctagctgagtgttgtgaatcacacttgtaatcccagcaccttgggaagccaagggagaaggatagtttgaagccagtagttcaataacagccagggctataaagcaaaaccctatctctacaaaaaaaatttaaaaattagctgagtgtgg

SEQ ID NO: 121191 - DNA, 450 bp, Homo sapiens
gtgatctcagctcactgcagacctccacctcccatgttcaagcaactctcctgccgtcagcctcccgagcagctgggactacagatgtgtgccatcgtgcccaggtaatttttgtattttccgcagagacagggtttcaccatgttgcccaggctggtcttgaactcctgagctcaggtgatccgctcacctcagcctctcagagtgccgggattacaggcatgagctaccgtgcccagcctaaatgtaggcatagtttctataatcccttacttcatgagtcatggggttcagcagtcacggggccagcggtcacaagatgtgtgacttccctaatggtttctatggataacatcattattgtacaacctaagattggtcttcctaaatattttttatactgactccacctggacttgtgactcatgactcaaccagccctactgccca

SEQ ID NO: 121192 - DNA, 180 bp, Homo sapiens
tcttaaaatcgagagcaaaatcagcaaaacttgactcctgtgtccaaccttatctcctatctagttctccctcattcactttgctgcagccatcctggccttaactcaacaagtgccaaattctcccacttttatgtgctatttctctctctttccacctctacctctacctctcttcat

SEQ ID NO: 121193 - DNA, 739 bp, Homo sapiens
ggggtgagggggcaggtaaaagtttaagttgcatgtgttatgcagattagaatttcagttacagctaagcatacttgtaaaactttaggacagcatttctcaaatttgagaacctaagaagcactgagaatgtttatgaaccagtttgaataacatttaatgccattattttagattatcagtctctactagtgccagggtgagcaacacattgcaattcaaggcactgaaataattcagtgtttagttatgagttggttattcaggtgatctagaatgtgctttttatattatcttgaaattaaaacaaaatttttaaatgcttatgtagaaatactggcctccatgggtcagcagagcccagtttaagaaaaactaagctaagaaatatctgaaatatgtttggttttctgcaatcaagctgttcgtaaaaagaatttatatgttttacttatggtcacattttagtgtaaaagtattgaagcaaaggatattgtcattataattctcaattacctactaaaatgatggttccattggctctgttggaacaatttaaaggtatttatttaaccaaaagtctgtttttttaaaataatttgttagtcttaacacataccaattttgtatttgtttgatgtgctgcaattttttcatcttttcccattatttataaaggctttctgtatatatgagatcaagattttagtgtgtgtgtgtgtgtgtgtgtgtgtgtgtg

SEQ ID NO: 121194 - DNA, 460 bp, Homo sapiens
ctttcttttttacgatccttccctctcccccgccagtactgtgtatggtaattggagtgatagggcatcttcttagagtctaggcagcaggcgggacgtctgggtggctgccaggtctgtgcagagggaagagaggggtagccccagggaggagctgcaggacggtcccccctccacctgccccccgatggcagtaggggtgcctccatgctatatgctctgcatggtgcagtcaacacacaagtcctcaaaacacgtcccacagaagggaagagggcagcgtgggattaacagaaccttatcttgtaaccctgttggtcacgtgagctgagatgagtgtgacagctagtggcttgggtacggcacgagcctggcccgcttctgccacgccgtcctgtcacagctgatttaccctgagggcccagagccaaggatgattagtgggcggaaggagggagag

SEQ ID NO: 121195 - DNA, 261 bp, Homo sapiens
cagccatagtaacttcatacccagaacaggccccaagacattaaacctgtgtgggtttggaaaacaatactaacagacactgacaaaaatattctatcttctatctattctgctaagggcccacttacctttccaaaaattcacttgttcttcttaagtggcctttctccaccctcttctaagaatttatttgtcctcccagaatcgcccttttgccccccacatcccattaggatggtaaattctttctttttttttttg

SEQ ID NO: 121196 - DNA, 530 bp, Homo sapiens
agttcacaaataattgtcttaaaaattataattatctttgaaaggaaaaaaaatacaacaacaaaacaaacaaacattaagcatgtaactcttagaaggagaccattgacaagattgttgaggagttattccgggcacaggcgctacctgtacctgaagcagtggtattcattgtttcctgataattggtcctattccacaaagttgccagcagtgaaagaataacaatttattttaaagtctgtgtaaattattgataggcatgtgacttctgtttcttctgagaatcttcaggttcaagatgccagcttctgtgacccatttaactagaagttcctatgtctgaatttatttgttcgtcttttggggaaggttgggttgttagactggggctgttattatcaaaaggccatgctatgaaaatctgactttagacttttgctttttcccacttacccaaaatcggatttttcagaagttttcctcagctatcttattcaggtatttacagacttgctaaatggggacca

SEQ ID NO: 121197 - DNA, 150 bp, Homo sapiens
tcagctcgccgctgccagtggaagctgtggtagtagatctgcctcactgagtgcatgggaattgggggctcaccgctgcctgctactccccactctgcacaaactcttctgcgcagcgggggcagaagaacatcaacccagtggcctgag

SEQ ID NO: 121198 - DNA, 409 bp, Homo sapiens
gacagaacagcaaggctgttcaagcgtttgccccagagctgaggtatgtgactcgtgggtccactcaaccctttcagcagaaatctacaatgaagatggggttatctaggaagcgtctgtgggaaaactctctgattttatagcttgggcctctataacttgcaaaagagaccaacaaggctcttgagaatctgacaccagcagaaacactgccggcctggagtgaagggggcagagatgagataaagggaaggaagggtggccccgaaggtggggctgtctcgtttcagagcatgggtcattccagcaggcccagaagaaagaatctcaggccacagaggattcccctcaggccttgaaaccaaatgaattttgccctgctgggctttggacttgcttgggacgggtg

SEQ ID NO: 121199 - DNA, 403 bp, Homo sapiens
gggtgcaggagaagcctggaagggtgggttaggggctgaatgttcaaataccttgaaagctgggctttgttctgtaggtgagagcgaaccatcagaagttcttttggagggcgtgttattctaaaaagcctgtttttattatgtacatatttattttttgagacggagtttcactcttgtcacccatgctggagtgcaatggggtgatcttggctcactgcaacctctgcctcctgggttcaagcaattctcctgcctcagcctcccaagttgatgggatcacaggcacccacaaccacgccccgctaatttttttttttttttttttttgtatttttagtagagatggggtttcaccatgttggccaggctgctctcgaactcctgacctcaggtaatccac

SEQ ID NO: 121200 - DNA, 530 bp, Homo sapiens
actgggcacccatcctttcttttataacgtatacatgtgttaacattatttagctcccacttctaagtgagaacatgtagtatttagttttctgttcctgcattagtttgttaaggataacggcctccgtctccatccatgttcctgcaaaagacattaccttgttctttttatagctgcatagtattccacagtgagcaattaaagcttaatcccacaaggaagctctgagaaatgcatgcaaaacatacacctcagaattgtccaagcctagcagcaaggaagctcaggttttcatacacctgcataggagggttgctggctggaggctgtcccatagggactgttgattcactggtgcttctagattgtcataagtacaggcagctctccaccactgcaggcaaagagagccttagtcacaaatgcagatagctgccattggaaatgaggtgaattctccagagatgtggatggggaactgactccatctgctactgtctatcccttgtgccaatcagatgctccct

SEQ ID NO: 121201 - DNA, 534 bp, Homo sapiens
cagaaagactctatcctgggctaccagaaaacaggtcataaaatcttattgatacctttaaatgaatatgtgttcgccttgctaacaaggtaaaagtcggtagcaaagagcctgagtttgaacactgagattcacacgtgtagcaacagatactgacaatgttaattacactaattaacacaaaggcagaaactaataaaaaatatttaggaagcaatggctctctcttattcaaaattatagagacagatggactttgcccacttaggctaatcaatccataaacgtttacagagcactatgacatgtaagtaaatgaggatacctggtctgacaagtacatgccaatggaacagaatatcagaaactagaactctcctggaagttaaggaatataaagtcaatgaaaatataagattatctaagattgcaaagagctactgtaatgaagggaggtgggacagaaatattctaaaggatagcaaacaatatgaagcagaattagaagttgatctgggatatacaagtggcaga

SEQ ID NO: 121202 - DNA, 469 bp, Homo sapiens
tccaaaggtaaccaatattatctgcttcttacttatccttccacatagcactgtacttattttcacacgatgtaagtgtatttataagataaattcctggggaaggaatcgctgtgtcaaagggtttgttcataattttttacagaattttttcatagaacttcccaaggtgaatacatttcatttttgaataggtatcatgtgcacacggtacattaaaaaaatgtaaacagaagtcaaagtatttgttcataatttacagaatatgtttttcatagatcttcctgaggtgaagaatacatttcatttttgaataggtatcgtgtgtacatggtacattttaaaagacaatgtaaacagaagtttccacacactcttcccccaaccaccaagttcctttcacttcctagaaaccaccataagcaacttattatgtacctttccccatctgtgtgtgtgagcgtgtaga

SEQ ID NO: 121203 - DNA, 812 bp, Homo sapiens
tggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagat

SEQ ID NO: 121204 - DNA, 455 bp, Homo sapiens
tctaggacttcaaggtgtttgttctgaaaaaccattattttggttttagtcactatggtgtgctgaatataaactcccaaagatatccatgtccccatcccctgaacctgggagcattaccttacgtggtaaaagggactttgcaggtacaattaaggatcttgagacggagggagtatcccggattatccgggtggatgcagtgatgaagtcacaaaggtctttacaagaaggaggctgaagctgatatggccagaaccaggggctgccagccacacttagaggctgaaaatgaccaggaaatggattctccccccagagctgccagaggaaaccagccctgccaacaccttgacttctgcccagtgaaactggtactggccttgtgtcctcccgaactgtaagataacagatctgtgtggttttaagccacacagatcggtctctggtcattt

SEQ ID NO: 121205 - DNA, 633 bp, Homo sapiens
gtcttcttgtgctgggagctcagcagcgatcataacacagcaaatcgctgggttggaaaccttggcaggtgtttcctttgattctagacttcaggggctgtggctgtggttgcaaaacctccactgatgatctgatccagagatctaaggccttgaggatagaacatccctcatcctagcaggaaataatgaaaccttctaaccttaaagccctttggaagaaatgaatataaacatgtgagtctctagcgttgctgcgatccttcatattttacggcacgcattctcatttaatcctcaataacatgaaggagcaattggtcacatcagccctaagttataggcaagaaaggcacttgtcccagatcttgtggtgaggaccagagcttaagctagacgcagtggctcatgcctgtaatcccagcactcagggaggcagaggcaggtggatcacttgagctcaggagttcaagcccagcctgggcaacatggtgaaaccctgtctctacaaaaaaaaatataaaaaaaattagccaggtgtggtggcacacacctgtagtcccagccactcgtgaggatgagatgcaagtatcacttgagcccgggaggcggaggctgcagtgagccatgata

SEQ ID NO: 121206 - DNA, 406 bp, Homo sapiens
gtgcagtggcacgatctcggctcactgcaagctccacctcccgcgttcacgccattctcctgcctcagtctcccaagtagctgtgactgcaggcgcccgccaccacgcccggctaatttttttgtatttttagtagagacaaggtttcaccgtgttagggagaatggtctggatctcctaacgtcatgatccgaccgcctcggcctcccaaagtgctaggattacaggcgtgagccaccgcgcccggccgagcttttatcattgttaacccacacagcagagggagccattgaaagcgagtgatcggtttggatgcaccttctgaagtgatcgctttggtccctgtgaggagtgcagattgtcacagggccaggggaagacagaggccagtgaggaggcatttgca

SEQ ID NO: 121207 - DNA, 123 bp, Homo sapiens
ttcactcttccttcctcctgcagtggtcatttattgagcatctactatgtgctagggtctgtgctacatgctgggatacagcagtgaaaaaaccaaggctggtctttggtctctaacttagag

SEQ ID NO: 121208 - DNA, 297 bp, Homo sapiens
tttctcataccagaaaataatgagtctacctagagggtttacgaaatgctttaggaccatgcttagcatgggaaaacagtgaatagttaacatagtgagcactaattatgtactaggtactgttttagttgctgaagatacaaaaaagatgaagtctctgttctcatagcatttattttccagtggaggaggacaaaacaaataaaaatgagcatgatgattcgtgaaacttacaaacataatttctgagcaggttagtgagccatgattgcaccactgcactccagccagagtgac

SEQ ID NO: 121209 - DNA, 486 bp, Homo sapiens
cctgcagtgtgccctgtgagcacacacactggcgcttgttcagacacaattgggggtaaactccatgccacttcgtttacttcctcctcttgttccataaccatgtacccctcatgggcctcggcatcggtggataccaggtcatgctgttacatagctacaagaatttgaaaatgagttaaacttttctctgtgtttcattataagactgataagttcttattgtttttaacatgtaaacaccagtgacagtcaggagtcccttttcccttcctctccaaccgtgctctcttctgagcctctgccagcccatctgccttcgcacatgtatgtactgagattaacacagatgcggcgtggcctagcatgtgcctcttccaccaagcagtgggtgtcaaccgccgagtgcacatcggaagctacccagccatctaatcggccaccaggcgtcccggcagatggccacccctggacgtctgctctcaa

SEQ ID NO: 121210 - DNA, 149 bp, Homo sapiens
tgaaggtttcctttcccttctgccccccataccagtccatctatttagtagatgtcctggtttctacccaggatatcatggaccaggggttctgtcttccagccttgagtacaatggtgcgactatagctcactgcagtctcaacctcc

SEQ ID NO: 121211 - DNA, 230 bp, Homo sapiens
caaaccttgccttctgttcatgtttctgtgtaatctcctcgccttgagggtgtttggaacttgggactttctgctaatgaacagaatttagaagtgatagggtctcacttctgtgactaatttaccaaaagactgtagcttctggcttgttcatcctctcttgctctttcactcactctgatttgcacctgctgccataatgggagctgccctgtggagaggcccatgtg

SEQ ID NO: 121212 - DNA, 181 bp, Homo sapiens
ttttattttaacctagttttccagtttatatccagttttctaaatgtcccctaagataggttgcagacttctcaggttggtttgtaggaagttatgatgaaaacaccgaattgccgttttctatttattaaggatgtgccgtgtctagggggaaagtctcatgtgagttattttatactgt

SEQ ID NO: 121213 - DNA, 521 bp, Homo sapiens
tggacaataagggcgaaactccatctcaaaaaaacaaataaaaaaattatttatgagtttctaataatttaaggcttaaattaaagccattataaataatatgaagaattgagtgctctatataagacaatctttgcaaaagactactggttctctcgcaaaccatttgtttactaacatgacaacagtcacatgagaaaggcaaataaaatcaaacccacaaacttccccacctccccttatcaaagacacacacctgaatagcgtgatcagtgacacgttaacttgcattgggacattttaaattacctactacagaagtagtttatttctcaactgtaaatatactgaatattcgtgagaattcattgttctgagtttgctttaaaacgtttttataatttacaaaacaccacacagtaaaaatgttgatagaaaatatacaaatataaaattacagagcacaaggacagaattttggtacaaagagccaagactaatttagcaaatggtaagacttt

SEQ ID NO: 121214 - DNA, 493 bp, Homo sapiens
catgatttatagtcctttgggtatatgcccagtaatgggatggctgggtcaaatggcatttctagttctagatccttgaggaatcgccacactgacttccacaatggttgaactagtttacactcccaccaacagtgtaaaagcgttcctatttctccacatcctctccagcacctgttgtttcctgactttttaatgattgccattcgaactggtgtgagatggtatctcattgtgattttgatttgcatttctctgatggccagtgatgatgagcattttttcatgtgtctgttggctgcataaatgtcttcttttgagaagtgtcagaaataacagtatttcttttacagagtttatataaaagttcaataagatcatgggtaacacatttagtacagagtctgcatcatgtgttcaggaagtatttacttgctatgataattactattaacaataaagatcttaaataatttcatatatagaatgtctt

SEQ ID NO: 121215 - DNA, 924 bp, Homo sapiens
acgttctactctggccaccacgatcttggcagcccacacctgatcaggacctaaagcgtgaagggtgtgaatgaggagaaacgaggaccgcctgctaccccagcgtctggccccctggggactgaaggctggctctggagctgtacctcggcaactgctataaggctgccgaagccgccgccactaaggcggccgccagcagcctgaatgcaggttatatgtcccttgaaggagttgagtaaatacaggcagtatgtgactagtttaaaattagactttgaaagaaactgtataagagaacaaggtttcactccaatcacccaggctggagtgcagtgggatgctctcagttcactgcagcatcaacttcccgagctcagccggccaacacttatggaaaatagaaagaacctatgttgaaatattgggggcaggttcccccaatacaggaccacataagaagaaatcttgatctctgtagacaaattgaagaggcaaaaaagtcctgttgtgtctgacaaaaattaagtcgtaaatagagaagcaagagctgaagaatgacaccagaaaacctgaggacaaactggctggaagagacgggctctcactctgtcacccaaactggagtacagtggcacaatcatagctcactgtagcctcaacctcctgggctcaagtgatcctcccacctcggcttcccaagtagctgggactacaagtgcacaccaccatacctagatatttttttgttgttgtttttggtagagatggtttctcattatgttgcccaggctagtcttgaactcctgggcttgagtgatcctcctgcctaggcctcccaaagtcgtggaataataggcatgagccgccacattcagcctatttttaaaaatattttagaaacaagcacttctagagaaaaac

SEQ ID NO: 121216 - DNA, 181 bp, Homo sapiens
tcaaagcactcactaagggtcaagtccatactaagctggtacccgcctcaattattttatcctcagagccaccttggaggcaggaacaataagtatctccactggaaagatgaagagactgaagttcagagagtaagtggtgggtagccagatttcagcccaggcctgcatggctccaaag

SEQ ID NO: 121217 - DNA, 413 bp, Homo sapiens
ggctcactgtatgctctcagatcaagggaaaggacactacggttgtggttgccgctattccaccctcagtgtcctcatccgtcatgtgtgttgaacacactctgtgtagccccatgttctgtgggaagcctggagctcctgaggcctctatggggcaggccctgctcgagcagggtagtttgcacagccaggctttcccaccttccctcaccctgagctgttctgcttggtttggtgacatattaaaatgtttgcacaccacttacctggtgtaaagggcttgggacatgtcaatctccagtcagcatcctctgttcactcacccttcccaagctctgtgccacaaacacacacacgcacacacacactatacaatacatccacacacataatacacaaccacaacacacata

SEQ ID NO: 121218 - DNA, 233 bp, Homo sapiens
ggcggggccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccg

SEQ ID NO: 121219 - DNA, 574 bp, Homo sapiens
gttctctctcctggcactctcatcccctgtcctctacaattctcagttcagaactgagtgtgttgtattcttagactagacacagggagcctgctgggagctctcccagtccaggtcctacccccgtttcagcacgtagtttgtacttgcttattagcctgatgtcccaccagagggataggtccttgtctacttagcacacctttgcatctcttgcacccagcacagttcctgccactggataggcatatggtaagtgtgtgttgaatgaatgaatgaatagatcaattaaggattctaccgttcaagaaaggagacacctttacttataggtagaagttgatatatgctatgagaatcatacaaatagactataaagtgtttctgaaattccaaaaatggataaggagaatttatttgaggactccatgagattttacagtggagaggacgctgaagatgaaccttaaagaatagggagcatttggacatgagtgagctggggaggaggaggagcgtgggtgaccaacaaggagtggaaagtggaagaatgtgaagtttccttcaatttctg

SEQ ID NO: 121220 - DNA, 500 bp, Homo sapiens
cccagaagtgtcccaggctcaacaagtcccagaatggaacctcattggctatgaggtcgattcctgagtcaattgtaatggctagataagggaagcaatgctatgattggtctggttggagccatatgcccactcctggagtctgcttctcccaaacacatggactgacacttggtattatgttgtacctacccactcccccaaaaatattgggatgatatttccagaaggagggagaatggatgcttgtcaggccataattaaatatattcacctcaaatgaaatattcaccggcagtttctactccatatcattcataattgcaataaggatttgccttctagaccagaattgtgcaatagaatttttttctgatgatggaaatgtgctgtccaatacaatagctgctaaattttttattgtatttagttagaaataatgtagtcaactgtggctaagctagaggctgctgacttagaaacacagtcataggccatta

SEQ ID NO: 121221 - DNA, 442 bp, Homo sapiens
cttggatatggagggagtgagagggattcagaatggtgatttggcagtgcctggtatctggaggctaacaataaagaccaataaagactgattgaagacgacgcctgcactgaaatctatccccacctggctgatgatccttgcacacctgtgaaacacaggacttgggttatcaactctgcatggttgctttgatggagatggagctccttgtggacttaaggttttttcagccttttgttcctttttcctattcttgattcccgtaccatccttttgggcatgtgtaggatttgaagaaaattccttcagcagaggcaggcaggagtgttggacttgttctcagttacatgtggattgagataaaattcaaaccttgctccttctgctcttcctttcttccatggtgttctcaaaactgtacttctcatctaaatatggt

SEQ ID NO: 121222 - DNA, 493 bp, Homo sapiens
ctgggactccaagcatgagccaccatgcccagccataatattttaactttttaaataaaaagaaatgtattcatatataacttgtataataaatgcttttaaaaagtgagctcattaggtctagccatcctggtagtctctgggtatcaatggttctcatcctgggcagtgcctcagaaccaccagggaagcttttttaaagtatgcagcctgacactgcactccagcctgggcgacagagagatcccttgtctcttaaaaataagttttttttttttttttttaaattgtgctgcctggacttttctgcagatcaattgaatcaaaatctctggagacttccatcttaagctcttcagatgattccaaagtgtggccaggattgagaaccacatgtggagaaaggaatagactgtgtccttcaaacaattaccagtagactcccaaagagaatttgataaggatccggtggaaggtcctttgaggcatatta

SEQ ID NO: 121223 - DNA, 474 bp, Homo sapiens
tcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgatgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggcttt

SEQ ID NO: 121224 - DNA, 584 bp, Homo sapiens
tgtggttttcattcacatttctctcacccatgatggtgaatagtgagagagagagagacactgtgtgtgtgtgtgtctgtgtggcatttagttgttgcttgtttgtagtcttgtgttctagtctaccagtaatatttccttagactttcactgtcattgatgatcttgacacttttgaagagtgttcactagttatttgattgaatattccttagtttgagtttgtccagtgttctctcatgattgaaatgagattatgcatttttggtaagaataccacaaaaataatgatatgttcttctcaatgtatcattacatgagattcatgatgttgatatacctcaccgatgataatattcacattgattacttggttaagttggtgtagggtgggtttctctgccgtgaaggtagtatttttctctccgtattttataagtatctcggggtacttttgagactgtgaaagtcctttttctcttcaaatttttgcctgctattagcatctactggtgaggcttgtttgtgacatttatggctatggtgtttacctagccataggctggagtgtagtggcacgatat

SEQ ID NO: 121225 - DNA, 747 bp, Homo sapiens
ggctcaagcgatcctcccacctcagcctcccgagtagctgaggcacgagaatcgcttgtacctgggtggcagaagctgcagtgagcagagatcacgctactgcactccagcctgggcgacagagagaaactctgtctcaaaaacaggaaataagcattggtatgatgttgttaactatagatcttatttgaaatttattactttttcttttactagtgtctgttttgtgttccaggaacctgtgtggcatttagttgttgcttgtttgtagtcttgtgttctagtctaccagtaatatttccttagactttcactgtcattgatgatcttgacacttttgaagagtgttcactagttatttgattgaatattccttagtttgagtttgtccagtgttctctcatgattgaaatgagattatgcatttttggtaagaataccacaaaaataatgatatgttcttctcaatgtatcattacatgagattcatgatgttgatatacctcaccgatgataatattcacattgattacttggttaagttggtgtagggtgggtttctctgccgtgaaggtagtatttttctctccgtattttataagtatctcggggtacttttgagactgtgaaagtcctttttctcttcaaatttttgcctgctattagcatctactggtgaggcttgtttgtgacatttatggctatggtgtttacctagccataggctggagtgtagtggcacgatat

SEQ ID NO: 121226 - DNA, 747 bp, Homo sapiens
cctgaccttgtgatctgcccgcctcggcctcccaaagtgccgggattacaggcgtgagccactgcgcccagcccaaagtttccttttatctctcaccccacttctaatgttaacagctcacattactataaaattatcaaaaacaggaaataagcattggtatgatgttgttaactatagatcttatttgaaatttattactttttcttttactagtgtctgttttgtgttccaggaacctgtgtggcatttagttgttgcttgtttgtagtcttgtgttctagtctaccagtaatatttccttagactttcactgtcattgatgatcttgacacttttgaagagtgttcactagttatttgattgaatattccttagtttgagtttgtccagtgttctctcatgattgaaatgagattatgcatttttggtaagaataccacaaaaataatgatatgttcttctcaatgtatcattacatgagattcatgatgttgatatacctcaccgatgataatattcacattgattacttggttaagttggtgtagggtgggtttctctgccgtgaaggtagtatttttctctccgtattttataagtatctcggggtacttttgagactgtgaaagtcctttttctcttcaaatttttgcctgctattagcatctactggtgaggcttgtttgtgacatttatggctatggtgtttacctagccataggctggagtgtagtggcacgatat

SEQ ID NO: 121227 - DNA, 657 bp, Homo sapiens
tggactgggacaacctcgggacccgtttatagcaccatggtactggacatgttaagggtgaggtgtctaagtacacttccaaatagagacgtcaagcagacagttggacataaaagtctggagttcaggtaaagaagagtaacggaaatgaacacgtgagactcttaagggcacacacagaggttacagccattagaatgaatgagctttctttcccagggagtgaacagagacaaaaagtagacaagatatctgaggacttatccttaagaactccaaaattataaacatgtagagtctccacagcaactagcaaaagataaaatgaggagtgagatgtcccaaaagcaaaagaaagaaaatggttcaagaagatgagagaggtcaggtgcagtggttcatgcttgcacttccaccacttagggaggctgagacaggaggattgctttagcccaggagttccagaccaacctggataacataaagagacccagtctctaccaaaaagagaaatgatctagcagagtcaccaaaagagtatccagtggggattcaaaaaagcttcttgccaaagagcatatgatcccaacaacagagatctcaccaaaggggcataaccacggtacggtcaaccgggggcgtgcaggtgacctatgc

SEQ ID NO: 121228 - DNA, 380 bp, Homo sapiens
caggagtctcccttccagcagagaggcctcttgtgcactctgtgctcgcctgggggccttttctggcactctgggcacacctggagctcctggggactgggaccacaggcagggtgactctccactgccccgagcctcctgcccctcaccaggccctgttagcatcacctcgggcacctggccacagcaggggccagtcagggcaccccgggatagcacgcccaggccctgtgcaaggcctctggcacttaggagaggcttttgcccctttgtcctctgagcagaagggttggcaaagagggaaggggacaggccagttctgcacctggcctttctccagaatgaaggcctccacctcccgtccgtccccacagaaagaa

SEQ ID NO: 121229 - DNA, 212 bp, Homo sapiens
aggggaggggttcctgcagcaaatggccactcccaggaagccaggctgatcgaggaaaagggtttgtctgtttgccttttaaaggagacggcccagggaggactcggtggacacagaagctccaagacttttcttctgatgctttcctttaaatttctttttttttttttttgagacagggtcttgctctgttgcccaggctggagtgcagt

SEQ ID NO: 121230 - DNA, 561 bp, Homo sapiens
ggaatcaacatgcaaagtttcagtacaattctgggatcccagaccccctaaagcccaatccaaagacctcaaatgaacaactcctgggcccagttcctttctcaaccttctgcctcaggtgtccaatgtcccagaggctctttcctgattaaaaccaccttcactgactgatagaaagttgtttccaggttataagagaatacaatttctcttgaagatttttcattttaactagaccccaaattacagttgataatggggtgttacatttttcggtccacagaatcagtgagaaacgtttaaggggaaagtgaggggcaaaattggtaccctgatatcccatctgtgggccctcagactgacagactcacactgtggccctgaagagggcatcaaggctcatggaatctccaggtttctgccaaggagggttccagtgcatggagggcacacggagtgtgcgcctgtggaggccactgtcttcacctccaacactgagtaaatctacaatatcctagccactagccactgttttaggctctaggctgtaggaatatgggg

SEQ ID NO: 121231 - DNA, 699 bp, Homo sapiens
ttttgcagaagcctcaagataacgtactacacataaattctgcactgagtttccatgaattaacagactcattaaaaaccatcagttaacaacccctggagcacgcagttaactttggaaaaatggatagatgctttcttccaagatcaaaagacaaaagacgtcccaaagaaaggtgaagagggaagaaatgcagaagctcacatcaaatggcctggctccctgagcaatgtttctgcctatgtactatgtgccaagcaggccacagcgcagtttagatgttccaatccagtctaagtggtgtggccgagccaggacaggcaccacaggaactcagaagggaaggtacagcctggcctcggacggtgaagaaatgcttcccatggggacagcgcatggtctccatctcagaaaggggcgaatcaggcaaagacagaagaactcactggaaagaaaaccctgcacaggccaggcgcggtggctcacacctgtaatcccaacactttgggaggccgaggcgggtggatcacctgaggtcgggagtttgagaccagcctggcaacatacaagatctcatcccccccagaaaaattttgattagctgggtgtggtggcccgtgcctgtagtcccaggtacttgaaagcctgacgtgggaggatctcttgagcctaggagttggaggctgcagtgagctatga

SEQ ID NO: 121232 - DNA, 203 bp, Homo sapiens
tttagatcccacttccttcatgcctttgcctggaaaaatatatttatgtcttcactgattcatacaacccagtgcatttcatgagtagctgcctactatgtgccagacatggggctccacagtagaactacagatctgcctgggattgacagagttcacaccctgtgttcaaacgcttctctttcatgaagtttcccctcatt

SEQ ID NO: 121233 - DNA, 280 bp, Homo sapiens
catggatgatgcctgtgtgttgctgaagacttaagctgtttattatcagtattctcaaaatgttattaggctatgttgagttttagagtttcagagaaaatactttataaaatggaagcctcctgtgccagggaggaagaggaggttctctgaaggatggtgccctgtcccccagaacagctacaggcataccttatcatctgcatcgtttcaaaaccaaaggtacagatgcattttgatgtcttggggaagttttaaagggaacatgcaatacttcagc

SEQ ID NO: 121234 - DNA, 103 bp, Homo sapiens
tcaaaaagagtgagagataatttgcccttctggctttttgttcattgtttgggccctagggattggataatgccagcccacactggtgaagtcagatctctgc

SEQ ID NO: 121235 - DNA, 686 bp, Homo sapiens
gcgcacgtgtgtgttttgtgtattattgtcaggaggcagggatggtcatggaggtcccaccccaaggctgcaacctacaaatgacacgtctcagccctggtctttggccttgacttacaccagatcagtgggaaaaagaaacatgtaggtaaagttgatccttgaacaacatgggtttgaactgaacgtgtccactgatttgtggattttcttccacctctgtcattcctgagacagcaagaccaaccctcccactcctcctccttctcctcagcctagtcaatgtgaagacaaggatgaagacctttctgatgatccacttctacttaatgaagagtaaatgtattctttcttccttatgcttttctgaaaaacattttaacatctaaaatatgtgttaattggctatattattgataagacttctctgttcagtaggctattagtagttaagtttttggtagttaagtcaaaagttatatgcagatttttgacatgtaggggagaggagattggctcccctaatccctgcattgttcaagagttaactgcaattgaaaataaaagcaatgctaaattgttacacaagtataagcaactagaataattgttttttctcctgatgactactctgatggttttcaaataataaattcaataaaatttttttatttcaggtgcccctg

SEQ ID NO: 121236 - DNA, 217 bp, Homo sapiens
gtacagacaccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaa

SEQ ID NO: 121237 - DNA, 760 bp, Homo sapiens
cgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactctgtctcaaaaaaaaaacaaaaaaaaacaaaaaaaaaccacaacattgctgtcttacaacctactctttccggtacccaatactccacaatatttttcatctttataattaggctactaaccacctaagagaactgttcataattgatgacagtaatgaaggtgcctcagaaacaatgaacaggttcgcttctgattgctgcaaagtacctgggtagctccgtcacctgcaaaggcagaggaacaatacccagggtctaataattgcttactcaaactaacaaaaggagaaaaaaaaagaggaagtagagaaggggcagcactctaaattatttaatgtgattcccatgcttgggaaaacactgaattcatgcaaccagcaggagctggaatgctcctcagtataaaaggcaccatataaaaagaattactgaatccaaatgcaatattcattttcatttaacatccaactacctagaggattgaggtaatga

SEQ ID NO: 121238 - DNA, 287 bp, Homo sapiens
cctggccaacacggcgagacccccatctctataaaaaataaaaaatattagctgaatttagtggcatgcacctgtagttccaactacttgagaggattgctcctggtgggaggattgcgttagcccgggaggtcgaggctgcaatgaaccatcattatgccactgcactccagcctgggcagtagagcaagaccctgtctaaaaaaaaaaatccacagaaggttgaaggtaaatttaataaaatatctcaaaaaacagaattaaagaaatatttaaaatatgaaaaa

SEQ ID NO: 121239 - DNA, 449 bp, Homo sapiens
tctctgcccttcactaagaaagaggtgtgtcatggcagataacaacaaccagtgtataccaaaactgtcttagttggcttgtgttgctgtaacaaaatactaccgatgggatagcttaaacaacagacatttattatctcaaagtcctggaggctagaagtccaagatgcaggtttctgccaaggtggttcctgtgagggctcacctcatggcttgcagacagctgctatgtcctcacatggtttctcctctgaattctcatagaaaaagagagagagggagctttctggtgtctcttctgataaggacagtaactatattggatcagggtcccacccttatgacctcacttaaccttaattacttccctataggtgccacctccaaatacagacatactgggggttagagcatcaacatagacattcggtagtagagggatgcgattc

SEQ ID NO: 121240 - DNA, 166 bp, Homo sapiens
atgggagttaaattctaattgttttaatctaatagccaacaaacaaatttggaacaactagaggacaataaaaacatgtctaagttctaaattgatgcagaattccattgctatagggattcagagaatggagaagaggccaagaccaaggagctagacccaatgg

SEQ ID NO: 121241 - DNA, 619 bp, Homo sapiens
ggaaaaaccaaagaggatttgaaacattaataaaaactctatgcaggatagaaagagaagctaacaagaataggaagtgatttatttcaggataaaacaatattaaagagaaaggcccactaataaacaaggtcatacgactctaacaaagcccatctttaatggaaaaattaaatccatttttaaaagctaactttagtggttgctttggcaacacataaaatttattatactaaaaaaattttatttatttttttatactaaagaaattaaaagtgctgggattacagacgtgagccaccgcacccggcctagaacctctttatatgtgtctgcttatcagtcgtccatctaagcttgaaaattttcaaggatagggaattgaaggaacattaaggtagccgttttaagtttgaaaagatctttctaccagctgggccaacatggtgaaaccctgtttctactaaattagctggccatgatggcaggcagctttaatccttgctactcgggaggctgaggtaggagaattgcttcaacccccgggagggggaggctgcagtgagccaagatcacgccactttactccagcctagccgacaaagcatgactctgtctc

SEQ ID NO: 121242 - DNA, 419 bp, Homo sapiens
agtacggcagagcaggacaaagaagggtggaattgaaattgacagtcaataatttgacaactgatgcagatgggttctgtaaggctcagatgaaagcaggaggagttttagtacagttttacattacctggtcagaaatccagcagcctagagtagtagggagagaagtggggttgcagcagcagtggcagggagcttctcctctgggctggtaagttgcttttatactcttgtttcacaaccaggaggtggctggaaaaatgcatgtgttctgcagaaggcgtacctatcagcatcaaagataagacaggaatatgcactccagaggatttcccacccacggtgcctccctgcctggatgcttctggaaaccctagtgaggtcagataggctcccatctgccccacagcaatgagtgt

SEQ ID NO: 121243 - DNA, 275 bp, Homo sapiens
tttggcctctgcatactggattcagctgcccctttctggccactcagttctcatttgggcctgaaccagctcagcctgcattgcctcatggtctgtctgaacaaattggcaggtcctttctctcctgatattgctctgatctgacccttcctatgtcgccccccagctcctactcctgtccaagccaggcctggcttgctcaggtctgttcgggggtttgaggcttttggacagcatacagagacacagatgtgttataaaagaaactctgtata

SEQ ID NO: 121244 - DNA, 301 bp, Homo sapiens
ggcaagggaggaacaaattcctaatgaaggctgttgagcagctggatccaggtctgcttgaacccaaaagttccataatcttggacttggttgctttagacaatatatcttctaaaatttaatgcaattaatcatgtatgagtcagatttctataacttacaactaggagttctaattaatgtcctatgaacttgtttagctgtaggatgtcaagggagtcagtatattttctcactgaccttttccctaagggtctcactgggtgcatagttatgtacactcatacacttccactgcagc

SEQ ID NO: 121245 - DNA, 596 bp, Homo sapiens
taaagtgatgggattacaggtgtgagccaccatacccggcctaaagcaacccttgaggtccctccacagccaggcggctggatccacactaacccccaccccacggcacccccaccccaccgtgaggcttctccccacaagggcattggccgaggcttcgtggctgtggatgaatgaggccaacatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaa

SEQ ID NO: 121246 - DNA, 359 bp, Homo sapiens
tgttaaagccatttctacatgataaaaaattttaaaaagaaaaatatcctctgttcgaactgagggtcagtatttgccctcctcaaagaaactgtaggaccaaatccactttgtttcaatcagcctttacccaatgactttttacagagaacagtttgtgagacccatcaaggtactcttcattatgtgtctgttatagcctgtaatacccacctcactatccataccctattaatgagcacgcttcgcgcttcctggcccatgaccctgtctgcactcccttccatgatgctctctggaacttttgctctatgaccaatactaccctgcatccataataccttggaatggtctttctg

SEQ ID NO: 121247 - DNA, 736 bp, Homo sapiens
gggttataagagtgtttgcaagtgtcatgatggccacaaataaaaaatgttaatatgcaacaaataaaaagcaaataagtaaatcatatcaacagagaaattcatctttgattaaaaaaaaaagaaaaaaagaaaaaaagaaagaaggaaagaagaccacaaaccaccaggaaccaaatattaataacaaaatagcaggagtaagttcttacttatcgataacaacattggctgtaaatggactaagctcttcagtcaaaagacatagagtggctgaatggataatcaaaaaagacccttgatttgttgcctacaagaaacacacttcacgacttcacctataaaggcacacacagactgaaaataaaggaataaaaaaaaaatgccatgacaatggaaaacaacaaagcaggagtaatagtatttacacaagaaaaatagatttcagaccaaaaatataagaaaaggcaaacagggtcattatataatgataaagggttcaatttagcaagaggatacagtaattgtaaatatgtttgcatccaacgttggagcactcagatatataaagtcaatattattaggagtaaagggaaagatagacctcagcaatagtagatggagacatcaacaaccactttcaacattggacagaccttccaggcaaaaaatccacaaagaatcatcagacttaatctgcactgtagataaaatggacctattaaatatttataga

SEQ ID NO: 121248 - DNA, 296 bp, Homo sapiens
cattcatctgctgtgtgactttgggcaagtgtcttcacttctctgagcctcggtttactaatctatcatcacagttttttgtttttttttgagacaaggtctcactccgtcgcccaggctggagtgcggtggcacaatctcagctcactggagcatccgcctcccgggttcaagcgattctctcacttcagcctcctgagtaagctgagattacaggcgcacgccaccacgcctgattaatttttgtattttttttggtagagacagggtttcaccctgttggccaggctggtctt

SEQ ID NO: 121249 - DNA, 198 bp, Homo sapiens
aagcatttctttgtaagaccttgaacctcatagctcactcatgaagaatatttttattttattttcattcttttttgagacagggtcttgcccgggctgaaggacagccgcacaatcacagctcactgcagcctccacctcctgggctcaggtgatcctcctgcctcagcctccagagcagctaggactacaagcgca

SEQ ID NO: 121250 - DNA, 1672 bp, Homo sapiens
ttcccgggttcacgccattctcctgcctcagcctcccgagtagctgggactacaggcatgagccaccgtgcccagcctcagcttttggttttattgatttctttcttttgtatgtttctgttttttcgttttttgttttggattcctgctctcaatgtttattattccctttcttcatcttgctttatatttactttgctcttctttctctgttccttgagacaaacttggttactgactttagatattattttttaatgtatatattgaatgctataaacttccctgttaacactgctttgtctgcatcctatatgttttgatatattgtatttatattgttctttagttcaatccatgttttaatttctcatgagactttgtttgttacctatgtgttatttgaaagtttcttgtttcatatccaattgtttgagggaattttccagatttttttttttcatttctaatttgtatgatctcaggatgcaccttgtatttttttctatgtttaaataattaattgaggtttatttaataagccaaaacatgatctgtctttgtgaatgctacatataattgagaagaatatgtattctgttgttgcttaaagtgttctatcattatatgaagttgtttgatagtaatgttcaggccttccatatcatttgtgattttttacttgttttattaatttcttagcagtgttcaaatctcaaactaattttagatatgcctacttgttttttcatacctcatttattgtcttattcattttgaaaacctttgattaggtgcgtatacctataagattattatgtgttcttggggaaataactgtcttttcatgaggtttctctttatcctttgataatctttcctgttctgatgtctattttgtttcatattaataaatattttcaacctatttctttggttagtgttttatgctgtatctttctccacccttgtacttttaatcattgtatgcctttatagtttgtgtatgtatgtatttcacagtaagtaggtgggtggttgggtttttaggtaggtaagtaggctaaatagataggtgggttggcttgtgttttattccatgtgacagtgttcatccttttactggtggtgtttagaccattacaatttaaaaaaaaactttatttgggcaaaacttatataatttactcattttaagggtacaattaaattatttttagtaaatttagtgagttctgcaactaacaccattattccagttttgtaatgtttttaccaccccagtaacatttttcataccactttacagttaacctttgttcccatcctcacccccaggcaaatactaatctactttcatctatgttgatttgccctttctggaccttccatacaattagaatcatataacatatagtattttatgtctcagttcttttacatgggttaattattttgaggtttgtctatattattatatgtatcagcctttcatttagtttatttgtaaataatattcaattgtgtcaatatgtctcattttctttctccattaaacacttgatgggaatttaagtagtttctgtgttttggcaattatcaattatgcgtctgttgacattcatgtggaaatatttaagcggacgtgctttcatttctcttatgtaggatt

SEQ ID NO: 121251 - DNA, 890 bp, Homo sapiens
ttcagatcttgctaactctccccaactgttccctgcagtggagtcagggaaggcaaccgacgcaagagtcaggagagctttcgggtgctaccgaagcctgaatgcatccttgagagggaggaagaggtcagcatcaagtccaaagggaggatgttgagtagcgtaaggagacctggtttatccttcatcacatacacaaacctgcaactaccatatgacccagcattttcattcttgagtgtttatcccagagaaatgaaaacttaacgttcttgcaaaaatttgtgtatgaatgttcatggcatcttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcactccagcctgggtgacagagtaggactctctcaaaaaatgtctttgatgagcagtaaagttactagtttcattaaatatggacccttgagtacgtgtcttcttaatatggtgtgatgaaaagggaagtatgcgtgaagcagttctgcaaactgaattttaaattatcttgaggaaaatcacctgtaacattgtcagcaagctgtactgctcactttttaaaatttacaacattatacttagaagaataactaatagacaagctacagttttttacacttgggtattgaccagatatgtttttctaaataaaatgggcttatcctttcaa

SEQ ID NO: 121252 - DNA, 792 bp, Homo sapiens
ttcagatcttgctaactctccccaactgttccctgcagtggagtcagggaaggcaaccgacgcaagagtcaggagagctttcgggtgctaccgaagcctgaatgcatccttgagagggaggaagaggtcagcatcaagtccaaagggaggatgttgagtagcgtaaggagacctggtttatccttcatcacatacacaaacctgcaactaccatatgacccagcattttcattcttgagtgtttatcccagagaaatgaaaacttaacgttcttgcaaaaatttgtgtatgaatgttcatggcatcttgttcatgatagtaacaacacagaagtgcccagatgtcctttaatgggtgaatggctaaacaaatggtggtgcattcataacataataccacacaggaatgaaaaacaaagctgatgcacaaaacaacctggatgaattcccagagaattatgctgaatgaaaaaagccaatctctgacgtatagttacatactatattatactatttacataatattctttttttttctttttttttttgagatggagtctcacctgtcgccaaggctggagtgcagtggcacgatctcggctcactgcatcctccacctcctgggtacaagtgattctctgcctcagcctccagatagctgggattacaggcgcccgccaccacacccggctaatttttgtatttttagtagagatggggtttcgccatgttggccaggctggtctcgaactcctgacctcaggtgatccacctgccttggcctcccaaagtg

SEQ ID NO: 121253 - DNA, 378 bp, Homo sapiens
attccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaatgtaatggacaaaaacatattgtacactatttgttgaaaaatcatagcacactttctatatgagagatgctggatctcttgtatcaccagttttacagaatcac

SEQ ID NO: 121254 - DNA, 724 bp, Homo sapiens
attccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaaaaaaatacctatgatagaataaatgataaagggagaaattttaacatacaggaagcccccaacttagaatagtttgacttaaaatttttgactttatgactgatttatcaagatgtaaccccatcataaatcgaggagcatctgtatatctaatctaggtttcagatggcaatatcagaaaaaaattgaggcaatagtcaaagataatcaccgagaattttccaaaacacttcaaatacacattggtgtgtacagaaagcccaatgagtatttgaagtgattgttccccgctagacggggaacaatcacttataccaaagccttatgaaatggatgaaattttgttaaataggcaaatgtggaattcctcacagattaaccagtattttttaaaagtagtcattcctactataattaactataataaactctgatagtggtatgtcttct

SEQ ID NO: 121255 - DNA, 715 bp, Homo sapiens
ctaaccttttagaaatatgaacttgagaaagagggagcatcacttatatttaaaaaacaagagataaaacttctttgtccaggaaataattatagccattaacacctgagctcacccactcagggatggaaatgaccctcacctcagataggaccatgccactgccctcccgtaaggaactgaaaagaaatgccaatgtcaggagttccaactaaaattgaaaatacacataagacaagccatagatagaactggtttaagagtgcatgtatcttctaaaattaccacattttacttcataagtccttcttatccttgcagaaggaaggaaaatgttacttgaaggtttatacttgcggaaattacaggtagttttcattttgcatatgactcagtagtggataaatttggccaagtccagagacaaaatgccataatttgcacttaagtggaaatgaatgcaaatgtccatttgatgtaaattttacttgcttctctgaatacgttttaaagtttgcaaactgcagtatctgtgcctgccaaatattatcattttctggtttgttactggagtaggaggccataataaaagaagaacctgctgactactacatcaattttttaagtcaatttggaaaaaaaaatctttatcctcttcctttaaaatgaagtataactcctacatgttctaacagtgtttccatcctccataccc

SEQ ID NO: 121256 - DNA, 428 bp, Homo sapiens
tctgtaatgggggtgctagcgtgcatatataaaaagataagtatttttaaaaaggaaacaaaaaaaaacccctggaagtctgcctgatgtacagacaagtttaaaaaccacttgcttctgtgtatatctttccttccccaggaaagtggttcccacatctgcacacagacatgagaagtgccttcaggacacgagatctagtcccatgatcctggaagtttgtgccttgtcaggacacggtcacagccaactctcaaggaaaaaaagatgaatgacattactggttgttcctgagccataaagtggtagaattcttctgcttctagaagcctagacaagagactcctgctttcaggcaattttaaagtaaaagttgcttgccacccttggtcagctctgcagccagcatagctcctcctcaattatca

SEQ ID NO: 121257 - DNA, 325 bp, Homo sapiens
ttaaaatatatatatgttgaccctatcacaattgttaatttaaaaaatatttttaataaaatgagtctctgtttaatggaattttagttggaattaggattttctgtgggcaatagaaagcctcacatgtcagcttagattaaaagataaatttatttctgtctttaaaaatattgaaggtccagtgctgatacagtagtctcacagtcatcagggatcctattatagtaatataatagtaatctataatagatctataatagattactattctaccattttcagcctaggcttatacttcatggcccaacattgtccccattct

SEQ ID NO: 121258 - DNA, 832 bp, Homo sapiens
aggctaaatccagagatgcataagcggaagaggatttgttctggatcacaccaagtgaatccatggagggaaacctctgaggctcagtcactcatcatgaaagcatctcagatgcaacaatcctgactcagtatgctgttttcacaagggtcatgtggcatagcctgggagtacaatgtccgtgccttagtcccttatactctccaaataacagtcaaccccttagattacctaccatcgtagtttttttaaaagccgtggaagaggggaaatgatatttttactaaatctggggtacgtatcttcctggataccctgtatcttagaggctttgttaatagagattacagacgaaatgacggtagttgacttctgggtggggaaacaagttcattgaatattaaagcaagaaaaaaaaaaaggaatttaaagattattagtccaatttatcactggcaaataaggaacctgagtctgggagacctgtccccaaatcgtacacctctataacaaccctgctggattagaattagatcccactttctttcagccataccaaatttgaggttttagaggcgaagtgttctgtaggtatctttcctaggagccctattcagagctaaattgggctattcatcatttgagcctcctttcagcttgagggcttagagttgaggttttaggtcaagggtccatacttagcatagcctaaaacatactgggcactcaacgcacgttaattaaataaatgttaaattcatgtggtttagtttacatgtattctgagtgggtttctgagtgtctggaacttccaaatattttacttaatctt

SEQ ID NO: 121259 - DNA, 765 bp, Homo sapiens
aatgtttctcttaataaaatgatatattttgttttgaactttggaattccattgtggcttggcactaaattataggcctagcaatcctaaatctcctatgtcctcaatatctagaaacaagcaggaactgtttgtcagaaattaaacaggacttatttgaatgtgctttaaaaaaaaaatcaatgaattcaggggaatgaaaatacatgttagaaattaaaatgtggttatctcagctatagttaagaaaattatcaaatgtaaatgatcccttttttgctggatcttataaaatatgtgatacttaagtacactgaagttttaaagttagctgcttatattgtacaaagatatttttggctctttaaaggttattttcctatattaagaaaaggtttcttatattgaaaacttttatggtgactcaggttttgtgtctatgtataggcacacataaataggaggtgtttttctttgcacatttgttttgcacagctaaaataatgaggttaaataatgcccaggtatgcaggtcaattgacctttttaatagcttaacgaaagcatttgacaaatggacaaaagaaatcacattgtatttctttgtatctctccattcctcttacccttccccaaccctctactaaagaatatttcttatttagtcaggaaatcttatgtaatatttttggacggtccataggaaaagcaagatgaaactctcaggcagacaacataaagcagctcccatatctgctagaaagg

SEQ ID NO: 121260 - DNA, 225 bp, Homo sapiens
cacaggccaatttatcattcccctctgagacatgggctgtatatacagctatcatatcaggaagcctgactaggtccccatgtgctgcctgcacaagataacatacaaaacatggcatgagtccagggaaaggcctgttctagaaatttacatcaacagaacataaatagtccattatagtgcctgagcaatttaactggatgagtcctatcacaaatgaaggat

SEQ ID NO: 121261 - DNA, 220 bp, Homo sapiens
gggtaagcagctaatccctcggtagaactaagtacacattaatacaggctaaattttgctaaacaaaaactatcaaagtggaagagctctatgtaactatgttaaccttgagctgaaattcatattggagctgaattcaaattcattcatggaggacgaagatttatgtggcacggttaagtgaatgggcactagagacagactgcttgattcacatcta

SEQ ID NO: 121262 - DNA, 517 bp, Homo sapiens
ttgacctccccccatccttccctctctcagcctcctaaaatgctgggattataggcatgagccactgtaccaggctttaagccagtcttgtattctctagataaaccccatttggtcatggtgtattatttccttgtatatattgctgcatttcatctgctaatattttgttgaggattttcatgtctgtgttcctaatgggtgttgatctttaggtttttgtagtgtctttgtgtggttttggtattaaggtcatgccgggctcctcaggaagtgttctctcctcttctagtttctggaacagatcgtgtagaattagttttgtttattctttaaatttttggtataattcaccagtgaaaccctctgggtgaattcaatttctttaatacaggatcattatctatttgatctcgggtgaattatggttatttcctaggagttttctagttttaccttcacatttggattataccaccttgaattaacttgtgtgtgccgtgaaagagggaaggat

SEQ ID NO: 121263 - DNA, 246 bp, Homo sapiens
tacttgctaggtatatgcagaaactagacttcagggtaactgaacataagacatggaacatcctaacaccgctgacatctaaccttcacaaatgtttttgttctgctttgctttagtggctgtgataggattgcctggacagaaactaataaatgaagaaaaacaagattgtctggacttcacatactatttatctcctatgggtccaagatacaacatgtgtgactctaggctcttctcccttct

SEQ ID NO: 121264 - DNA, 3726 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgataaaaacaagaatacctacttacgatgaagatgacaacactattctttatgcgtatgaaacaaaacctgaatttgtcaataaagaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121265 - DNA, 3440 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaatgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121266 - DNA, 3436 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgacagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121267 - DNA, 3506 bp, Homo sapiens
cttctgatataataaattcttttcttgcccccttcctcaattgtcagtttttcattctcatattaatgtgaattttaaaaatctctgcttaatttaagacttctgaaaccccttgaaaagttggtgataaataaaaacaatttaaataaataaatatagctcccccctgcccccagtgttcagtttggctgttacagaaataaatcattaactacttttaaaatattagcgaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121268 - DNA, 3577 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaatagataaaaacaagaatacctacttacgatgaagatgacaacactattctttatgcgtatgaaacaaaacctgaatttgtcaataaagaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121269 - DNA, 3683 bp, Homo sapiens
gggaatacacgatttggcttaggggccggggctctcctgaggagagagggtttgctttgcggggaagagcgagtcttgacttcgcagcctccaatttcagccgcggtgtggaggggggtgctttgggtggtccccacagcctttccggagtgcccgcgcgtgtaagcttttgagatttgacaatttgtgaagtgcttggtgctgactttcggggacgacaggatccttttacagtcattctcctgtcaggggaggcaggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121270 - DNA, 3439 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctagaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121271 - DNA, 2584 bp, Homo sapiens
aatatggaagcattattaattatcgttaagtttcttctctccataggaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121272 - DNA, 3493 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121273 - DNA, 3642 bp, Homo sapiens
agcggggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattgaaaaaaaaaaacaaacaaaaaaaaaacaaacacaaacaaaaaaaaacacaacaaaaaaaaacaaaaatataaaagaaacacacaatataacaatattacaccaatgacctcccacaataacaaccactatcacaactatataaatataaaatactttttctcatctattactcataatttcaatacatctaccataacttgaaagtatttatttaaaccaaacgcacacccaaatgagagcaaaataaatgatgtcaaactagtaacgtcatcttaccagataaatatgacatacacaacacacactctagggggccggacatacaagaaaaagtggtaaacaaaaaacacaaaagagcaacagtagaacaaacatactcatacacccaccatcacacccctgcaatctacaacactacatgtctcctccaacacaacaaaacacactattcccaccccaactaccacccacatctcccccaagtcccaacccccccactaccacaacacataattaaaacccacaccccactcaacacaacatccccccccccccccccagcaaaaaatagctcgcacgaggccgcccgcctcagccgcatcgcggagcagaccagcgacaggacgatgagaagagcatcaataggagaccgataataaggcgcgagccatcacagtaacgtgcacgacgagttactagcggcacgagatagggcagccgagtaagcacagcgagccgcagcaagaaagcgtgcgcgctagaccagagaacaatagacgaccgccgcctcagccgcgctcgacaac

SEQ ID NO: 121274 - DNA, 1671 bp, Homo sapiens
ggaagcactccacaaatgccagctgctattgtggctgtgggtatgagtcagacagcccgtggattctcagctcagggctgttattggttgttgagtgagcctgcagattcactcccagcttgcagcctcagtttccttatctctaaatcgggttgatgatggccccccactgttagggatgtttgcaggagccagcgacgtgatgtgactaaggtgcacagggcctggcatgtgtcgtggctgttgtggttattagcactactttaattgttcagataaacttgggttcacatcctgtttctgtccctccctagctgtgtgacctcgggcaagtaaccttacctctctgagccttggtttccttgtctgttaagtggaacgcctaatgaagacttgctgttccctgggttgttaagatgcgtgcatgatgcggatttgaggatggctaatccccttttctctcgtccaactcttgtcactaagacctgcctgtcagtcctggtggggagtcacttgcctgcctctggaatgggaggttgcagccccctctcctgttacctggttaccatggctacagccacgtggggtcatgctcccccaccccaagttccagggccccccaccagggggccagcctccccaggttccctagcaacagtcccgggtgttggggcgccagccgggcgggagggagccaggccagctggtggtgcaggccaattttagctcccacccccggccccaggggcttgtcacccactgccccagctgcccctcgcaggggtccctcagccatgctgccttcagcgtggtgccatcccacctccagctggctgccctggcgccacctgacagggcttcttctccaggtccttatcttggtggggatcggaggccttatctccaggatctccacctgcctccctggtctctcctgggaagaagcctgggcctgtggggaagcctggctcagcactcaggaggaatcagcaggccggggttcgcatcccagcactctgctccatctgccctgtgaccttgggggagggactccccctgcctgagcctgggtgtccccgtctgaagactgcagatcataattggacccacattggaggccagggtgagggcacggcaggcagtggcggacgcgtggttagagccctggccgtggtggttggaactgcccagctgtggggaggttgtctttctgcccctgtgaatggactgtgtgaccttcacatggcaccttccctctccaaggctcagtttctctgctggaacatggagtcattccctgggctactgcaggaattaagtgtaggcgagttacctgtttacacaggacttggtccatagcatgagctgctttgtagaaatggttcatgacccagcgtggtagctcacacctataatcccagaactttgggagacccaggcaggaggatggcttgagcctgggagctgaagactagcccggacaacatagcaagactccatctctacaaaaaaatttaaaaatcagctgtgtgtggtggtgcactcctgtggtcccagctactcaggagcctgaggtgggaggatttgcttgaacccaggcagttgaggctccagtgagccttgattacaccactgcacttcagcctgggtaacagagcaaggccctgtctc

SEQ ID NO: 121275 - DNA, 693 bp, Homo sapiens
agaggcatgaatccacaggacaatgagaacagtggaagaggcaaaaggaaagagaaaagtcctcaaactttcacggctgggaagcaggtgaattgactaagcaaaccagagaaagttgaaaaccagctgcagaggagtggagaagccagggacagatgaagagtaacaagaatcaactgtaataatttcctgctatagtggcagtcttagatggttttagaagggatttttcctgaaaattctcaaatatctgttctgctctaatttgtatttgtattctgatttgtaaatacaatggtagtctttctattgcactggatttttttttttgtatgtagcttgattttatctgtttttaagaccagcagcttttagaagttgttctcatttacctttcagtcattttttatgctagcttcaatggaagaaacctattgaaaagtaatttataatttctactcctatgactttatcttctgtctccctccagcaaaggaaaaaatatgtcactcttaaaaattcataaaaaattaaagaatttaaattaaaaatccccaatatctagtggtatatttcttgtgctttaaaaaatattgtgtttctgggcatggcagctcatgcctgtaatcctagcactttgggaggccaatgcaggcaaatcacttgagcccaggagtttgagaccagcctggg

SEQ ID NO: 121276 - DNA, 665 bp, Homo sapiens
agcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgatgtacgtacgcttcgctttgcggagggttcccgcgccgcgggctgcgccgtgcgtggtcgggcgggtcgccagcggggcagggggcgataagtgtggcatgggggcgggggcgggggcggccgcttcctccctcctcggctccccgctgggcgtcctggctcgggagccgccgggagtgctaggccgttgcgcccacctggccctggtgtcagggtgaggggcgcctgcggtcttgggccacccttgcgcttggcaaactgaaggccagaggggggttgaccgcggggcactgagttgggtacagggctggggaggaatcagggtctcgtgccctccccaggcatattagggtgggaggggcatggacattgataggagtcccaggcaggagcaggattcgagagacaggaccccccactggg

SEQ ID NO: 121277 - DNA, 806 bp, Homo sapiens
tcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaggtatatgttttccttatatttgttttatcactgtgtaaaattttgattaaattagtcaaaatccaaaactaggtaaataccaagtaggaatagaaattgtgtttacatattggtctcctacaaagagcaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaact

SEQ ID NO: 121278 - DNA, 168 bp, Homo sapiens
cacgtctcctgtgggggcggccctccgaggcagagtctgatattcaaaaagaggttaaccatgtattattcatgatgaatgaagcgaacataacacggataacctctcctcaaatatccttgcatagttctgaaacgaaaaccatggcctcttccccaccgttgtctt

SEQ ID NO: 121279 - DNA, 423 bp, Homo sapiens
ccttgatgcttctaacttctgcctatcagtcctttctcacattcactttcttctctctctagactccatagctcattcatttcaatcactactagtaacatcccatttctcttgccactcccatatgcctggaactggatcaattcaaatgtctgctttctccaggcctacaacagactactccattgccaaagggggttacacacacacacacacacacacacacacacgcacacactcttactttttgaagcagatgtcattcttttgtttttttcgagagtctcacactgttacccagtcacccagggtggagtgcaggagtggggtcacagctcagtgcaaactcaaagtggggggtacaaccagtcctcctgccgtgagctcctgaagtgctgagattacaagcatgagccaccatac

SEQ ID NO: 121280 - DNA, 144 bp, Homo sapiens
cctggagcacctgaccccaggtcgtcgcctgcctcactccctcatttcacaaccatgactcccctcaaatgtcacctcctaggggaggccttccctgactgccttgtctaaaacagtacaccacccccgtctctctctgcctgt

SEQ ID NO: 121281 - DNA, 401 bp, Homo sapiens
atctgttgcagtctccctccaggtccttctcatatggcatctccccgcaaaatgttttgtggaatactaagtggtgttttattaaaataacgttttaggccaggtgcagtggctcatgcctgtaatcccagcactatgagaggctgaggcaggtggatgacctgaggtcacgagctcgagaccagcctgggcaacatggtgaaactctgtctctactaaaaataaatacatacatacatacatacataaatgagtcgtgcatggtgtcatgtgcctatagttccagctactcaggaggctgaggcatgacaatcacttgaacctgggaggcggaggttgcagtgagctgagattgcaccactgcactccagcctaggtgacagtgcgagactccttctcag

SEQ ID NO: 121282 - DNA, 518 bp, Homo sapiens
aaacttcccagtacacgtacattgctggtgccagctaggattggaagtgcaaatgacattaataccatcatcgtttttagttaagaattcctgatcctttttattgtttgagtgttttcccggtgccttttaagaaacgaggggtggagtctggctacagaaaagtaactgactcccagcttcaggcaaaactaccataaatagccatcttagagcttccactgacttccttgaggccccaaatcatggacttaagagatggtgctacccagctgaggttatttctccagcatcagaacagaagatatccagaccacaacatttattgagaaaaacgtaagccaccatctctgccaccaaggaccatactctctaattttcaaaaatatatatgctcacgaaagcacaatagacaaagtgagttttataagttacaaaagaaatagatgaaagaagagatcactatgctcttgagtgaccgtgaaaggctttatgaagaagacagggctgcagcttag

SEQ ID NO: 121283 - DNA, 670 bp, Homo sapiens
aatttagcacgagaagacagactcattgttttggcaagctcctggcctggaagtctccaacaaaaactcacagcactctatctgaaaaggaatttttaaatgcattcttagtcttgaaattgaaaatatattctagatacaacagtttgctgggaaatttaaacaatgccgtttatcatccaacaactttgctctggacaaagagctttttcatctcttccttagtgtcccttctactccattagcttttcagagctttttttaaaaaattaattaattaatttatttttttgagactccatctcaatagaaaaagaaaagaaaagaaaagaaaaatgatgatgcaagagtggtaagatgcaaggttataactcggttataccacatgcctcatgtgaaatgagcaagtttcttagtacacttgtattctctgcttatgacaattgagacactgccaagagtgttattctccttaatattttgaaatattaaggaaaaagtaatattgaattaaacaggcctggcatatggtgcctcatcatgcctgtaatcccagcatttggggaggctcaggtggcagggtcgcctgagcccaggagtttgaggctgcagtgagctatgatggtgccactgcactccagtctgggtaacagagggagaccctgtctta

SEQ ID NO: 121284 - DNA, 739 bp, Homo sapiens
atcccttgctcgctgctgctgccacgtaagaagtgtgttgcttccccttcgtcttccaccatgaataacagaatggcaattttcgtgtggtgttaatttccgtggaagaagaaaaggctcgactctctgtcctatttttcatgaatactggaagtagggaataaacctggagtctcacgggtgaaaagagacatttccatatcaccagaccacaaacgtgggtgttgattctaaggatacccccaataaacatctttcgtgctaaagcccattccagaatttacttcccagctatctttgatgttcatattgtcagaggtggtggccgctgaaacaggcaaagacatggagcatatcttgggtccaggtaaaggaggtgggtgcacacaagtgaaaagatgttgctgaagtcacgtggcttcaagcagtagagctgactgtcctctagtccagttgtccctacaggataaaagcttctctccattacagagaccttgggagtccagaggaaggtctttttaccatcagcattctctactgtgttcaatgactgtcagccaaagatggccaggttctctactgtgatggtgaattttatgtgtcaatttgactggaccatgggatgcccagctttccttcagaaagaaatgcattcaaagaacctacattcacaacataaagaaataaagcctgcacctacagatctacacacatgcccatgcacatgcaggaagtgttc

SEQ ID NO: 121285 - DNA, 386 bp, Homo sapiens
gggcgctctcaggacttcttattttccttctttataggtagtaagttttaagaaattagttatcctcaagaaactttacaagttgaataacaaatagtttttaaaaatatccataaatgtacatacatagggagtctattgctttaactttgtatatctgacattagcacagacattataattatgcactttggcaagaggaaagttgcttctgaaactgcctctttaaaacgtttatttttaaaaaattgtctcttttttttgtagacaggatctcactctgatgcccaggcaggaatacagtggcacaatcacaactcactgcagtctcaaactcctgggctcaagtgatcctcgtgcctcagcctcctaagtaagactatagg

SEQ ID NO: 121286 - DNA, 338 bp, Homo sapiens
cggagtgcaatggctagccatatgcagaagattaaaactggacccccccccttggccggagtgcatatggctgaatttgtggatggcttggatatagagtatgtggacaaaaaagagaagggtcggctgggcgcggtggctcacgcctgtaatcccagcactttgggaggccgagacgggcggatcacgaggtcaggaaatcgagaccatcctggctaacacagcgaaacccggtctctactaaaaatacaaaaaattagccaggcgtggtggcgggcgcctgtcgtcccagctactcgggaggctgaggcaggagaatggcgtgaacccaggagggg

SEQ ID NO: 121287 - DNA, 446 bp, Homo sapiens
gggggagccggcagctgctcaggaagacggtgggatttgaggagccatcacgcccagtgggacagctgagaggaatgggccacagtggcccgtgacgatggtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgttttcccagggttgaggccccttggccccgcatcagtg

SEQ ID NO: 121288 - DNA, 339 bp, Homo sapiens
tgaaagaacgatcactctccggcgaatgactctccagagctccctgtgggctgaggctggggctagacttgacctgaaaccatatccctgcatggcccctcccccctcctgcgtccctctccttgtgaatcacatgcaccccaatccccgtctcaggcttctttctagggagcctggccccagaccagcctgtatgggagacattgttaagactctccgttttacagacagggaaagtgaggcacaaaagggtcacacagtctgtaagtggctgtgctgtactgcaccgcttagatggagcccctccccaagcccatgctggtcctcctgccccggctc

SEQ ID NO: 121289 - DNA, 547 bp, Homo sapiens
cttaacgttcaagtgtataagaaacagaaacaattcaactccagtcaataatgtaaacaaatcctggtttagataagccctattaccaggctgaagtggcccagggcacctctgctactgctgattagcgtaaatgctaaacacaaaccaattaacacactctagggctgcttatctcccgtcacttagtgtggaaataaagcccagcgctaaatacacatattgatttagccattaaatccagcatcactcaaaataaaactcattatattatggggcaaaaacaaagtcaccttcgttttcaggatgggctatattatttaaaaatttcacttttacacttttccattgatttcccaaagtggcctgagtatctcctcctactgtggattttggctagctctaggacaaattcagaaagtaagcattttgcattcactttaacatgatctttgcttttagtgctaaaagtgcacacatatatgagaatcctttttctttaagatgctattttagcttagaagaggaaattttatgcttggaagaa

SEQ ID NO: 121290 - DNA, 141 bp, Homo sapiens
gaaaaaaaaaaattcgatgatacaaacagacaaagtaaaaggatgaaaaactaacatgggaacagcaatcacaagaaggctggaatggctaatatcagaaaaaatagatttacaaatgctactggtgagaaagagggacat

SEQ ID NO: 121291 - DNA, 696 bp, Homo sapiens
agggtggggtttctttcccaccctaataatcctgagggtactgcaggagaccagggtgtatgtcagtccttatctcaaccacgtaagacagacactcccagagcggccatttatagacctccccccaggaatgcattcctttcccagggtcttaattattaatattccttcctaggaaaataattcgcgatatcttccctacttgcacatccgtttataggctctctgcaagaagaaaaatatggctctattctgcctgaccccgcaggcagtcagaccttatggttgtcttcccttgttccctgaaaatcactgttattctgttctttttcaaggtgcactgatttcatattgttcaaactcacttgttttacaatcagtttgtacagttagatacaattatcacagtggtcctgaggtgacgtacatcctcagcttatgaagataacaggattaagagattaaaataagacaggcgttaagaaattataaaagtattaatttggggaactgatatatgtccgtattaaaatgaaatcttcacaatttctgttcctctgccgcggctccagccggtccctccgttcggggtccctgacttcccacaacaatttctcttcactaaaataatcacatttttgctctatgtctctgaaattgctcctaaatcccactgagtagagtttgtgttctgga

SEQ ID NO: 121292 - DNA, 495 bp, Homo sapiens
tttattcgaggtgtctggggtgaggggagggtgaaacgacaacatttaggagaactagcaatttaaggagccaagagcaatgcagcctacaagtaatggaaatgataacaattccttgttctgtacggtgctcttaggccctatgcccgctgaccccctgtgtactcaggctgcctgactgtcagaggtgatgctgctaatcctagctcctaacttccaggacacaccacggagaagatctgttttctgagcctgagcgcatcatcccagatgatggcttcaatgggcttacacgcttaatttggtacaaactaacttggcagtaagatttattgccattgtctagtattgtatctgggtttattaaaaatccccatcacatcttttccacaaagggctagcatttctgcaagcatcattaggtagtcaatgatttcagctgacacacccatgggacaatcacagtttggtggaggagactgtgtatatatatat

SEQ ID NO: 121293 - DNA, 406 bp, Homo sapiens
gatagatagatgatagatagatagatggatagatagataaagatatacttccaaaagaaatcaaatatgttaggctaatacactatgagtaataaagttgtactacaagtatgtgtgacaaaaatatcttcatgtaaatcttctgcttattcctactcagctaatgacatagagataaaatgtatctgagcccatttgtgcttactaatgtaaaaagtaataatttatttatttgtgtgtgtatatatacacatcagtgtatgtatacgcatatatgtaaatagaaaaattctggaaaaattgctaaaagatgtatacattataatgttttactatatatacttctgtaccatttcacttttccacaatgagcatgtaactacttaattataaattaaaaaagaaa

SEQ ID NO: 121294 - DNA, 346 bp, Homo sapiens
tcaaacttaagtaaagtgtttccctgagttctgtgagccactttagcaaattaattgagcctaaggaggggggtcatgagagtcccaatgtatagccagttgaacagaagcacaggtcgcaacctgaggcttgcaattaccatctgtagtgttgggtggggggaacaggcttgtgggatctgacactgtctcccagtagatagtgtcagaattgaattgatttttagggcatgcagtcggtgtccattgcagattgctaggtgtgtggggaaaaacctcaacgtatctgttgttagaagtaaattgttgagtgactgtgtgagtataagcaaaggagtaggaaaag

SEQ ID NO: 121295 - DNA, 619 bp, Homo sapiens
accaaaatggcacgagggaaatgagtgttttttatttatgatattgtactagaaattttaaaacacttataattagaagtgaatttcataatctttgattccttcaaaccaaatacctaatagctttcttaacactttgcagcatgtggttttgacttggttaaggggaaagcagcccttaattgtttactgtgtcttcagcccaatttgggaaggagatgagtgcttgataaatactattcaataaggacagaaatacaacacaattctttatattctacgtggtttaaggtaagagtcttgtgaaggcttgccaataatagggaatacacctgtagtatagaagaccaaaaagtggcatcaatctgtgttctaaatatgtttttgcttagaccagttgaatatatcttagcttttctttgtagtactgatgattccaatggaatcattcttcatttgatagatattcatagagcccctctgccataaatgctctactaaaatctagtgctacacaagtaagtgaatctcagtgtctgccctcaaagagttaactgccaattaacaaaatggaatctctcatattaagcgtttaataggtcctaatattttataaata

SEQ ID NO: 121296 - DNA, 167 bp, Homo sapiens
ggactattccatgcctaatattccgcatttccaggagtcgcctaagcgaatctggtcaccgtgattcagcattcacttgtgctgcttgctctgtttcctgatagccaaagtgaaatcacctattttttgtgccaagtgttgacactcatcatagacagcttgtgtta

SEQ ID NO: 121297 - DNA, 252 bp, Homo sapiens
ctaaagcctatgtctacaccctctagcagatgcaggctttagggcacagcacacatgaattcaaatcccagctctgtgttttgctagctgtgtgaccttcagtgagttactcatcctctctgagcctgtgtccttctctgtaaagtgaaaacatgaaactgcctcacacaaagtcattttaagaatgaaatgagaaaatgtatataaagctctcaggacacatataacacaataaagtctcgtctactccct

SEQ ID NO: 121298 - DNA, 246 bp, Homo sapiens
ttaatgaaggaactacaagccaaacccattctttctactccagattgatatatgcagttgtctcctcgacatcttcagatatctcaaaattacgtcaaacctaaaacatatttgaaagtttagtatgcagacttttttcctccaatttgtagcagcatcatctacccagaacctgtgagtcatctttaacacatccttcactacccttaacatttcccttgcaagtaccactcaagtctgtctact

SEQ ID NO: 121299 - DNA, 134 bp, Homo sapiens
ggtgcagcctcacccgaggatctcctggggccagcactgtgccagcctcatcccagcaagacccttgggagttgggtgctgttgttgtccccatttgtcacacaaggaaggaaactgaggccagagagacgaag

SEQ ID NO: 121300 - DNA, 283 bp, Homo sapiens
tgggcaaagggaaccaagctcatgcccagaaaggaggcccagccaaggtctcctgggccaatgctcttcaccttaatcctccaggaaggagctgaaccagccacattcgaacactgtctctgagcgagcccagtgcagatagctggggctatggcgtgactgggtgagggcacaggctggacggggggaggggggtctgctgggtcagctttgactctgactctctcctctgagcatgaggaaagtgtaaagcaagaaaacagggtgggcgaaccccacagcc

SEQ ID NO: 121301 - DNA, 732 bp, Homo sapiens
  misc_feature (590)..(590): n is a, c, g, or t
ctagtcctcaacagggagcctaggagcaggcacaaggaaacatgtcccctctgggtaaactttctgtccaaaattaaacaaaacaaacaaaaaacctgaatacgtctggaatctgtctgagttttttgtggatgcaggcccaccctggccctggcatatcagcaagccagttgtgggccattcttttcctccctgtttattgtcgttttttcctgcgttctttactcactcagtttccttccttttttgtcttttttggttcttttccgtttcttctctttttccttttaccttcttccattccttatatggatagcctaggaaacatcctacacttaccataggcattttttttagcctgattaatggcagtccagaactaaagacaaattttactctgatattatggtctgtaaaatcgcatgctggtgcaaattatttatttgtttgtttgtttgtttgttttttgagacagagtttcactcttgtggcccaggctggaatgcagtaggatgatcttggctcactgcaacctctgcctcctgggttcaagcagttcttctgcctctactaaaaatataaaaaattanccaggcgtggtggtgggcacctgtagtcccagcaactcgggagggctgaggcaggaaaatggcgtgaacttgggagcggagcttgcggtgaaccagaatcgtgccactggactctaccctggcgacaaaagcagactggctt

SEQ ID NO: 121302 - DNA, 199 bp, Homo sapiens
acccgcctcggcctcccaaagtgctgggattacaggcgtgagccaccacgcccgcccagaaagtgctttctttcagagggttacggtttgagaaaagcagcattgaagttgacgctgatcttggtaatacatttgcagagcatgcttatggtcagacgtggatgatggtggggttttgtttttgttttgttttttatct

SEQ ID NO: 121303 - DNA, 461 bp, Homo sapiens
ggacctgaactaagacagtgatggtagggctgatgagaaaggcataagagataatagcaagtaaagctgataggacttagtatttgggtggattcagggtaaaaaagaaaccggaaatcatttccaggtgtttagctagaaggttgagtggatggcagtgccattagctaggagagatcatgtgcctaggaagaagtctaggcaaaagaggaagaagttttagaaaggttgtatgacaggtgcctgaggtatactccagtggagatgctccatggataggggcataggagtctgaagctcagtaaagaggatgggctgaattaaatatttggaagtcatcaggacatagctattagttgagaccacgagactgaatgagatcacccaataggagtctcttaaatggaacagtgtgagtcaaggacagaaccctggggaaccagactccattagaaatctgc

SEQ ID NO: 121304 - DNA, 496 bp, Homo sapiens
gccagactaatagcaggtgccaatcatggattttaagtcagtgaacacacagttgagtgtgccatgtgttctgtacaagaaccaggtacagatgctcctctgcttcggatggtgttgtgtcttgtgtccagataaacccctcatcagttggaaatattgaaagtggaaaatacatttaatacacctaacctactgaatatgctggcttagcccagcctacctcagatgtgctgagaacactcacattagcccacagttgggcagaatcatctcacacaaagtctgttttataatgtgttgaatatctcgtgtgacttacggaatactgtactgaaagtgaaaaagagaatggttgtgtacttcagatactcacacaaccatcgtgtttttcacttctggtgaataaagcagcccttatcgatacagtttctactgaatgtgtatcgtgttcacaccatcatcaagtcaaaaaatcatcaagttgaaccgttttaag

SEQ ID NO: 121305 - DNA, 222 bp, Homo sapiens
cccatttcacctgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctat

SEQ ID NO: 121306 - DNA, 415 bp, Homo sapiens
atcccaagagtttcctgtactctaggaatcaggaaagtgtagaatacagatttgaaatatgtctaccaagattgattaaaatattaaatatattgcttaaataaagtaggccttttctagaaatgttcttgttcttgagatagggtattgctcttttgtccaggctagagtacagtggcacaggcatggcttaccacagccttgacctcctggacttaagtgatccttctgcctcagcctcccaagtagctgggactacaggcatgtgccaccatgcctagctaatttttgtatttttattttgtagagatagggggtctcactatgttgcccaggctggtctcaaactcctgtgctaaagcaatccttcctcctcagcctcccagagtactgggattataggtatgggctacca

SEQ ID NO: 121307 - DNA, 453 bp, Homo sapiens
gatgaaggctgcagctcgctgggtcttgctttctcatctgagaatgggagggggtggggcctctaagagcccttctggatcgagtgtctggggattccagaaccagccccactccttcccaaggttcagcgctagcacatccatactccccagactgtctcccccatttcggttgcggcaagactgctgtgagccagagctatgcaggcgtttgaatcgcgggtccctgcctagatggacacttcttccccttaactagttttctccctggcagccctccgtccattctcacctttcctcctcacctctagtcctgcattagaagcagccggttctccttcccagagccctccctggcagattgtgaaccgactaggccatgcctcttcacctgtggagagtggctctgaagcagggtactctctcttaccctgggccctgcactccagtgca

SEQ ID NO: 121308 - DNA, 331 bp, Homo sapiens
ttaaagatttgtagttccctgaagatatcatgcaagtgtccgtcttaaacatataaatcagcctttacttatggtcctgaaccaacctctttactcttcctgtatatctgtccattcttcaacaactcaagtcaagtaccagctcttcaagttctcctcacaggtgaggttggtagcccctcttttatattcccatagcactctctgctttttcttaacaaggcatttcccaccttataataacatcccctctctctggctgtctcttcccaacattagagtgcagtgcctgccctctgtgtgctggtcccttctaaaccctggagatgca

SEQ ID NO: 121309 - DNA, 147 bp, Homo sapiens
aactgcacatatgtgggtgaggggttcttaacattttgggccaattgttacagagattattgctgcagtttgtggatctgaatcctatttttatatagcctggccattgtccactggtctattcagtctcccagcacatagccttca

SEQ ID NO: 121310 - DNA, 439 bp, Homo sapiens
atataacctgtgcgcttatgtgttcatagcatataatcagcttttaagttttgaaaatgatttgactacttctcttagccctcttctcattgccagtagaacacattctactagttatgggttagctaaaaagtatgtgtctctatgaagggtcaaagacaaaaatcaactaatattttcagcaaaaaagaagacatatgatcatacttctggaagtttgtggattaacttctgtgactaaagctgcttgtttaactgttcgggtatgctctgggttataggccctgggttaggagatgaaagcaatttgatttccacaagcatattcatatctcacagatgaagtcacaccaaaatcaaatgatttcacagggcaacagcattgacaaagaaagtactgctttgggaatacaaagaaagtactgctttgggaatacct

SEQ ID NO: 121311 - DNA, 555 bp, Homo sapiens
tgcttttgtactacagtggcagagttcagtcattgtaatggagactgtagggtctgcaaagcctaaagtatttactatctgaccctttacaaaaaaagattactgaccctgggtcagcagtggattttttttttcttttaatgtgggaagagaatctcttgagtgaaggtgaatgggaatttgtaaaggatgagatgtagaatttatcactctaggattctgagttcatgcttacttaacttcagcacataaaattcctaaatcgtagtcacaaaaatcatgctattttcatgaaaaccatgcaaaaaccgtgctgagtttatgaaagttgcagtatactgaaacttctggtgcagtaaacagggcaaaaggaatatttcctaacatccttgccaaggcagtgtctatccacacaacagcatcaacctcttatgcatatctattgtcacctttgattatccagttaaagcttctgaagagcctacatcttagttttggagacaagaagacaaggaatgtcaaaataggggttacagaaacctggctagattcaga

SEQ ID NO: 121312 - DNA, 682 bp, Homo sapiens
ctattaaccagtaactacagaaagaagttagatccaattagtaaaggcagaaagaaacattgcctttgtgagttctgtttccctgtgcatatctgccaccttaaactaatggagctatttattgagttcaagctgtccccaacgaaagctgctttttactttgcttctgtgcaaatcttgttcactttttacaactggctacagaatcaaagccagcagctggcctccatgctactacacagaacaatagcctgagcccaagcttctgaagagcaggcctgccccagtatcttgaatgtatgcctgcataaaaagcagacaccacccaggatggctgtatctgctgcttctgctcaggcagtaaatatgtaaaataggaagccaaaacacatccagggccacatctcattgagtgcccttgggaaactcaattggacatcagtttatctttaaaataggaatcataatggcttcctctgattatgtcctgtaaagtatataagtggtttataaactacagttttaacatactggttgttaggtgatcgtgttcccattttttatgtggttgctttctcaagcacatacataatcatgctaaagaacggtaaaatagcagcagtcctcctgccatgcccaggacttatgctactttgtaatgtgatctcaaaatggactgtaa

SEQ ID NO: 121313 - DNA, 631 bp, Homo sapiens
gatgctaggttgcgctctcctgctgggtctgcgccgtgtgcgtgtgtgtgtgtgtgtgtttagtaagtgcctgttagaaatcttcagcttttccttaaaaaataacctggcctcttctaagggggtgcccttaaactacgtctcttactacaacttaattttcagaggaactgataaaaaacatagttcggagcacgactcagaataattaaaattactgcagccgctgaaagtcactcagttctgccgagtggaaaagcaggcagggaggggtagaataaagacacagaactggagatccttaattcgtgaatgtggggtttctcagattcaaactttactcagaactgcgcgtgaaacctactccttcccttgtcctccctctggtggagaattctaaagagcaaggaaataagaaggcattgacccctcccctgcaaaggacaaaagttaaagaccagggtaacgggcaccacggaaggatccagaattgtctacatgtagagaaaacattctcagagttataccacagctgtggttaacttagactcttaatttacagtgaaatactcttgtgttgtggtcgggaagtggtgagttggaacaatccatattcaaaatctattgcttc

SEQ ID NO: 121314 - DNA, 390 bp, Homo sapiens
cctcccccgggagagagagtaggtttgctattcctgaaatgtaatccctccttcagcgctgcacaaaaggcccatgtctgctcgctgggacctgatagttcgcctttgtacggatgaaaaaaaccaaacactgagcctggtctgagcggggctgtttgttgaggctcctgatgcagacaagggagcagtgtctgcacagggggtctggatcgcacccgacaccatccaggtgcctgcgtgtgctggtcccgccatcaggacttcccctcgtgaggagctgggtaccactgttatcctgcctgctggtctgagggtccgagcgtgattgggagcagagacaagagttccagggcgagcctcagttctgggaccaccattgaccagtagagc

SEQ ID NO: 121315 - DNA, 214 bp, Homo sapiens
cttaggtggtatacatagcactatcagacatggctcctgcttttgaatttcttactttctagtaggggaaaatagaatatcctcaccccacagtgtgttactgtggctcaaccacatgaatcaggaaacaagagtagaggccattcggagcttgcagtgagccgagatcccgccactgcactccagcctgggcgacagagcgagactccgtctc

SEQ ID NO: 121316 - DNA, 678 bp, Homo sapiens
cagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctgg

SEQ ID NO: 121317 - DNA, 1078 bp, Homo sapiens
aatgatattctgtcagataaaaaattatatttatcagagataaatattgaagagtttttggataaaatattatgtctgggaattccttcttctccctttccccaaataaactagggggcagtgcatagaaaacaatattactaagtgattttaaattctgataatttttcaatataaaattggggttctcgcatatgtttgaaattttgcttaatgaaaaatttaaataacttacttagaattcatatataaaatttctaacatttgtaatatgcatggcaggtagcaattatgctccattcttcttctctagctcataagagtttatttttgattgcttagggaaaaccctggacctcaattatactgtaaaatatttttgttccatctaatctttagtattcttatatgcagtgcccctaggtcttactgaagttgccagagttacctgttggttgctgtctgcattatttagctagaatattctttgtctctttaaatgtttgctcagtatttattttacttgataggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121318 - DNA, 1793 bp, Homo sapiens
cgggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121319 - DNA, 835 bp, Homo sapiens
cgggatgtctgcgtggtcacgtgataaaggggttgcccatcccgacaaatatatgttggtctcttgccgaggcctagagaaaaactcggtggtcacacattgaggaccccccggcgcccctgtaagttcccgtgccccccaaggatataattcctatgaaggtaaaggagcctatgggaataagtttattaaagaaaagtgtatttgagtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121320 - DNA, 330 bp, Homo sapiens
  misc_feature (312)..(312): n is a, c, g, or t
  misc_feature (315)..(315): n is a, c, g, or t
  misc_feature (319)..(319): n is a, c, g, or t
cctagttttagaagtttcaatagcaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgaacttctaactaggggtacnacncgantcgatctgtat

SEQ ID NO: 121321 - DNA, 726 bp, Homo sapiens
  misc_feature (28)..(28): n is a, c, g, or t
taaagaggaaaaagaagggaaataaagnttaccccatttcattgtgccaaaggcgtgtgggttgacagaagagaaaagctagcagttgtagatgaatggagaaaagaaatgggcctgtgctggaaagaagtggcatatcttggttggtatctttttattcacccatagtaaaatggaccaggaattaattatttacttatttttaaagaaatgacaaagcacatcctccaaatgggtatgattgtagggaaataggaactcttttaacaaacactgctgatcaaactgttaaactgggacagtctttctggaggttagtttgataataggtatcaaatgtagaatgattattagcacaagctgtgaagtcagactgtaccactgattagccagttgtgataagatgaatgttgtttcctcatctgtaaactggagatatcgagagtacctattaccgtagggctctggaagggattaataaaataatatgagtaaagcacttagcagaatttctagtacatatgaattacactctgaatagtttttgctgctaattgaatgtacatactttttcctccaaattccaattccaggaaagaaatgagacaaatgggccaatagtgaagttaaaagaacccacttaaatgtcctgtgaaaaatagaatatccctaaaaaggattactatgcaaccattacaaacagtgctgtgacctgtatttatttgc

SEQ ID NO: 121322 - DNA, 1621 bp, Homo sapiens
cgggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121323 - DNA, 1202 bp, Homo sapiens
tctccacgtatgcggcgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgtttttgctattgaaacttaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121324 - DNA, 1026 bp, Homo sapiens
cctagttttagaagtttcaatagcaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121325 - DNA, 1718 bp, Homo sapiens
cgggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121326 - DNA, 1870 bp, Homo sapiens
cgggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttgaaaaaaaaaaaacaacttgtgggccgccaaaattataatctggcgcgccagaagaagtatcgacaacgcgaagggtca

SEQ ID NO: 121327 - DNA, 1802 bp, Homo sapiens
cgggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatggtgtgtgtggttgggggaagggggggggggtcagaacgttaaaaa

SEQ ID NO: 121328 - DNA, 1475 bp, Homo sapiens
tgaaggtggaagaaataggtcattagtacaagaaaaagtatataatttgtttatggtcagcggttgtcgacactgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121329 - DNA, 1061 bp, Homo sapiens
atagtatcagtatcagtttctcccaaaaatcctgctggattgtcggttgggattgctattgaaacttctaaaactagagttttagaagtttcggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 121330 - DNA, 462 bp, Homo sapiens
aagaacattaagcacctggcgggggtcccgctcattggctgggtcctgcgtgcggccctggattcaggggccttccagaggtgcgcatgtgcgagagtgggcggcgcggcctgggcgggggtcgggagagggagtcgggctgctggaggggctggggcctccggggccaccgctcttggaagggggccatctctcatgccagggatgtgcaagatccggggtgcctggggccgggctgagagcccaggaggaagggctccagctccttccttgttccgtagctgccaatggtcataacctgggacagttcctgtctccgcccttgagaatcatccgtaaaaggggagattacacctccccaaccgtcccctcctcccgggttgaccttacggggaaaagtaaaggaggccaccccggtgcaacatctgtgataatatgtgaacttctttggatgggggccat

SEQ ID NO: 121331 - DNA, 558 bp, Homo sapiens
cttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctgaaatatgtgtcaa

SEQ ID NO: 121332 - DNA, 317 bp, Homo sapiens
cacttccgccaccccttgtgtctatggatattccacttccgccaccccctgcgtctatggggtatcccagttccgccatctcatgtgtctgtaggatattccagctctgtcatcccctgtgtctgtggggtatcccactcccgccatcccctgcgtctgtgggatattccagttctgtcatcccctatgtccttgagaaccaggattctccgtggggctgaagggaggtgcagatgtcacaaagaaaaggatgaatgaaaactttagtcctgaatttctatgggaagtatcagtgtgaactcaggaattttatctta

SEQ ID NO: 121333 - DNA, 372 bp, Homo sapiens
ttttgagacagagtcttgctctgtcgcccaggctggagcacagttgcatgatctcagctcactgcaacctccgcctcctgggttcaagaaattctcctgcctcagtctcccgagtagctgggactacaggcacatgccaccaggcccagctaattttttgtatttttagtagagatggagtttcaccatgttagccaggatggtcttgatctcctgacctcatgatccacccgcctcggcctcccaaagtgctgggattacaggtgtgagccactgtgcctggccttaaaacaacatttttaacattgtgtcatttaaaagatgcttgtgtgtacagaataatgcaagtagcccaataattgggccaattgc

SEQ ID NO: 121334 - DNA, 167 bp, Homo sapiens
accttgagtcaaacagttgagaatgcaacatttatggcattttaaaagctcgaacttcatctttaaaatagataatactgaatttatttttcataataagaaattttctggaataagaaatgaacctctgctgctatcctatgtccacttttgtggacatagaaaac

SEQ ID NO: 121335 - DNA, 657 bp, Homo sapiens
gtacattctgaagtaagaagttggtgtgctgcctgtgtttttgactttataactcccatttcatgtgccaccttgaaaactggcgaagagacctctgcagcatctgttgccaggcatgggggccctttgaaggaggaggtgcaaaataattagtgtgatgaagcgttcagaaagatcgtctttcctcatcattatgggagctgggaaaggattatataccttttgtttttatttcttatgatgtatagctagataaaagtgtttcctctttatgcagaaagttgacctgatgtaagtgttctgtccactgacttgtggattttcttctattaataatgatcaaaaagcacttttcttagaaatgtaagtagaactttaattggaagggttattgcaaggtttctatattttaatactagaataattattattggcacagtcaaatattaaaactgctgtctagtgatccatgacactctaggagagaggagcgttaatcttgaattccaaattaatgtagcatggttggcatgaatccagaaatttacatgaggatggtagagaatcccatcagataacgctctggttcaaatttaaactaaaaaaaagaaccaactcaatattttcgtttagtctaaacagttaagtgttgggaaa

SEQ ID NO: 121336 - DNA, 301 bp, Homo sapiens
gtgacactgatatgaaagttcactagctggaagacattgaggcagttttcaaaggcttttaactctgactctcttgggctatatttttacacattcagatcatttggttcataagtaagattaatgccatctgcagttactatatttacagtttacatgtaccatcaaaaccaattcatagtcataaaagttaaaagcatgttaaaggtctttaaaatgtagaaggcaaaaattgtgttgtaattgagcatgaatgtcaatatagtaaaaaaaagatcttataggcagttaaagtattatt

SEQ ID NO: 121337 - DNA, 488 bp, Homo sapiens
ttttgcttatttgtatacttattgcatgtgacatagtttcaatgcaatagttctctctctctttctttctctttttaaagcaatctatgggggtctataaccatagtggcagaaagaaagttaatggagactaaacaatagtgttcatgtttacaaaattaaatgctgaaacatgatggaattctgtattaatggggtttcaacttgctataaaatgaaaataatgtgatggagttctgtattcgtaagattccaatccgctataaaaattaatgttaataagcaagaagattggttcatattcgtggttttcttcctgcaaagtcaaatagtatacatgcatttgttaatgactccctgaataaggtctaaatcacttaagtacagttttatatggagtggaagtataagaatcaaagtttgtggttattttgtaagaatttgcttccatttttacaatgcaagtcagagaaatcttgatgtgttcc

SEQ ID NO: 121338 - DNA, 668 bp, Homo sapiens
aggtgggaatgacagtttgctgcagtcccgtcaatgggggaatctgcccgagctctgcctgcattttgagcagcaaagcagctccagccaccaagaccgttgcctgcgctgtcttaggccagcccatgctgtctgccagccgcttgttgcgctgccttggggactgggaacacacccagccccggtccccatctgttgcagacatgcagtggcagcagctcggagcacagccgaaccctagaaattgcctgtgctgaaggggctgggaaaccccttctctgatggacctttcgagtgaggcagcaggatttgtcagagctgggagtgccgcccgtccccgtcactcgcatcctgccatccagcagcttacaagcctgcactgcttattagcatctggaagagaagacctccaggaccccttggggctgagacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtcccgccagctccctcg

SEQ ID NO: 121339 - DNA, 687 bp, Homo sapiens
ccactcatctatagtgttgatatttctgagtagttgaacttcagaccagtgctggatggttctctctgtatgtgagaacacgtcctgagtttttataaagtgtgtatgcgtgtcaacaatctgaattagtttatataagaggttgggcaatattgtaagtagatatttgtctttattgcccagatgaagctaataaacctctttatggtatagtgtcatgccttgagttttatagcaccttccttttaacaaactcggtgtttcattctttaagcttattatatctcttagtttgcgttgtttttattaatttttttttgagacaggatcttacttgcactctagcctgtgtgacaaagtgagactccatctcaaaaaaaaaaaaaaaaaaaaaattaaaacaaacaggaaacaggtggaattttttggatttacccattttaaaaattttccttttattatcttaaaccagttgtttaaaaactttttgaatgggaaaatttaatattccctttaatgcgggaacaaaggtctttggaaaaattgtgggccatacttaattttctcacgcgagggaatgccaaatttgcttggaaaaatcctttattgggttttctgatttttccaaatttcagccgttgaacaaagttgggttaatttttctgttttccaaattatccctcattt

SEQ ID NO: 121340 - DNA, 253 bp, Homo sapiens
tagaaacaaagtaaagatgaaaaggatgtctcagtttgtttcaggttagccttgcttctacactcaaaatgcttgccaggtgagggtcttcaaaatgtgaataatccagtgttgtatttaattctgtgtcatctgtctttgtgaaagagagggagccgaatactcccaaagcccaggttcttagtgtattccaccaggttcctgatcttataagattgttcaacttagtacaaaaccagaagaattaaaatcc

SEQ ID NO: 121341 - DNA, 524 bp, Homo sapiens
tcgtgatccgcccgcctcggcctcccaaagtgctgggattacaggcgtgagccaccgcgcccggccttggtttttatgactgccttaatatttagaatttattagtgttttcttcttattttcttggttaaattttttattactgtttttcaaaggtccagttttgagatttatcagtaattttttttctgtttttctttctttctttttaaaatttctttcctgttttcctcttcattcttttatgactcttattggctgaatcatggttcatttatctttccttttatattaataaaactttttaaagatgtgaatttatctctgaacacacttttgatagactgttattttctaatgatattttcacttgctgtttgatagaatgacaattgagtaaagtactgttaagtgttaaacaaactttgtcgctattgagatttattattgacctttttttcactacattgtgtccagataatagggttagattatcagcaacactggtgtttggtgacgtattg

SEQ ID NO: 121342 - DNA, 456 bp, Homo sapiens
agagtaagaccctgtctcaaaacaaaacaaaacattaagaggaaaagggaaaatttgcaggcaggcccatagtgaactaaggatctcaagacctggattctagtctcctgactttgacacaaatgggttgagcagtctattaaacttgcctttaaactgaggggggtaggagagaagataagaacctcccaagaacagagtctctaccaaatctgaagtctaaaagagcaagtcatggctgtccaaaattaccttgctgaaaaatgagaattccttctctttgaggaaagatctctagattctttacagttgaacctgttccttcatcctcacactgtacccaccatggagaaataattcacagacccactcgctgcctccccaaaagacctttctcctgggaaagaactttataaatcactttaagttagcaaccgtaattcccagacgcttaca

SEQ ID NO: 121343 - DNA, 495 bp, Homo sapiens
aagtaatagtaattttaaaagtatcctgccgtggtcacgtgtaagtatacttctgtgagcagatttacagttcgggatggaagtggtttgggcagatttctgacattcctgcatcctcatctctcacttcatcctaacaccagtaagggcagttggaatgcagcagctcagaatcaaagctctggcaccaaagtgcttgggttttaaatatggctctgtcaccttctagctgcatgacattgggcaattacttaaccttcctgtgctccattgtctaaatgtatataacaacgccttgataggggtacataaagattaaatgagttaacacatgtaaagcactcagaatagtgcctgatgtatattaaagtgctccatcaatgttggctattataatattatcattatatttatttatttagagacagggtctcactctgtcacccaggctggagtacagtgggatgatctcagcttactgtagccttgacctcc

SEQ ID NO: 121344 - DNA, 950 bp, Homo sapiens
cagagatgctgagtgaatgtttttacttctactatcaccacctacccacccctgttcccctgcaaatgtctagcactgacagcttccttcctccctgccttccagaaacaagttgagtgcagacagcgtgggtgaggtcttgtgctatgcaccaggacagagaggagacccacagctgctgtcattgggggtatgtgaggacctaacattcaccaagacacatatgactcctgccatcaactggaaaacgtaagggattcaaattcagaagagctgcattcctgcaggtgtgacccccaactctcaaccccccaaagcctcagcttcctcatctgcagagaaaacaatgatccctagagcacacacatcttcaagggctttctgaagtcttagtcccatcactcgcttttgtgatggtcattactaggttaacaaagatttgtggtacccagttccagagttacgctgggaacataatgggggaacccttattcagggtctccccagcttgcctgaccctaagaatcactgaagacactggtgaaaatgcagattcccaggccacctgaatctgactctcccggatccgcacagggccccaggtgattagggaaactggccagtttgctagagagagcacagttgctcaactcaaaaacaagcaactaagatttccagggttaggtgatctaactgaaagcattactttctgggggtcggaaagtagagctagggcttgggtttgttactttgccagaggtatgaccctgagccaggtcttcaacttctctcggtctccatttcctcaaaatgggaataattacaatgaatcctaatgcccaggcaggagtgaaggtggaatgtcaggtgtcttctcccggctgccttactcctgttctggggactaacatggcttcaagcaaggggagctggcacgtggtggcctccca

SEQ ID NO: 121345 - DNA, 105 bp, Homo sapiens
ataaataaagatagttaaggggaatgtaaaagtgataaatattaacttgtaatctctagaggcctcatgtaatacatgatctggggtaatgctgttttaaactca

SEQ ID NO: 121346 - DNA, 703 bp, Homo sapiens
ggattacaggtgtgagccactgagcccagcctgtgtctagttctgacacatagtctttcttgttttttctggggtttcagtaccaagactgatgtgtttgctaagcacttctggcttggtgaagttcaactccaaactgtgtgggtagtacctaaaaatctatcaggcttctaagccttctggtattgctttccactaagctctttgaaatttctcccacatatgctattcagggggtcatccaaggagcttatcatagtgtatacgcaaatttggaattcttgccaccctgtggctgtctcctttctaagatttttcttccttgatttccagcttttggtctacttagaccatgcctcccaagctgagaagtgccctcagaggaaaagccatgtaaaattttctttcaatttctactttatttttgtcactctcaaatacattcacatacttcattctgtacttttctgagggtttataattgttataaatataagagttaacaaagtacacttggtgttttgtttttttttcagtgttactcaaaacagaactccttgtagtccatgctttattttaaggttgtgaaatcatttgcacactcaatgagaatatggctttattcttaccatacaggtcaaggcagattaaaaaacttaaaattgcaatttatattatagtagtcactgtcctgatgtattac

SEQ ID NO: 121347 - DNA, 409 bp, Homo sapiens
gctcctcctacaagttctgggtcctatttgtccctaataataatgccaccattttatttagcatataccagtgctgctgctaaatcctttaaatctgtgacctcacagcacctctacgaggtgtgctattctcatcctcatcttataggcaagttaactgaggtataaggaggttggttatgtaacttgaccaaagtcacacaataagggactgggagatctgggatttgagccctggcagttggactccatccaaagtcctcactatcctagcacctctctatcccctccctttcctctctcctaccttcttctgtgctgctttcaaacagacagttatctctacccttaaaaacacagctgtgctgactactctgcttagatgccctctcaccccatcagattattg

SEQ ID NO: 121348 - DNA, 259 bp, Homo sapiens
aaatgtcagctctctgatgcgctagctgtgcaatcctgtgtaagtctcctaattttcaggtcccatttcctcttttgtgaaacgtggccaagggagaatggactttgcagtgtttgtgtttcagtctaagataatactgtctacttgggattgcagtccagccaccacttaccagctatatgcccttgggccatacttcctctgcgcctcagcttgagcctatcaatgacatctaagagctgtttatccagtcaggagt

SEQ ID NO: 121349 - DNA, 327 bp, Homo sapiens
tctttctaaatatgtgtagaaagggaagcctagcaagtctattaataagatttagagtgtgtataaagcaagtatgtgtatgtgtacatgtgtatatacatgacacctggtatgtaaaaatgggtgtggattttgcaatttttacaaaactaccgtaaataacacagacatccattttagagtgatcaaatctccccctaaatgaaagtttctctctgatgtcatgctccgcttgaccatgaaatgaaaatggcttcaaactgttcttaattgtgaaattaaaaaataaagagacagaacgcatcacctcttgcaccataagatcca

SEQ ID NO: 121350 - DNA, 797 bp, Homo sapiens
  misc_feature (73)..(73): n is a, c, g, or t
  misc_feature (168)..(168): n is a, c, g, or t
catagatttttgaaagtcaagtgagaaaaattcagtcaatacttccaacatttaagaaagtgtaagtcctttntgatttattgtttatttctaaaagtaataaatatcaatagaaggaaattaatccattactgttctgaggctgcatggtgctatttttctgacatntggcttaatctggatacctctttctgcttccaggtaccattcattgtattttccatgcaactgggcatccttgccatgttcttgatcttagaagaaagtctttaagtgtttcaccattgagtatgatatttgctgtggggttttcatatgtggcttttattatggtgaggtattttccttgtatttctagctcgttgagtgttttcattctgaaaggatgttgaattctgtcagatgctttttctgcatcaattgagatgatcatgtgttttttcgcccttcattctgttcatgtggtgtattgcatttaccagtttttatgtgttcaaccatccttgcattccaggaataaatcccacctggtcatggtgtataatccttttaatatgctgctgaattcaatttcctagttttttattgaggattgttacatcactgttcataagggatatgatattggtctgtagctttgggttttatagtgtctttggctttagtgtcagggagtgctggcctcatagaatgagatggtagtggaggaggtattggttaagagatttaggctgggtgcagtggcttgtgcctgtaatcctagtactttgggaggctgaggtgggaggatcgcctga

SEQ ID NO: 121351 - DNA, 820 bp, Homo sapiens
ggaggtggaggttgtagcgagccgagatcacgccactgcactccagcctgggcaccattgagcctcatttatgaattctatcaggatttctttttttggtggaattcttagcatgttcacatatgagatcatatctgcaaacacagataattttatctctttctttccatcttggatgccttttatttctttttcttgcctgattgccctggctaaaacttccagtactatgttgaatagaagcagtgaaagtgggcatccttgccatgttcttgatcttagaagaaagtctttaagtgtttcaccattgagtatgatatttgctgtggggttttcatatgtggcttttattatggtgaggtattttccttgtatttctagctcgttgagtgttttcattctgaaaggatgttgaattctgtcagatgctttttctgcatcaattgagatgatcatgtgttttttcgcccttcattctgttcatgtggtgtattgcatttaccagtttttatgtgttcaaccatccttgcattccaggaataaatcccacctggtcatggtgtataatccttttaatatgctgctgaattcaatttcctagttttttattgaggattgttacatcactgttcataagggatatgatattggtctgtagctttgggttttatagtgtctttggctttagtgtcagggagtgctggcctcatagaatgagatggtagtggaggaggtattggttaagagatttaggctgggtgcagtggcttgtgcctgtaatcctagtactttgggaggctgaggtgggaggatcgcctga

SEQ ID NO: 121352 - DNA, 272 bp, Homo sapiens
gcagcaaggagtcagaatgagatggacagaactggggcttggaaggagaaagtgttggtgtcctgcacatctgaggtgctgagggagacagtgtcacccagtgtggaatggccatcctcaaactgggcatggctctcacagccgaagtgagtgttgtctgctgaatgccttcctgtttcttttccctaagaagggtgacatgagaagccccagcaaagatgtatcaaggtgtcacccagcctccatggccctgtgccacgggcactgcagtg

SEQ ID NO: 121353 - DNA, 345 bp, Homo sapiens
tcccgcaatatacccaaggacgaggaaaatcagtgactgttcagaggaggaaccaccttatcagggaccaaaattaacattgccaatcagggcaagctgacagacgtctctgtgtttgatatctcaaggacaccgtttacagagcactccagccagaaatatataactcgaattccatcctgacaaaataccagaccaaaccaaattgagggcattctttaatataaccagctggtatttgttcagaaatatcactgctgttaaagacaaagacaggctgaagaactgcagcaggttaaagaagaataaagagatatgattactaaacagagcatgtgatctggt

SEQ ID NO: 121354 - DNA, 725 bp, Homo sapiens
tgtcgattttaagtttatttttgtataaggtacgaggaggaaggggtccagcctcatttttctgcatgtggatacccagttgtcttagcaccatttgttgaatagtctgttctttccgcattgagtggtcttcatgtgcagactgttattgctgtgcatgtgtatatctgtttatctggaattcacttttaagaactgtatatgggccaggtgcagtgactcacatctgcaatcccagcgctttgggaggctgaggtgggaagatcacttggggtcaggagtttgagatgagcctgtacaacatagcaagaccttgtctcttcaaaaaaattttaaaaactagctgagtgtggtagtacctgcctgtagtcctacctactcaggaggctgaggcagagggattgcatgggcctggaagtttagggcaacagtgagctatgatcacaccgccattccagcctgggcaacagagcaagaccttgtctcattaacccagttgtgcctagtgttccattattggaacactaagcttgtgggagttatttatatcctgctccaggtcattgccaaggtctgatttttcacaaaaaaagtttgcaaccttcggcataaatgggttaaaaaaaggaaaagctgtatatgaaggtctttggccacagtttggtttttgatggtagatagggttttgtcacttgaatgcaaaattagctttataactataactt

SEQ ID NO: 121355 - DNA, 822 bp, Homo sapiens
taaatgtttcagtcgtaaagtcttgacccatgaacacgtttatacctctgactttagtaacacgtgaaataatgtggcattatattccagttttcattgtaactcatattctgctactagtttaacaatgaaatgctttcatttatcgatatagaggaaatactgtactttataatagtttttctaagaatgtgacagaaaagtgtgccagtttgaagtgtttcattatttttccattagatatgggtttttttcctgcccctaagaagaaaaaaactggctcttatatatttatctataaaaggaagtgtggggaggaataagttatcagatctcagatcctactagatgtacattctagagatcaacctttgaagccttgtactcaagaatttattccctttatcagttgctgtgtggcttattttgaaatttttatcatattctgtgcttagcatcataataaaacatactgaaaggctttttttatgtttccaaaaaaaaaaaaaaaacacaaaaaaaaaactttttggggcgcctgggccctggaaaaagttttttaacccctccgttggggggcggggccccattggtgttcgttgacccgggggccaaacgcgggcccccaaagaggaagaccccgggggtcccagacaccaagggcgtcgggtttttcccccccaaataaaaaaacgcccgggcggaccacggacgcgcgtttcgggaacaattccccgaaggggagtccccggagggccagaaggcgggtcccaacacagggggtgccagggaggcgaaataaaatacacgcggcggggggcg

SEQ ID NO: 121356 - DNA, 179 bp, Homo sapiens
ggtactgggggagtgttaaagatcttacgaggaatactaatgctctttttcccgttgacttacatatttaataaaatgaccctcctccaggggttttatgattttaagtctacagtaatttatttggatcagttacttctgaattcttaaatatactctgatttgttgttcttgggttt

SEQ ID NO: 121357 - DNA, 417 bp, Homo sapiens
gccaccgtgcccctccaggtgtagttatataatcaggaaattaattgatactttgacacacttataatctaatcctcagaaccgattcatattggccagtttttataggaaaagatcctatccagaatcacaagttgcattcggttgtcatctctctttattctcctttgatctggaacagtttcttagctttctccttgattttcatgacctaaatatgtttgaagattacaagtcaaatattttgtataatgtttcccagtttgagtttatttgatatttctttgtgatcaggttgaggttatgcatctttagaaggaatatcacagaagtgattctgtgttctccatgtttcgtcttgtcagatggcacacaagtttggtttatctcactacctgtaatgttccccttgatatt

SEQ ID NO: 121358 - DNA, 236 bp, Homo sapiens
atcatgctcggcgctcctactactctttactctgccctcactgttagagttcccaagagttagtcagtggccgtgtgtctctgctctaccaatactcctttctttgtgatcaggttgaggttatgcatctttagaaggaatatcacagaagtgattctgtgttctccatgtttcgtcttgtcagatggcacacaagtttggtttatctcactacctgtaatgttccccttgatatt

SEQ ID NO: 121359 - DNA, 252 bp, Homo sapiens
tgacataaatgttgagaaatgcattcttgttttccttcccaaggcaccaatagtacaaagacaagcataaagccccttaggatacaaaaaaaaaaaaaaaaaccccggcttttggcccggtatagcctaagggggcgcccctctgtattcttaaacggggggggggttttcccccctaatggaacaaacggcctttggactcttgggaggccccccctgcctaatcgatgggaaggcttccctagggacaga

SEQ ID NO: 121360 - DNA, 882 bp, Homo sapiens
gaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaaatcgcttcttgacctgcacaactttctgatttgatgagttcaacagaaaccaactcaagggagaagaataaagacattgttgaacttagactttgacaagatgcatattggatatctaaatagagatatcaagaaatgaagatatgcatttccagttccagagagaaattcacactggaaatataaatttaggaattttaaagttagtggtcacatttaaagctgcagaatacaaagagatcacctgtgtgagagaactgagtcctgaaacatacccgtgtttaaagatctgggaggtgcagaggaattatcaaaggaggctgagaaggagcagccagtgaggtgtgtagaaaaacaagataagcaaaaagaaaagcaagagatatggaactgaacttccctttggcaaaaaatttagaaaatgataatgagactccgctttctgtctctctgaagataacgttaagctgcagctccgtatctgtgaaaacccatttcacagcatctgcatccctggattgctaaatacccttgtctagttacccaaatattaatggatcccatggaataaggtggcatgatttaggcacaagcaattaccaaaggattttgaaaagcagtaactccaaattatcttgtaaagttgagaataatctgagaagagctattgtaagactgggaatcaagtaacaaaataaagatatgaaccgtcaattgg

SEQ ID NO: 121361 - DNA, 551 bp, Homo sapiens
caccagaaaatcctcaatgcctgagaaatgagggacattccaaagccacggattgatctgaaatacaggtctttggaaatcctcctccagattccccagagcatgacagtgacttcacgtggatacagattttgcagttatcaactaacccatcaattagcatttatggagcactaattggtgtcaacccaggtaccataagtatcgcttcttgacctgcacaactttctgatttgatgagttcaacagaaaccaactcaagggagaagaataaagacattgttgaacttagactttgacaagataagaataacaatcttggaatatgctgaagatggcagactacaaagtagaaggagacaaagtttgtgaaagaccaggtggaggaaagtcatccactaatcaggagcccttttatggaatctacgtaaacaagaaataaacaaaggtttagtccattatacctttcaagtcaacagcaaagcagacagcctactctaattaatgtatccattctaagggaaaattatattaaatgttatattttgaaa

SEQ ID NO: 121362 - DNA, 3187 bp, Homo sapiens
  misc_feature (1350)..(1350): n is a, c, g, or t
  misc_feature (1542)..(1542): n is a, c, g, or t
gaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaagtaggttttctgcttgaaaaacctgtttctatttctttttaaaaaatcatactgcataacagaatagtaaaaacaaaatgcgtgttaagacttacagggaaacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttgggacctctctaatcctgcctaatttgggactttttctgcaggattgtaatgtaaaatagttctttagctcttggagatttttaataatacgagttattaaaaaccaccaccaccagaaacttgattaacttgattaccctgttgagtagagaggtcttaaccaccgaaaacactgatatctttatgttggcatgctcatgcaaacacatgtgtgtgtgtgtgtgtgtgtgtgtgtgtgtgtgtgtaccacagtgttttataaagcacagcctaattgattatataggacaaaaattgtataggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcactgaagctcttagatgggtgggagctgaataggtgcagatagcaggggtgaaggagtgaaaggataaaagattcaaggttgagatgaggatggagcaagaagaagccacattagggccattaaggctgctagaatttagaaagaaaacacacagcctcccagagtgctnggattacaggcatgagccactgctcccagccttccagaggaattttaagcccatgtccaaacattctgtttgtataaatatattctaatttttaaataaatagtttctacttttctgaactttatattttttcttgctataatggattttcataatcagaaaagattaaattagtaatcatgaattgccttnaatatttggcagtaagtcaatgaaataataaggcacttatataccatctttgacatcattaaaagtatcaaatcccattaatctaaaacttctttaagcattttgaaagcagaaaatgtttacatggttctttcagttcctcaggctttttgtctaatgatgcgtgacttaggataagatttgaattaagtgcccagcttgaaacataataatttttctgtataagccacagatcctctacctcctttgtgttaaagcctttatatgaaacaattaagtagaagcattcaatagtgtgtcattaactgttcatactaataaatggatacagcacattttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataatataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagcacaaaataaagtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaataatagtgtcagtttatatgtgagggagtagagacagagaggttagcactggataataattagtaaggccaaaggagaaaatttcatagaaaatattgttgttgtcataatgagtacagcatgaaaggcttcctctacaagacactagtcaaagagttgagagctgcggtttctaatctttgtccattactcccttactccctatgagactgtggacctgtcacttggcctctctggtcttcagttttctcaccagtaaaacaaggaacttgaaccaaatgacctctagtgttccccttgggtttaaatgtctataaatgttcaatgactag

SEQ ID NO: 121363 - DNA, 4212 bp, Homo sapiens
  misc_feature (1350)..(1350): n is a, c, g, or t
  misc_feature (1542)..(1542): n is a, c, g, or t
gaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaagtaggttttctgcttgaaaaacctgtttctatttctttttaaaaaatcatactgcataacagaatagtaaaaacaaaatgcgtgttaagacttacagggaaacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttgggacctctctaatcctgcctaatttgggactttttctgcaggattgtaatgtaaaatagttctttagctcttggagatttttaataatacgagttattaaaaaccaccaccaccagaaacttgattaacttgattaccctgttgagtagagaggtcttaaccaccgaaaacactgatatctttatgttggcatgctcatgcaaacacatgtgtgtgtgtgtgtgtgtgtgtgtgtgtgtgtgtgtaccacagtgttttataaagcacagcctaattgattatataggacaaaaattgtataggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcactgaagctcttagatgggtgggagctgaataggtgcagatagcaggggtgaaggagtgaaaggataaaagattcaaggttgagatgaggatggagcaagaagaagccacattagggccattaaggctgctagaatttagaaagaaaacacacagcctcccagagtgctnggattacaggcatgagccactgctcccagccttccagaggaattttaagcccatgtccaaacattctgtttgtataaatatattctaatttttaaataaatagtttctacttttctgaactttatattttttcttgctataatggattttcataatcagaaaagattaaattagtaatcatgaattgccttnaatatttggcagtaagtcaatgaaataataaggcacttatataccatctttgacatcattaaaagtatcaaatcccattaatctaaaacttctttaagcattttgaaagcagaaaatgtttacatggttctttcagttcctcaggctttttgtctaatgatgcgtgacttaggataagatttgaattaagtgcccagcttgaaacataataatttttctgtataagccacagatcctctacctcctttgtgttaaagcctttatatgaaacaattaagtagaagcattcaatagtgtgtcattaactgttcatactaataaatggatacagcacattttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagcacaaaataaagtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaataatagtgtcagtttatatgtgagggagtagagacagagaggttagcactggataataattagtaaggccaaaggagaaaatttcatagaaaatattgttgttgtcataatgagtacagcatgaaaggcttcctctacaagacactagtcaaagagttgagagctgcggtttctaatctttgtccattactcccttactccctatgagactgtggacctgtcacttggcctctctggtcttcagttttctcaccagtaaaacaaggaacttgaaccaaatgacctctagtgttccccttgggtttaaatgtctataaatgttcaatgactagaatgtattgcgtttttctttattctttttgctttgagaaaagagaatgtgatttaagagtaataatttgaataccaattatccacattaaaattgtgtcctctatgtgtaaggcatagcacatttagcacacatacataagcacactaagcaccttacaaatatcctcatttattctttacataatcttttgaaattgattatgtaatacacactgtttttgaacaattggtgacttccagctgtttaaaacaaactacagtatggtgcttgagtactgacttaggaggtcagcattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcatttctaatcacttcccaggtgatgcagatgtttctggtccagggaccccagtttgagaaccactgtattaaaatttccttcatctctatagaaatggaaagattttttataagtcctctaatttgctttaagataaatgagatttcacttaattctgttggagaaattgttttaaaaattgtgctaaagaaccgaaaatcactttatgttaaggctctatttatagcaagtgaacttttcatgagttaataaaggcctacaaaaataattttgactgtgaaactaattaaaatctctgtgtttcatttaaagcataaacatatttgaataaaaataggttaacaataatttgggacatgtattcagtataattttaagataattttacaaaatatatgtaacattgcatttgtttctgtaaaatatcttcggaaaaagccttgttttccctagtgtgttatttgttgaatttcttgttaaatgtattttttcccattgaaaaaaatgtttttaatcaatgtgatcaatacagctatctatatgccctgctttcactgtagaattagaaag

SEQ ID NO: 121364 - DNA, 1757 bp, Homo sapiens
gaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaagtaggttttctgcttgaaaaacctgtttctatttctttttaaaaaatcatactgcataacagaatagtaaaaacaaaatgcgtgttaagacttacagggaaacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttgggacctctctaatcctgcctaatttgggactttttctgcaggattgtaatgtaaaatagttctttagctcttggagatttttaataatacgagttattaaaaaccaccaccaccagaaacttgattaacttgattaccctgttgagtagagaggtcttaaccaccgaaaacactgatatctttatgttggcatgctcatgcaaacacatgtgtgtgtgtgtgtgtgtgtgtgtgtgtgtgtgtgtaccacagtgttttataaagcacagcctaattgattatataggacaaaaattgtataggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcactgaagctcttagatgggtgggagctgaataggtgcagatagcaggggtgaaggagtgaaaggataaaagattcaaggttgagatgaggatggagcaagaagaagccacattagggccattaaggctgctagaatttagaaagaaaacacacagcctcaaagaaatgtgggtaagccaaagaaggattttgttttgggaacctgaataaaagatgtccatttggctaaaaagtaaaagcagaatctttttagggcttttaatatacccaccctgggatatttggtatgctggcaatggtaattcaaattggcgtttaagaataatcttggccgggcgcgatggctcatgcctgaaatcccagcactttgggaggccgaggcgggcagatcactaggtcaggagatcgagaccatcctggctaacgcggtgaaaccccgtctctactaaaaatacaaaaaattagccgggcgtggtggcaggcgcctgtagtcccagctactcaggaggctgaggcaggagaatggcgtgaacccgggaggcggagcttgcagtgagccgagttcatgccactgcac

SEQ ID NO: 121365 - DNA, 1616 bp, Homo sapiens
  misc_feature (302)..(302): n is a, c, g, or t
gtctcgtgttggctcctgtgctcgctgcttctgtcgcgtcactctgcgctcgctcgtgttttcctgtgcgcgtctcgtccttcgcgtttctgcgctctcgccgcgcggttttcggtcggtcctcgtgagccatgtgccccgcccctggttggtcgaagctcggtccgccggctttttttgtggaacccagcccatttctagcgcggtggtctggaacgtctggcccgtttccttacgctgggcgccggcccaacggttgttgttaactttttggggcgcgggcgcccgcacacattcttttnttgttttttgttttttttttgtagcccagaggtcctttattgtttttttgtaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccattcccttgatgtctacaatatcacctttcttatagattcgcatatatgtggccaaaggaacaactccatgttttctaaaaggcctagagaacatatatcgggtgcctctcctctttccctttgtgttcgtcattttggcgaattactggaagatggcggttccggccgaaagggcatgcatattggatatctaaatagagatatcaagaaatgaagatatgcatttccagttccagagagaaattcacactggaaatataaatttaggaattttaaagttagtggtcacatttaaagctgcagaatacaaagagatcacctgtgtgagagaactgagtcctgaaacatacccgtgtttaaagatctgggaggtgcagaggaattatcaaaggaggctgagaaggagcagccagtgaggtgtgtagaaaaacaagataagcaaaaagaaaagcaagagatatggaactgaacttccctttggcaaaaaatttagaaaatgataatgagtctctagacccccttcgtggatggtatcagatgatttcagtccaaccttccattgcattctctgactgagccaacacagctggattctcagccaactatgaagtttaaattgactccgctttctgtctctctgaagataacgttaagctgcagctccgtatctgtgaaaacccatttcacagcatctgcatccctggattgctaaatacccttgtctagttacccaaatattaatggatcccatggaataaggtggcatgatttaggcacaagcaattaccaaaggattttgaaaagcagtaactccaaattatcttgtaaagttgagaataatctgagaagagctattgtaagactgggaatcaagtaacaaaataaagatatgaaccgtcaattgg

SEQ ID NO: 121366 - DNA, 1504 bp, Homo sapiens
  misc_feature (302)..(302): n is a, c, g, or t
gtctcgtgttggctcctgtgctcgctgcttctgtcgcgtcactctgcgctcgctcgtgttttcctgtgcgcgtctcgtccttcgcgtttctgcgctctcgccgcgcggttttcggtcggtcctcgtgagccatgtgccccgcccctggttggtcgaagctcggtccgccggctttttttgtggaacccagcccatttctagcgcggtggtctggaacgtctggcccgtttccttacgctgggcgccggcccaacggttgttgttaactttttggggcgcgggcgcccgcacacattcttttnttgttttttgttttttttttgtagcccagaggtcctttattgtttttttgtaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccattcccttgatgtctacaatatcacctttcttatagattcgcatatatgtggccaaaggaacaactccatgttttctaaaaggcctagagaacatatatcgggtgcctctcctctttccctttgtgttcgtcattttggcgaattactggaagatggcggttccggccgaaagggcatgcatattggatatctaaatagagatatcaagaaatgaagatatgcatttccagttccagagagaaattcacactggaaatataaatttaggaattttaaagttagtggtcacatttaaagctgcagaatacaaagagatcacctgtgtgagagaactgagtcctgaaacatacccgtgtttaaagatctgggaggtgcagaggaattatcaaaggaggctgagaaggagcagccagtgaggtgtgtagaaaaacaagataagcaaaaagaaaagcaagagatatggaactgaacttccctttggcaaaaaatttagaaaatgataatgagactccgctttctgtctctctgaagataacgttaagctgcagctccgtatctgtgaaaacccatttcacagcatctgcatccctggattgctaaatacccttgtctagttacccaaatattaatggatcccatggaataaggtggcatgatttaggcacaagcaattaccaaaggattttgaaaagcagtaactccaaattatcttgtaaagttgagaataatctgagaagagctattgtaagactgggaatcaagtaacaaaataaagatatgaaccgtcaattgg

SEQ ID NO: 121367 - DNA, 975 bp, Homo sapiens
  misc_feature (302)..(302): n is a, c, g, or t
gtctcgtgttggctcctgtgctcgctgcttctgtcgcgtcactctgcgctcgctcgtgttttcctgtgcgcgtctcgtccttcgcgtttctgcgctctcgccgcgcggttttcggtcggtcctcgtgagccatgtgccccgcccctggttggtcgaagctcggtccgccggctttttttgtggaacccagcccatttctagcgcggtggtctggaacgtctggcccgtttccttacgctgggcgccggcccaacggttgttgttaactttttggggcgcgggcgcccgcacacattcttttnttgttttttgttttttttttgtagcccagaggtcctttattgtttttttgtaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccattcccttgatgtctacaatatcacctttcttatagattcgcatatatgtggccaaaggaacaactccatgttttctaaaaggcctagagaacatatatcgggtgcctctcctctttccctttgtgttcgtcattttggcgaattactggaagatggcggttccggccgaaagggcaaagaggcgggcccggcgcgcgccttacaagggcctgtgggctgcccacggcgcttgcctgagggaaacgccaaccgtaagcgacttcc

SEQ ID NO: 121368 - DNA, 554 bp, Homo sapiens
cagtttctctgactacaaaacattgtacttcattccatcaaaaaataaatacagcagtgaaaacaatttgtaactttacataaacctaacagctagtttatgggaaggacaaagtgtttcttttaatttatggaaactagtattaagcttgtttatctgcacaataaatttaaaacatagagatagctttaacttgcaagagggagaggaagagagaaagctaaatgtttaacttttccatctttgcaaagggtctttggaaatcctcctccagattccccagagcatgacagtgacttcacgtggatacagattttgcagttatcaactaacccatcaattagcatttatggagcactaattggtgtcaacccaggtaccataagtgtaagcatgatccaaataaattaaatgagaattgattgttttaattacggcaatccagtcaatggcaggctcttctttctctgcttttattttccttctcttcctctttccccttacctttctctttctcattctttttcctctttctcttcttttttctcattggc

SEQ ID NO: 121369 - DNA, 319 bp, Homo sapiens
gcaaagggtctttggaaatcctcctccagattccccagagcatgacagtgacttcacgtggatacagattttgcagttatcaactaacccatcaattagcatttatggagcactaattggtgtcaacccaggtaccataagtgtaagcatgatccaaataaattaaatgagaattgattgttttaattacggcaatccagtcaatggcaggctcttctttctctgcttttattttccttctcttcctctttccccttacctttctctttctcattctttttcctctttctcttcttttttctcattggcaaaaaaaaaa

SEQ ID NO: 121370 - DNA, 481 bp, Homo sapiens
tctcacggagcttttccccctttgcttggcacttctctctcctgtcgccatatgaaggatgtgtttgctttcccttccgtcatgattgtaagtttcctgaggcctccccagccatgctgaactgtgagtcaattaaacctctttcctttataaattacccagtcttgggcagttttttacagcagcgtgagaacagactaatacactcatacgttccagtgaaatattaaatagaaggtccctgagggtacaaataagtctcactcactgcaaaaagcagagcatgttatgaatacttggtattaagagattcataagatgcaaacgtatgccttgcttaggacctagcaaatgtcagatcttattcttattcttcttattttttggagacagagtcttactctgtcgcccaggctggagtgcagtggcacaatcacaacttgctgcaatgtccacctcctgggttcaagtgattctcctg

SEQ ID NO: 121371 - DNA, 325 bp, Homo sapiens
tcttgaaagagttgagcctccaccacttcagagagagggcagcaagagcgctctggagcctgccctccacagagcttggtgctttgagacctggacagtgcccaccagacagaatccacatagtgtttcctctcctccttccagaaccggatcttcctgagtccctcagtggctttgactggtgaaggctggccaggcctgctggagagatccgggatgcagagctgtttagtctgggaggcaggtcagtctcagaggatgggtgggtcagggctgaacacaaggaaaaaagacgccacacatggaaggaaatcaccactatgcc

SEQ ID NO: 121372 - DNA, 460 bp, Homo sapiens
gggttatgccattctagagaaattataaatgttcttgggggttgacccataggtgagctgggcatccctgtgctcttgggagctggagcaggcaggaggcccatcctcctgggcacagccgccatggctgcagacccaggcatctctgcactctggagggctcaggaaggttcccccacccccacaggcttggaagtgctcgctcccactgtctggcttctcctcactcttggcatccactccaatcacagagaaaaggggagtctgggcccacgcacctatcaacccatcacctaggtattaagcccagcatgcattagccatctcctctttgacttttaacatgaaattctcatgatcattttatgttatcaatgaccagtcataggttttaaaatgctggctgttacttgtgtataataacaatgacatttttattaataaaacaaaacacgggata

SEQ ID NO: 121373 - DNA, 369 bp, Homo sapiens
caatccacccggcttcagtcttcccccaagcgcatggttgtgggactaagcacctcaaaggagggcacagaccccgccagcctgctgggaaaaaggcgtccttcctgctaagaaagtaggatctcaaaaggcctgtcctacccccagtctctccagggaagctgcttagaggcagactggcagcaggcagggccactcccagatgctgggcccagagccaccccaacaatccagcacaggaccccgctcagcaccagggagcccacggcagcccaccagcaaatcaagacaggcttcgcctctctgcctcgtcgtacatcttctctccccacgcaaatgcagttgtccaggccccgctaagaaccgttt

SEQ ID NO: 121374 - DNA, 366 bp, Homo sapiens
gtatattagctactgtgcctgacactgctgatttttactggatattgacccaggttctttagaatccttgagatgccaaatctgggaagagaaagaaggaagggagggagacagggaggagagaaggaaagatttttctccctgattttgtttcatgattgacagtgctgtttatgccttggcgtgttacgtagtaaaacattctttgaaggttttacatacagctctttctcactgagactcaacattgtctatatgcatagaaaaaatatcaaaaggtaaatttgggattcaaagttatttttattttcttctcaatacttaaaattttcattaaaaattttgagtaggtattaaattttactt

SEQ ID NO: 121375 - DNA, 495 bp, Homo sapiens
ggtgtgtggggcagcagcggctaacagcgtttctaccgacaaagcacacaggaattcacgtttgaaaatattttcgagaaatatttcatttgtaatgcactccaaaaacacagagaaacgacaaacccatgattgtcttaccatatgtgtgttggtagtcattatctgagggtgggaagggacgccagtggcaaaaagaaaaaagcaagatacaaataaaacaaacccccaggggttaggcaaacaaccagagagtgaatgtccgctagaaaactacaaatctactcatcacagaggaagacgactaagtatggtactcggggaaatctaacacgggctcaacgtggaattcattcccacatcaaaaatgcaatgtcttaacatggtaataatgtaccactaggtaacaaactgatggcgaactgtaagttacagagataaagtctgaaaacctcagcaggctggccgtgcattgggggctcacgcctgtaatcc

SEQ ID NO: 121376 - DNA, 271 bp, Homo sapiens
tggcttaagatctttgctctaaccactttgcagctgtgtgcccttgggtaagccccttaacctctctgaaactcctcctcataatcacagtatggcccagggatgtatggattaaataagatcaagccccagaagcacttaacatagggcctagtcttggtgagggaggcagttgttattaatatgcccaaaagatcacatctccacaccaccaccagcctggctatttatgaaaaccccatcccctatacaaatttgaaacaaatcagag

SEQ ID NO: 121377 - DNA, 1307 bp, Homo sapiens
agacatcagaatatttgatgttggacattgtaacttttgaccactggtttagatgatctgcccagatacttgtgatcggctcccttggcccttctcttctgcgttcctagcaggttctattaacaactgagaagtagaaggtggctgtaagacaaaaccaaccctgacaagcagacccaaatgacagcacatcagcaatgacctgccaaatacagtttgtctccccattttgtcaaatcctgttccacatcattctcctctagggcacagaagtggggccccagcaaattgaaactagaaccacttgtatttccttccatgatgccgataggaaccgagaggtctggatcaataatattacctgctctcatgctttttgtctgattttcagtctaaatgataatacaaacagtgtctcatagagattgcacaatttccaccttatttgtcatatctggctccattcctggaatgaggtagagattctgactccacaagctaattggctaccacttaaggaagcctgcactgcctctagaaaaaaagaagtgccccacacagatttgaaaggccgttatgcaaatccaaatagaaattcatttggggctgtcgtcacatggaataatttttattctatagctccagtgattcctttcctggtgtgcatttttatcattgccatcagatgattttctcagagctgaaatcacaatatatcgtgttagatctcagagtaaagatgtcactgctgttaaatgtttattggacttgctcaatcttttccaaatttaccaacttgattgtcaccggggaagaaagactgtgagcttgttgttgcagatagatgttataattaaatttgagtaacacaacagtgccttcctccttgactctcagcccctattcatgcagctagcgtgttctgatttatatataatcatctatatatttttttggttatatatgttctgttcttactaaagcacataattgcataggcctgttttttcaaagggaggatagctgaattacaaaaggaaggtcagtttatacccaaaactgatcttgttataactaaatgaaaagcaattatacatgtaaagaaagttgccaaaatataaaatgaactagaactcgaagatttaagaaattagctcatatcgatgcatatggtatgtttggactattaatagcaaagagacgaatagcccagacattaacgcgactcatgtccttggcattgttacttactagctgtgttacctggagtgagtttcccaacctctgtctcactttccttatgtgtt

SEQ ID NO: 121378 - DNA, 410 bp, Homo sapiens
tttcctgaatgcagttttaggataaggacaatccttggaaatccaccttccagaaggttccactgttgcggctttgggatcaggaaaggggatttgcaggaagggacaattgagagggcttctccctgctatggagacacacagctgtctgtacttcacgggaccccctccttcagatccagaagacactgaaaagaaacgcagggctttgaacctgggctggggctcccggggctgggcggctgctgcctctcgctgagggaatccacactctcgaggcagcacctcgcagagcaggtcacctcgactgccccatgatgtccacgaggcttgttcctgtcttactacgatcgagaagacagcatgtgattttatgaacaccccgtaaagaaaacctgaaaaccgtgttc

SEQ ID NO: 121379 - DNA, 433 bp, Homo sapiens
tcagtctaattacacagtacctgaggttctacatccatgacaagtgaggccattgtcatgcaatacccttcactgagaagacagtatctggaatgttagcatcagttcccctagtgctgacagtaaggttaactaatagaaaacacattgacacagtaaagtacagaagaagaggaagaaagtaatgaaaaatcaaaatgttttatattcagttttctctgtctatgcatctattggaaaggaaaatattttaagaagtcattacagctgattttaaatgtaccttttctgtgcaggctcagacataggggagaactagctctgctgtttgaaagtaactttggccagacttcaattcaaaataagaattcaagctatgtgaaaattgaatgaccttctgtttcatggagacccgtggcacagaaagagttct

SEQ ID NO: 121380 - DNA, 351 bp, Homo sapiens
aaaaaggaataagttcaagagatctattgtacaccatggtcaatatagttaacaatatattttatactttaaaattgctaaggtagtagattttaagtgttctcaccacacaaaaaaataagtatgtgaaaagcatatggtaattagcttgatttaaccacgccacagtgcatacatatgtcaaaacatcatgttgtatactataaatatatacactttttgtcaattttaaacaggttataaaaaaacatgttattgttgataattatgaaaaattttaatgatgtggaaatgtgtacagtataatgataaatgaaagagtagtaaaaatccttataaaatataattaca

SEQ ID NO: 121381 - DNA, 562 bp, Homo sapiens
tagaagtattagggttgcagcttaaaggaagagcttgatacttcaaagtctcactgagaagatgttagaattggcatccagtatgaaaactgaagagcctaaacaagattctttgccaaatgaatgggcagcttcctggcacatagaggtgagccatgacagcacctgcagagaggttccagattttgctggaaagtagttcccagccctctcagccagagaatgaagagaccctcagaaccccaaggtgatgcagaaagaataagatccatcctgggcaacatgttgaaaccctgtctctaaaaaacatacaaaaatcagccaggtgtgatgacacattacctgtggtcccagctactccagaggctgaggtgagaggatcatgtgagcctgggaggtcaagctttctgtgagccatgactgtgccactgcactccagcctggacaacagagcaagaccctgtctcaaaaaaaaaaagcaagaataagactattttaaacgcaaaagactttctcttgtttttaattatcaaaatggaaagattattttatgactgtaaac

SEQ ID NO: 121382 - DNA, 406 bp, Homo sapiens
ggcaaatgaccagggaatggcctgggatggcctgggaagctgggggacctacggagaaacacaacccttctctcttcctggcctgcctggggccatggtgcatcatcactgggaggtaaggtcctcagaccgcttctgaattagcctctgcccatggtttcaataaataaacacatatttattgagcaccttctatgtttgactcactgtgcctggccctgaggctacaacagtgaacgagacaaagatgcctgccttggtgaaactgaccttcaagagggaaagatggatgataaatggagacagaaatgcttatatgaggccaggcatggcggctcacgcctgtaatcccagcactttgggaggccaaggcaggtgtatcacctgaggtcagaagttcgagacc

SEQ ID NO: 121383 - DNA, 379 bp, Homo sapiens
ctgtggtcgctctgaggatcccccggaagactggcctcttgagggatatgaagcccgccaggtcctttgcgttttaagctgtggctcgtggtgttctggcgagaggagatcaccaagggtcaaaacaaatctcaacccttgacctctggaactttcacttcaaagatacccaagtttgattgacttagactatggaacagtttatactgtagtgcattgttgaaatcattacaggaatcagacagcaattagtgtaatttaacaagctagttgtggtcagagaaaccaagaatcagcgagagccctgcccaaaccactctcatcccaaggtgacagtgagcaatctcaagtctgagctccctgaggagcaactccagag

SEQ ID NO: 121384 - DNA, 534 bp, Homo sapiens
ggtataagaaccatttcaagtcgaaggagagtggttaaaggccaggtatgcggaccacttctataagatctcatagttgctctcttgttgccgagcgaggcgaatgacattgataaatcgccccattataactggtgataaaagcagcaggtacttaaaggactgaccaatagacatctgaaaagacaaatgactgcttgaagatgactgatacaagttggaaattagcgatacccattgtgaggagaacaggacaaagcacgctggacagagataataccccaatctcctgaatgctcattgatgtgggtcacctgacagccttctcggaaaaaagtcttaattactaaaaacatatgtgaaaacaccctgaggaccatgatagctcatgcaaatgtaaggtattattatgattcaaccaactgaagtgttgaaaattaaagcaattttatatactttcatttggggcacaagttttggggcattcggttaggactttttttttttactaaatggtctggatacttactatag

SEQ ID NO: 121385 - DNA, 241 bp, Homo sapiens
tcccattatccttggcagttctcttagaccttcgccatttcatcaggcctctcccctctgcctgcctcgcgccaagcagatgaccttgccttttactcagagcaaatagaggccttcaatcttcatcccctatctccatgcagggaaccaccacctacttcacacactccccagagccgccacccaggaactgacgaaatcctctcccctcacctcctccatccagctagagccaagccct

SEQ ID NO: 121386 - DNA, 543 bp, Homo sapiens
gcaggatgacagggagccagccacaggaatatctcaggggagagtgatccaggcagaagtcagagccctgcaacagaattgatcctggaatgcccaaggctgtatgggacagggaccaggccacagagggctccttgaccatggccacggggagcagtcttgatttgaatcctgaagcaagaggatgcagccatggggtggtgagcaagggagtcgatctctgcttctggtcacaccagagtaacagggatcagcccagccctcctgccatagcaactattaaagcagacaaaataacggaaaccactattttcaggtagtagacaatgtgcagggctagactgcaatcctgagagatgggaacccctgagagggtttgcccatcctgctgcttggtcactacttcctgaccaccatgcagagagctgagtctgagcatagcatgcagtctccctgggcagaggaggcagtgccagagtgaggacagtgggactgtcgggctagtcgggggctgtcgggctagtcggggactgtcgggctagt

SEQ ID NO: 121387 - DNA, 464 bp, Homo sapiens
tttaaacagagttttgctctgtcacccaagctggagtgcagtggtgcaattgtggctcactgcaacctctgcctcctgggttcaagcgattctcctgcctcagcctcccaagtagctgggattataggtgtgcaccaccatgcctggctaatttttttatttttagtagagatggggtttcgctatgttggccaggctggtgtcaaactcctgacctcaggtgatccaccctcctcggcttccctaagtgctgggattacaggcgtgagccactgcgcctggcccagatagtaaatattttaagctttgcagaccaagaggcaaaatcaagggtattatgagacttacctcaataataagaaacaaaattttcacagatttttttattgacaaaattcataacataattattgagtccagcataataatacacatctactaatgaggggaatagaattcttttt

SEQ ID NO: 121388 - DNA, 456 bp, Homo sapiens
ctttgtacatccacattcatatcactattattcataactggtaaaacatgaaagccaaccaagtatgcatcagcaaatgaatagataagcacaatatggtaccatagataaagtgaaacattagccttaaaaagaaagggaattctgacatatcctacaaaatggatggaacttgaggacaatatgctaagtgaaataagccaggcacaaacaactactgtatgataacagttatatgatgtagttaaagaatagccaaagccacagacagacaggagaatggctgttgccgggtgcaaagggaggggtcaaagggaagttattgtttaatgggtatagactttcagttttacaagatgaaagaaaagagttataaagatggatcgtgtgatcactgcatattatcaatgtatacttaaaatgtacacttaaaaatggggttaagattttaaactt

SEQ ID NO: 121389 - DNA, 759 bp, Homo sapiens
ataagaaccagagtcctcagcctcaccctgaagtgtccgctagacccttcgtgacccaaccctgctgaccagccacgtctctcatgtctcttaccctgtgcctggccagcgtgatgtgcagtcatctctagaatagacaggatgtttcacacatgctgctccctacccctggaaactcccttctctcccctgtaactgctcatccattgaggatcaacacagatagcacttcctccaggaagccccctcccattcctttgtgctttcttagcatctatcacaatacccactgcccagtgttgtgactatctagtgtgtatctgctcctctcggactgtgagcagcttaatggcaggggtcatgtaaatttgtttttgtaccctcatctgacacaaaggtggtgctcaacagatgtgtagagagagaaaggaagggaaggaagctgaaggaaggggaggaagaaaggaatgaaggcagaaaagaaggagagaggcagaccttagttccaccagtggcataatttccaccaagccaaagctgtctggggatggcccggagcccccaagggtggcaggtttcccatcgggagaggtgtttgagcaggggcagtgtgcccactggctgaagaagtggtaggagagttgacatcttgccaagggcctggtgtagatgacattgagggtccctcctggctctgcaatgatcaagttctatgaacattgttatttttccagaaattcatctgagcagccaaaaaaa

SEQ ID NO: 121390 - DNA, 697 bp, Homo sapiens
gtgacctacagtatttagtacagtcacatgtggtccagatttgtagcctaggagcaatgggctatgccatatagcctaggtttgtaatagcctagactattcaggtttgagttcactctatcacctaatggcacatttctcagagtgcatccccatggctaactgacgcatgactatggttgcgctcttatatttagttcagaattcagaacctctgcttccctcctgagagccatctctgactgtgccaactcaaaacaactgccccctatttacccacatccctggacctcccctcaggggagtgtctgagtgggcatagggtctgtgcccccagctccctgccctcacccttgcctttctccccaccctcctagaagtgagtgagtgtggaactgcagggccctgaacggcccagggcagggcattgctttgcctgacttgctgggggccttgggacagccccttgcagagcagggagacttggctgggagatctccaactttccttcccgccctcgcttttggggagtcccatgacttgctgtgtgaccttcagggcgggaggaagggttgagaatctgggtgaggctctcaaggctcaggaaggaaagtacgatcgctgcttaaaaaaaaaaaatagattagttgctgcttgaaaaaacaaaaaagcgtaaaccaacaaaaaagcataaacc

SEQ ID NO: 121391 - DNA, 458 bp, Homo sapiens
aagaccctggacctgggtcaccctatcgaagtcactgtatttaaaatatatttgagctgaaagtcccaggagtacacacagagtgccagctgcccctccgctggttcagcaggacctgccattgccacccacatccccagccgtggccctcaccctgtccttgaccctggtttattggtcagagacccaggtctgagtcagcctgaacatcttcctggttgtgtgagtgggatgctgccatgaggctgggcactgggggtttcctgacagtgacagaaatagccaaacggaaatgtatttggtgtttcacactttgcaaatagcattccctcagattgggcagagacccatcttctccctgccaaccccaacccccagctccatggacacaggtaggaggcctctgtatcctgctgagaacacaccccaccaggcctgtttcttctccccaccgttcc

SEQ ID NO: 121392 - DNA, 412 bp, Homo sapiens
acttcataatagcttttaatctcatctctactaataaattgaaacctagtgttagacacatagtagccctcaataaagacttgatggatttaaattcacctgggcctttattcttctgtgatgagtcatcaggacttactgagcctaggaaaagttgtcagaacagttacctggctgactggtggctcctttgtgtgtactgacctatataatgcctggggtgttcataatatttttggatacctccaccaagaaaggatcatttatcagtcttctgattgcttgataagaggatcctgataccatggaattttcttgtatctggatcaatgtttattactagtaggtccatgttaggaacacagcccgagtatggctttggttcaatagagtagattaaaagccattctgg

SEQ ID NO: 121393 - DNA, 259 bp, Homo sapiens
acgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatga

SEQ ID NO: 121394 - DNA, 276 bp, Homo sapiens
tgctgagattataggtgtgagccactttgcccagcctggaactttcattcttaattatcactaagaatttgcacacatctacttcttgaaatttttaaagtaatcttgggatcaagaagtgcggttactatatttagatacaatctcaacattcaacttatcagccacacctctagactgcaatccaaatgtgcatagaacaacacatgcatgggttggaagtttaaactgtttttttttttttttttttttttttttttttgagaaggagtctca

SEQ ID NO: 121395 - DNA, 416 bp, Homo sapiens
ctaaagaggatttcaccatgttggtcaggctggtcttgaactcatgacctcaggtgatccacctgccttgacttcccaaagtgctgggattacaggcgtgagccaccgcgcctggccaagtttttttttttttaatatcaataatttagaactgtgcttgtcctctcccttgcctcacctatcactcagaagggacttagtatttatggagagatattattgatgggcgtggattgcacaagggaaggatgtggaatcagataaaagattgagtatgttagtccatacttgaacaaagaagcaattctttccccatctgtcttcttaaagctttttccatttgccttattgctagcctgttctattccttccttctcttctcctcccctctcccctctcccctctctccattcagt

SEQ ID NO: 121396 - DNA, 529 bp, Homo sapiens
tgagggaaccaggattaaacctaagcaatctaactccaggtcccagattttttaaccattacagtactgtttaatttgatttgatatgttaaaaggattaataaaattaatacaggtccattcccttattcataaatgttcattgtcttcatttatttctttatactgttctgctgaaattgcactctcatctccccaataactttgtaatatccaatgccatttttttcagtcatcccattttaaaatatatttttactagaatagtgaaatatatattcagataaaattggctttgttttaataatgatcagtaaaagtaaattcattttaatcatttccacacattcatgaaaagtaaaggggaaaaatgggcatagaggtaaccactagaattaggctttcttggatgggtagaccaggtgtggaggtgtgcagataagattttacaaacactcatacactcccatctccaaaatcataatttatcttacattctgctactaataaacattccactggttttaaa

SEQ ID NO: 121397 - DNA, 368 bp, Homo sapiens
tccggggcggaccgtgggactccgcgcgtactcggcgctgagcgcgaccacgcctgcctgtcttccagtccagccaaacactctaagcaggaccgctccaaccgcagccccgggatgggtccacttcctaacgcagatccccaggccccctccaaccagtcggctagccctcgcctctgcccagctggacgagtctcctcaacacgccacctcgccctgcccacagagggccttggctctcaccttctcgcctgcctataaggcccgcccacattcctcctctctcccagccaaaccccatctgtccttcaacaccaagtagaagtcccctcctacacacactcctctctgaccagtgaaagagctcc

SEQ ID NO: 121398 - DNA, 331 bp, Homo sapiens
  misc_feature (159)..(159): n is a, c, g, or t
  misc_feature (223)..(223): n is a, c, g, or t
atcaccaccactgagatcccatcacacagtactcccagcttcacttcttcaatcaccaccaccgagaccacatcccacagtactcccagcttcacttcttcaatcaggaccactgagaccacctctcatagtactcccagcttcacttcttcaatcatngccaccgaaaccacctcacacagtactcccagcttcacttctttgataaccacctctgagaccncctcacacagtactcccaaagggacctgccttgtttttgaggagcttgtcacttaactatgttgaggtaccaaagaggaagctgagacaaagtcaattcaaagtacag

SEQ ID NO: 121399 - DNA, 405 bp, Homo sapiens
ggaaagcagaggctgctgggctggcgaattcagaaaaattaagatcacagagggtgaagagccaaagctggcagccaagaaagttacataagccccttcttcaatttcatgcacaaaacaggctcctgggggctttggggcctgggagccatgaaaggacacctttgcagatcaagtcccttgccttctggaaagctctggcctcaggacacgcaagcaagatggacccttgtcttcagagttgagaatggagactcctggggtaggatcagagttacgatgaccttcgctagcctgccaagtgctctgaaaacttgggagtggcaagcaggacagggaacctcagcccccttagagaccatcaagtctgggtgaggtctgtaaaatgaagacttcacttagctc

SEQ ID NO: 121400 - DNA, 676 bp, Homo sapiens
gccatagctttttgaatggttagtttcagttggaaaacatagtgaacaatacatctggaaatattctgtcatgttttgagctgagaaactctagagaaccagctgctgatttaaaagccttttattatgatacagacagtctattgtctataaaagcattggctattacacagtggtagatatgtgttgctttttctagctattaacttgaaagaaaaaacttgtattcataatttatgcatgacttatattccctgagaatagtttattgtgttattttctttagctgatttactgagcatttagagattttttgagacagggtcttgccctgttgtccaggctggagtgcagtggtgtaaaacactgctcaccacagccttgacctcctgggcttaagtgatccttccacctcagcctcccaagcagctgggaccataggtgtgagccacacacccgactaattttgtgtagagacaaggtctcactatgttgcccaggctggtcccaaactcctggtttcaagtaattctctcaccttggtctcccaacagtgctgggaatgataagtgtgcaccactgtgccagccaggatttttcttactccatttttttttcctttaaactcaatcaaaagttaaatggttaaatagtaggactgacatattttccattc

SEQ ID NO: 121401 - DNA, 468 bp, Homo sapiens
cccgagtcgtcctggggattttcttcactgagcatttgtgaagattctggggtcaaggttgggttaaacttttgtggtgggtccatccgcggtctagtcaacagtactaagctcttcctgcatctttgggacccagcgggaagtgatgccagctctcaaattgctacaaggtatcctggaaagaaatctatgacccagaaagagcctgaaaacccaaactccagcaaatattggtgaaagagccaacccgcaaagccttttaaaaccttgaattccttacctataaactgggataaaacctatggtgtaagtctgttctgagaattacatgaaatggatttatagagttctcagtacagttcctgaaatacagcagctgacgccagtagatgttgatttccttctcctttctacttttgaacttagctgtagttattagcatttttttaatgttgaggtaaacagttt

SEQ ID NO: 121402 - DNA, 246 bp, Homo sapiens
tactgggattataagcatgagccactgtgcctggccacattcttgatttttagtttgttcagtttttttacttgccctaagcatgacagtgatgacttctaagctctttacatgctgaaggtgaaaccaaaagtctctggcatttttttagattgaaaagtcttaaaatttctccttcttataaactaatttatctcattctttatagtccaatgatgtgcctttacctgtttgcaaacattctgt

SEQ ID NO: 121403 - DNA, 291 bp, Homo sapiens
gatatttaattcagaaaaaaatgtattctgtagtgttaggggttttgaagagtgaaaatatagtcagcaaattaaccttctgttactggaaaatggtaggacacgttatcaggacgagacttccaagaaaaacaatggaaaataaatagtgcaaaaaaataatatgaagagactaactaaaaatgctctttctaaacacccctcctgccttctcccagctcagcactttcttcccatacctgctgtcacctcttgtcccatatccctctttcacacactgtctctccatcc

SEQ ID NO: 121404 - DNA, 479 bp, Homo sapiens
tcatctggtgatgggcatttggattaattctctctttgggttattaggagtgatgctactgtaattattcatgtacaaaattttgtgtggacctgtgctttcatttttgaatatgaaaatactgcgcatctccaaggaagacatacaagtggtcaataagcacatgaaaagatgctcaatgaaattcatcatcagggaaacagaaatcaaaaccacaattagataccacttcatacccataagcatggctagaatcgaagatagagaaaattggcctggtgcggtggctcatgcctgtaatcccagcactttggaggctgaggcaggagagtaacttgaatctggaggcagaggttgcagtgagctgagattgtgccactgcactccagcctgggcgacagagcaagactctgtctcaaaaaaaaaaaggaaatggggctctatgtagcaggagacaaagggaaccaggggatcctcta

SEQ ID NO: 121405 - DNA, 3025 bp, Homo sapiens
tcgaggcctggggtgtgaatcggccgaggtctcaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121406 - DNA, 745 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggtaagtggatttagtctgtgaagtacagtagtgtcctactggaaagtagtaacaatggtttcataaaaagttacttgttgtcttgagaaaggcaatctaagtcaccttgtaggctggcaagattttgtctaaattatttatgttgggttttaggttgtaaaatgcgttttacctgaggctttattgttttaatagtctgctcttttcatttcctgtccttaagtaactatatcagcctgttccacacatctgtgattggagaacatgagcctttggttaattgagtatatgtgtatcacattagacactgtgtgtcctttactgtctgatg

SEQ ID NO: 121407 - DNA, 4183 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatgaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121408 - DNA, 4662 bp, Homo sapiens
ctggccaagggcaactggtcacttaggaaggttcctgtgcaatgagaagctctgtccagaaaactttgttttatacacctaaaccagcagtgtaaatcactacaaagtgaaaaacaggagaccttgatttttgttccaaagttgctattaacttgatggtttactttggccaaatcccttcctctctctgaacttgagatttttttatctgctaaaggaagacgttggattaggtcactggtttttaatcccctttcccattcccccagcacaagtgaaggataaaataatagttctataaagccatgattttcccagggaaggaggaggtccagtctggagggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121409 - DNA, 3020 bp, Homo sapiens
caaaatgaaaactctcctcttctcaaagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121410 - DNA, 4152 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaaaaatgaaaaaataacccttatatt

SEQ ID NO: 121411 - DNA, 3561 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagtaattatgacctgacttgac

SEQ ID NO: 121412 - DNA, 304 bp, Homo sapiens
tctgtttgtatttaaagggagtagaattttaacctaggcaaatacattggataacaatatttaggagaaaaatattacagtggcaaaatttatttagaaagcaaatttaatgtttttcattgtttataaaatgtgttgtcatgtttctgaaaaattctgcttataatctaagttatagagtaaattaagttatggctagcagtgatgatttattttgtataatatttgatttaaatcattttaaaggggtaagaagagggacgagaagtagaaaaaataaatggatctgctaaatattcaacag

SEQ ID NO: 121413 - DNA, 448 bp, Homo sapiens
aatccttgaaggttaagctgttaatatgaaaaatagactcttgaacttataagcaaaatatagtatatttttgtgatttttttcttgtttgttcttttttatatttgtgttttaggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggtaatggtacacaattatggtggaattaaacataagttattctaaaaatatcctgaagcaaactctagctacatttgtaaatacaattatattatgctattactatttatgtcttataacatattcatcttgtgaagataaatgtactttttgttttaaagacattagaaagatgatttgtgtttgacctcagca

SEQ ID NO: 121414 - DNA, 366 bp, Homo sapiens
cacttatattaggaggaatctttgattctgatggtttttgttttactctgatatgttctctgtctttattcacaggttacatgaagttcggatccagccttccctaaccaaagatggtgtcttttctgccctaaagatggcagagttggagtttccccagtttgaaacccttcatctaggatatgtagatgagtttttgctacagagtaagatttatcccattttaattcctagaattactgtaagaaatttacttgacaaactgaaatctgaattgggttgtgccatgtctttttgaacataagacaacttaaaatcttaggtgctctcacgtcttgaaaaataaacttttaaattagaaatgtc

SEQ ID NO: 121415 - DNA, 4408 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121416 - DNA, 4466 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggggtaagaagagggacgagaagtagaaaaaataaatggatctgctaaatattcaacaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121417 - DNA, 3944 bp, Homo sapiens
cctgcatattggttgattgcagactgtgagagacgtattcccatgagctcttgtatccccagcactatgctagacactaaagatgtaactatgaactaacagaatcttggagcgtgagggggcaggcagatgggagaaatgataagaggcaagggatgaggtgtgattcttagtgacatgatctagaataaaggatcctcctttacttattcccaaacccctagtttgtgaccagagagtaggcactaaagcccagtggcatgtgtttgagttagaagtgcacttttagggtatagatagatgttactaaccagtgccatgggttctaacaatgaatcttaaattctcagagtttacctttctctacacatgtccacactgggctccaagaacatcattttattgtaagggagttgagtttttaagattttgttttccttttaaatgataaagctaaaactttaccatggtatgaaccagtatgatagatccttcacttatgctttaagaatttttgccttttctcttctctaaacaattggaaataatttttcctactagctgtcccttgacttttaatataatttattattttgtacaagaagtgctaccatatgtacggaatacctaacctaaaattatacctgaacccaatgataagcagatgatacagaatgatggtagagactttttatactgactggtaagatacaaagttggtaacactccctaacacttaagaatttgactttttttttttttaattgattgctctttttaggcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtggaaaaggcaagactccacttcgaaagaggtacaactcccatcagatgggccagtcgaagcagtttcccctcgaggaaagcagctgtgagaaaggctgtcaggtcaccagtgagcagatcaaagccgatatgaaagcagctagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121418 - DNA, 3679 bp, Homo sapiens
agcggaagtgcctcagcggtaggggccggggagcgggtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggacccacaaattccttgaaatatgtccctttagtaacaggcttagcctctgcccgaaacttggaacacttagaaatggttcgagttcctttccttggaggtcttatccaacatgttgttgaagacagttggagatcaggtggttttagaaatttgcacactattgttctgggagcttgcaaaaatgctcttgaagtagatcttggttacctcatcattactgctgcccgtaggttacatgaagttcggatccagccttccctaaccaaagatggtgtcttttctgccctaaagatggcagagttggagtttccccagtttgaaacccttcatctaggatatgtagatgagtttttgctacagagcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcagaccactcaagatggactcgattggttgatatcaacctagtacggtgccatgctttgaagctggactcttttggccagtttattgaattattacccagcctagagtttatttcactggatcagatgtttcgtgaaccacccaagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacgcattaaatgagatggaagacatcgtccaagaagatggagaggtggtggccgagagtggaaataatactccagctcacagccaggcaattattcctgtggatgttgatgaggaacaagcaggacccagtggtcttcagcgtgtagtaaaaccaaccccaattactgttcatgattcagagagtgatgatgaagaagatagtctagaactccaagaagtctggattcctaagaacggtactcggcgttactctgaacgtgaagaaaaaactggagagtcagtgcagtccagagaattgtcagtaagtgaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtggacactctaactttggagcagaagctatttagtggtccctacccctatcacatctgtattatccatgaattcagtaaccctcccaatgtccggaataaggtgcgcattcgcagctggatggacactatagcaaacatcaatcaagagctcattaaatatgaattcttccctgaagccactcgaagtgaagaagacttaaagaaataccccaagtacccctgggggagagaaatctatactttagaaggtgttgtggatggagctccatattccatgatttctgacttcccttggctgaggtcattacgagctgcagagcccaacagcttcgctcgatacgactttgaagacgatgaagaaagcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctagtaatttatttccacattgaattgtgtatatgctttatcttgaatataaaataaaagtttattaaaaacttt

SEQ ID NO: 121419 - DNA, 446 bp, Homo sapiens
agtggtagcattgaagctgggcgtggtgaatgggctgcatttcaacagtcagttgttgaggaaggagcatttctagctcccccatgacctttcttctgggggcttctcctccctcaccccctgatatggtttggatctgtgtccccacccaaatctcatgtcaattggtaatctccaatgttggaggcggggcctggtgggaggtgattggattatgaggtgattctctggtttaacaccatcccccttggtgctgtcatggagagaatgagttatcaagagatctggttgttgaaaagtgtgtggcacctccctactttctctctcttcctcctgcagctcgcccaactcaggggcgagctgcctctgtagccgcttgttctgttccttctcccggttctcggctgcaatgcgctgatcccgctcctcagtcagcttctccatgt

SEQ ID NO: 121420 - DNA, 101 bp, Homo sapiens
ggagtatgagtgaagaactcagatatgcagactttcagggctggaaagaatcttaagagatgatccaggaaagctctatctcacagatgagaaaaccaagt

SEQ ID NO: 121421 - DNA, 447 bp, Homo sapiens
tatcattctttgcaagaaatgctagaaggagtctttcaggttgaaacgctgaacactataaacttctttaaaagaacactaagcatcttacaacttgaagttgtaagaagaaatagagatctccagtaaaggtaaatacatggacagttataaaatctagtatattctaatgatggtttgtaactctttttattttctacatgattaaaaagacagatccattaacaactgctaatattgggtgcacaacgtataaagatgtaatttgtgatgtcagtaacagtaagggagacagcagtacaggagcagagttctgtatgttattcaaattaggttgatataaattcgatttaggttgttgtaatgttaggatgtcaagtgtaatccccgtgtcactataaaaaatgaactaaacacgaaaggcagtaatggaggaaatgaggaacc

SEQ ID NO: 121422 - DNA, 150 bp, Homo sapiens
ggagatcctgtgtcctacaaaagaccccttgagggagaccagccccctagagctccgtgggtctaccagggatggttttggcagcctgtccctcaccctttcagggccctcaggatggaaggaaggtctcccccaaggggatgccttcca

SEQ ID NO: 121423 - DNA, 423 bp, Homo sapiens
ttcatccccactctcatctaaatggccatcagtcctattgattatatctctgaaatgtttccacagtagtcataactgatgttatttatgctaagcacttcacatacacgtacacacacacacaccacacacacaaacacacacatgcaacctaattaatctacagacaacagtccattttaaaggtaaagaaacagaggcatgtagaacttaagtagctttcccaaggtgacacggcagtaagcagcagagtcagagtctgaacccagttgtgtgactccaaggcttgtgaggccagcccctttgctgctatgctgcacattgaaatccatggtctaatttccacttttttgctgctgtagtttaaaattcaggttctttgtgtgatcattttcactcttaagaagtaccatacacatgagg

SEQ ID NO: 121424 - DNA, 567 bp, Homo sapiens
gtgtgtatttctgtctttcaatttccaagtacaaggtctcatttaaaaaattactgtcaaagaagtattgaagatggattgttacgaatataaggggaaagtgataaaaacagtgttcagaagagagatgataaggacatgagtcaaggcagtagctggggagaatagggaggggaaagagcatagaagagccattatttaattagaagcggtaggtcttggtgactagttatgaggaggtgtgaggtgaagtgaggtgtcaaggttaatgtacatatttctagtttaggtaactcagtggctggtgttatcttcaattgagatggtgaatactaggagtgaaatgtgggtttgggtagaaagttaaattctttttttttttttttaattcaagagacatgccccttgccatattatctgggctgggtttgaactcctgggttcaagagatcctcccatttcagcctcctgagtggctgggactataggtacatgccaccatgcccagccgagtagtttttgacatgcacggtttgcgatgtctttgagtcaggtttataggacttg

SEQ ID NO: 121425 - DNA, 212 bp, Homo sapiens
ttcatttgaaacctattatcagccttatgaccataccaagttgtgccagtcatttaaaatttttagtttttcattattcaacatacattgatatacagcctaacatgcatgtctatgagaaagtggtaggagaaagctctcagctgatttttgtgcaactgaatgaccattaatgcttggcaatcttcccaactgaatctgactcaagtaga

SEQ ID NO: 121426 - DNA, 137 bp, Homo sapiens
atgccactgttaagtgaattaattacataagcataacagtctactgctattttctactcttattgtctaagaagtttgaagtttaaataaaacagggataaatcagaaaattaatgctgttgtccatcagtaaaata

SEQ ID NO: 121427 - DNA, 445 bp, Homo sapiens
cttctagctccaggtggtaaattctgctcagaaccctggccagatcatgctgccccctcttctgctctcagtcctgctttgcagcaggaactatgggaggatgccagtgtgtccagttcgtgtctgttcacctcacacatgacagaaattgctccattacacttctctgcccctgagaccaggtggggtgatgcagtcctacttaagacaacttggaggcacaagagcacaaaccaatcctgaatgtgctttgccctaattttaccaataaagaaactgagattttgaatgttcataaaacttgtctaaggtcacatagcatgtcaatgcgaatctaataaggagaacctgtactccagttctgggctctctttgttgtgctgttgtaatatctgtgacctaggatcgatggggcccagttctctaccacattgaaatatcctcg

SEQ ID NO: 121428 - DNA, 333 bp, Homo sapiens
agtttatagccaatcacttcctctaataattcagactcatgtaaccaactgtttggggggcatctccacctggacatacacaggcacctcaatccaaatgcatcgcaaactgaatccactatcttcaactcaccaattcccattttaaggaatggcagtatcatccacccagtaccacaaatcctctccctttctccaaaccttccatcagttaccaagccctgccatgttttatctcctcataagtctcaaattcagcccctgcttgaaacccttctaccacagccttagttcaacagctcattagctctcacttcaactattgaaaaagct

SEQ ID NO: 121429 - DNA, 324 bp, Homo sapiens
atattatctctttgcttgtaggaagccctgagatttgcaaccctctacactatcgacattggacattatggcatgcattcttaacatttgaactgtgccccgacttcatcttgcttttttactgttgttttccctcaattctgatttcgttaactaatctttgttctcttgtatcatatatatttctataaatggtttcaaattattttgagaatgaaaatggctattaatgcataaatacacacagtggattttaacccaaaccctttacgacactagtcctgtaaaaagacaatgtggcctcagacagacctgggctggaat

SEQ ID NO: 121430 - DNA, 758 bp, Homo sapiens
ccaccaactggggtagatttattagttactttaccattatcacacatattttatactgagataaatacagtattctgtattagtgctagtttgtcacaaatctccattaatgcgctttcaacttcgtgccagtaaatggttaaaaggatctatgaaaactgtggattatatctcgaaggtaacttagtaaggatctttgctaatgatatgtaattacatgactaaattatttccttagtatattaagctttctacaaatactagcacattctttgttccaggtcagtgtttttcttataaatatcacaatgttaattttgaaaagtaatactttcaataggcatatttcaggtattgtgtgtactttttaatcatcagaaattcccaggcgcatatgttaaaatatttgtcttcctttgaaaaaggaattgtatgctcaaatgctcttgagtttatcataaacaaaataaataacaataatttttaataaattccctagctaatgaatggaaagggggacataatttttaaaattccatcaatatttgagaccactatgaatgcagtcaacaagaatttctaaattgttattggacgttgtccatacattaacttcttccgagataaaagctattgtcatagtaataaaattacctaactaaattaaatagactaggtgatgtgttgtcaaatgagaaaatagtcaattacttaagagcaacttattttaaaaaattatttttgtaggtaaaataatc

SEQ ID NO: 121431 - DNA, 442 bp, Homo sapiens
ttgaaatatatactaccaataaaataactcattctctttcattagttaacattacagtgtacagaaaagcattatgatgtagaaaattcaaattcggcctcccaaagtgctgggattacaggcgttagctgccgcgccggccaaaattattccataaatttatccataaaaattccacataaattttctggagtttgattatgtattaggcttgttgggaaatttattacccttgtgaagaattttgtagctaagtagcttgagggttttttttttttttttttcactcaggaaagacatggtatgtatgcatcactgctattctatttgaagcttttggaatttttatttatggggtgtggatagaggctggaggcagagactgaggtcagagaagaggtagtagaaaagaaggtggcccactaccatatttccagtgtat

SEQ ID NO: 121432 - DNA, 405 bp, Homo sapiens
attgttataggagacaaaggaggacattacatactgagaaaatggaaaattactcaagacttcgcaatggaaatgtatacacaccaaaatatagagccccagaatataagaaaatatactgacagaattggagtgagaaagacagttctacaataatacttagggacttcaataacttactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaacta

SEQ ID NO: 121433 - DNA, 258 bp, Homo sapiens
cagagatgaggagggaccatctattttgggctactagggttggcataacagcatctttaaggcaacaggacacaggcattgtgggagggaagcagctaacatttagcttttactctgtggacttagcgtgtattttctcctttaatcctttccacaaccctgggaagttgctactatcactgttcccatttttactgatgaaaaatatgaagctggaagaggtgaagaaagtggatcaaagctgtatctttacattgc

SEQ ID NO: 121434 - DNA, 472 bp, Homo sapiens
aaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtct

SEQ ID NO: 121435 - DNA, 307 bp, Homo sapiens
ctgccccgggaactggaatgaatgactctcaggtaccaaattaagccccagcacgaggactctgggctggttatgttttccttcctcgcttatgtgtgtggcctcaaaggcactgctaaccataaagcatgcaagttcaaggggaaggggattcctcaacaccaaccctgaaagctgcgggcaccagagatgagtttgttctcacctggagcagcagtgacttaacaagagacaaggataggctcagtcgtccccactccaccctagcacgaccagccagcctcagcataccttctatgcacttaag

SEQ ID NO: 121436 - DNA, 411 bp, Homo sapiens
atccctcttcatcccacgatcacagccatgctgcctgatacaaggaggcttaaagcagttgttgctcctgaaccaggaatgagaagtgtttcaagggcaagaagcacaaggttgagcccaagagagagaataaagaagagctgttgtcagatagaaaaaagtgaagaggtacaagtcctctacctgaagaaagttacagtgacaacggaaaatgccaggtttgaggctgttgctgtcatctgagaggtatgtattaattacttcatagagtaacttgtccaaggcatagctgaaaatatagttgaaccagaatttgaactcggccatctggctccaaagcttatactatatgagaatttagttttatttggaagtagggttgtgctgtttctacacatcaaagttaataag

SEQ ID NO: 121437 - DNA, 932 bp, Homo sapiens
taatccaatttattttggtagcattcagctcaattaagggatacaatgttacttaaaatagtctaattagatgaaactccactatggtactcatctttcaatgtctgaaatataaccatgcattaggctgcaagaggtgaatactgttaactccagcctccatgtgtctgtccagtctatgagctacactgctatttccaacactgacctatatacagcaacatgccatccgttctggctgtttgtgtaagagatgcctcacacacttgccttaaccaacatcattcgcattgttcccacaatgggctatgtgaaaatggaggctactttgcatagtgatatgttcataacgtgtattagtcttacagtagagcaatactagattaaaccgtttccaaaaatgcctcctccagagtttattaactgaaaaatgtaagtagcattttggcaatctatagagcagcagtgccggaaagtgtcagcagagtaaaacaatcacattttagtttagaaagcttcaggaagagaatattcattttctccattagagtctcttctgacattgaaaaaaatgtcaccgggaaactgtagctacagttgtaggattctaaagcacagatagatactggttccgctgggatttagcacaccaactttaaataagcaaagtgttgacaggtttaaaataaagataattagtaatttatgatcttatcaccctattaaaaacaaatcacctgacaaactgactgctatttgtagtaagctacatattcattacgctccgaaggaagcaagatttacttgcagtattgttcttttggggatgtctgatccaacttgttttaataaatgtaggcacagatttcttacttcaccttttccaaacttctgtccttcttccatttccctgcaaatccactcatgtcatt

SEQ ID NO: 121438 - DNA, 823 bp, Homo sapiens
atcatatagagcttcttaaccttttttatgacattaaccccttctcaagataagagaagttttaatatttaaataaataaaatgtgtaggattacaaagaaaacaaattatattgaaatatagctcaggtaaagaaccccagaacccttcattatacagatgaagaaactgaaacccagaaaagctgcgatttgtccctttgagcactctaatctgatagtcttctctgtctacatggaccataatgtcatctttaactggtttttttttaggcccttgtcctgattggataaacaagataatatttcttatgatttagaatgcaatgtgtaaatttcagactttgctacttatttgcaaacttcatttagataaaaattaaactgggtgattgttttacctctgtttagctctgtctctctttttccttcttacaagtgccttgaatacaaagtcttgttagaccaaaaataaaatctctgtggcgcacacctgtagtcccatctactctggaggctgaggtgggaggatcacttaagcccaagagttggaggctgcagtgagctatgatcgttccactgcactccagtctgggcaacagagtgagacttcaactcaacaaaacaaaatgaaaacaacaaaaacaaagcaaaagttaactccctaatcttcagtctctctagtggtgccacaatgattttattataattcaaatttgtgcagtccactttagggttaaaatccttcatcattttccctaaagctggggaaaaaaagacctgattctagagcactccaggcccttcatgtgggaccctggctg

SEQ ID NO: 121439 - DNA, 242 bp, Homo sapiens
cgctcatatgcctcaggtgctcccaggccatctggaaagtggcttgaattccaacccagatgagttcatcctggttctagagtttcttccccagacttcaccaaacctctgtgataccccagaagtaattggcctcccaaattgggccattctgggatggtactgaaccttctacaatggtgggagaactgattcaacatgtcccaggcccggagtgctagagtggctacacggtggaagag

SEQ ID NO: 121440 - DNA, 465 bp, Homo sapiens
tttttaaatgagagaaaaatatacccttaggtgtttgactattatcaggtccctattaacagctaaataaaattcccaagtaaaataatagtgtaggatggatatccccctaaccctcaactccatattccatacatccagtaaatatttgagttcaccatgtgccagatatttctttccctagatttctccatttctgcttaagagaccatcattctccattctcaccatctgcttaagaacccatgtgaggtttagtgagcaagagtgtaatgtgagaacagttgacgtgcttgtacattttggtccagctatcttcggctgcatgagttcaggtataaagtaagtgaagagatgtctgagctcctgatctactgagagctactgagaccagaaatcttagccttccccttaaatgccttctcaccctaatctgcacatccagttagttgtcaaagcctgtca

SEQ ID NO: 121441 - DNA, 705 bp, Homo sapiens
cacacgggacacgcatgaattagcataacggcactcacgaatgatttggcatgggattgtcgaatcccctgtgctaaattgttatcctcaagtcagcatggtcttcacagaccccctacaggggaaggagagagaaaacactctgactgcctgacttctttttttttcccccaagatggagtctcgctctgtaacccaggctggagtgcagtggcatgatctcggctcactgtaacctccacctcccaggttcaagtgatcctcttgccttggcctcccaaagtaggattttcttaaatcatgttaaatcatgtgccagtgggttatactgtctatgaacttcatttcaggagaacagagagaactttcccagaactgacattcaagccagcacacgccctggtatggccacgccagtggttaagacagcaaaacactaaattatggattatttactcattcataaacggtcactgccatgaaccccctgactattagtatcctcctagctctccctggggatcccctgggctgccctctggcccagaagtccaggggttaaactgggtatagtgggagataagagggacccatatcccggatgttggatggactgatgactttgccaagcagtaaatattttgtctatcagccctacatgttacaaaatatttgctatgaacaatagtggcatgtaaagacctg

SEQ ID NO: 121442 - DNA, 461 bp, Homo sapiens
cctgttacttcatcgccggcttcctttgctctgaccattgggctcctgtgccaggctcaacgtatcagcagagccaggctatgcacatgctgactgacctcactggtgacttctgcagtgtcagcaatgggtaatgacgccaagagagcagattctcagccatgataggggccacactgtagccccaccctaggagagtggcaccctgcacctctatatcacccctgggttcctttccatcattcagtccctgctctgatgcaaaggtaggaggctgtgaactccgaatccaagcctgctgtctgctaggcctgcgtgctgtcctccttggcaggttttggaaatggggaatgacttgagccagagcctcctccctgaattatgggcaatgtagcaggtcagggctctctgcctgccccagtacccagtctgtgcctctccaaacccttagccatgttgtg

SEQ ID NO: 121443 - DNA, 364 bp, Homo sapiens
gtttgatcttgacaatgcacctgaatgcctgagactgcctcacttgctgctgtgcctcagaacagggggctgttcctgttggatgggaaaaatagaaacacaaatgtcccaggtgcccactccagatgtgtggcacataagaaaaactcgaaggctaggatgtgcctggaggagaggcaggagggcagtggtgtgttgcccagacactctctgggcatgaacaaagtgaagtagacacccaaaggaagccccctaacccatctcaccctttgccctcctccttaagaatgtaatttcttcaaaggagacaaaacaaagtgtttagatctcaaagatgagagaatccatctgagggggcctgcac

SEQ ID NO: 121444 - DNA, 581 bp, Homo sapiens
agccatctcattcttcagtgatactaggactgtggtaaggtatatggatccatatacatttttctgtgatttagtcatagtctgcctaggcctggtcttttcattcttgattctgtgtcactggccacatgtttcatgtgatgtttcactatacagtgccagcttctgtatgcatcccttttgtgcctatattatggagaactataagaatacatacctaaggattagtttactagtaatggaacaagaaattgccaaggtggcttttggcgtgagattgcttgactttttccccttgattgtgacgtatttaaaatgttgttagctatacagatattgaagcaggccctcatttctttggtaagaatattggcaattgctctgtgatatctgaacattttactaactgtcatttttatagtacttttcttaaaaattaaaaaaatcctttatagcaaccatgatgggtagtggtaatggcactttttaagtcgttttagcttataaagtgctttcacacgtgttatcttatttgatccttgtataaaaagccccatgatatccaaagtgattaagatctt

SEQ ID NO: 121445 - DNA, 356 bp, Homo sapiens
caaatgagtattcttaacattttactaaattaaaaaaacttatgtgctgagttttttattttacaagtatctccaagtatgctggatgattgcaaagaaaatcaaggccagtcattggttaaatgagtttaatagtagccacataatttcaaaagcaaaattataaagacccttcccagactgttgatagcaaaaataatctacgttgtggaaagtgggtccatgttaatatgttagatataagtagtgaggcctaaaaaggtattaaaacatctttgcttaaggtactacctatttgcaagattgttattttaaaaatagcttatgttttaaattgttattgctttttatcactc

SEQ ID NO: 121446 - DNA, 392 bp, Homo sapiens
gtacagtctgctggattgtgagccatataatctttatttctttataaattatccactcaggtattcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgta

SEQ ID NO: 121447 - DNA, 321 bp, Homo sapiens
aaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaa

SEQ ID NO: 121448 - DNA, 368 bp, Homo sapiens
gtaacataattaattttcaattcatgtggactactagctttaaaatgatgagattcttgaagagtttttaatttgggatgtttcacattattttaaattttgtacagagactttatgactgcatttaatagtgtgttatttcaaatttaaagttccacattttgcatggaattttgccacatcacatttcataggcaaaattatcctctagtagttgaatactcagggaagcatataccctcattctctcttttgggcctattggcacccagggaaattaatgagttaatctattttcttaaataccagggagagattgaacattatttaatctgtgggctcaaaatggccttaaagttcctgcattt

SEQ ID NO: 121449 - DNA, 370 bp, Homo sapiens
tgaccactcggtggagttccactatgtaaatcaaacacaggccatgtatgtatgttgtatgctgcccactaacaaatgtaaggccatcttacctcaagtactcaaatatctaatactgtcagcttgctgctgcaacttgtttttcaaaagacttcatcttccaacaatgaatgtcattagcattagatgtatcacacatcacatttgctaaatttggtacctgaaatgtgacttctagtattacagtatttgtagggaaaaaaaagtatctcggccgggcgcagtggctcacgcctgtaatcccagcactttgggaggccaaggcggatggatcacaaggtcaggagatcgagaccatcctggctaacat

SEQ ID NO: 121450 - DNA, 410 bp, Homo sapiens
tgtgcgtgcgtagtggtgggggggaatctctggcaaaacttcccctaggtcagtcactgaccctggcacatcatgtggcctctctgggcttaagtttcttttggatgtgttggagtctggggtacagcaggagtctccttcagccttataatctggccttagctaaggctctgtctttgccagtaacttactgctctattctacttaactcatgacttctatctcatagtccaagatggctgcctgagatccagctatcacaactgtttttcacccagctagaaggaggagggggtaaagagaacacctctctttttgagaacacaacctgggaattgtgctcaacactctttttccaagtcactggccaatacctagtctaagggctacatctagcttcaagggagact

SEQ ID NO: 121451 - DNA, 520 bp, Homo sapiens
cacagactcattttttgctttattttctcccaatattcatttgaagttcagctgcatgagtgttgtctgaaatgaaatgtcagaggctacacttggatgctattaaatgtttgtgttgtttcacaattcatattcaaaacttagaagatattcctgtagagttgcataaaaattgacacatttgcagaccatattttgacaaagccgtaccttatgtactccatgattgccagaattgcagttaaacttggtttggtttatatattggaaaaaattttaaaaatcatagttccttattatagaatcatatagatctgtttgattttccttattttcttctgctttaatctttctctattttacaaataacttcaaatatttttcaaattgtttagaattctctgaagtgaataaaaggtgtattgtgcaaattatgtgttcttaaaagatgtttagatatttcttaagagattaacactaatttctacttatatatttaaataaattttatttaaatatc

SEQ ID NO: 121452 - DNA, 384 bp, Homo sapiens
acgctacacagccataaaaaacaaatccatgcccttaccagaaacacggacagagccgtagtccattatgaacaaaaggcaagaacagaaaaccaaaattttcaaaacagctacaaaggtcaattgtgaatattctctccacagagaaatcataactctggagctcacagagatgctagacactgcaacttcattatgatgccacttttacatagatcaaattgtcccttacagcagctggttatacacacatactctacggcaatgaaattgctatcccattctggtaacattcattctcagtggagtgagatgatatctgagtgtggttttgacttctcgtgaggatcagtaatgttgattcagaatcttttacctgtgcat

SEQ ID NO: 121453 - DNA, 467 bp, Homo sapiens
atgaaatcccactggagtgcaatccagttgcaggaaggagcacataacgttatgctgagtgacacgtttcatttgtgtagtactctatgtggggggacattcatacatacattgatatgctatttcattgcatatcaactccatgaaacgggaattattctctgctattttaatgatgatgaaattaaggatgaatgtgattaaattagttgtgcaaaattaaagaagggactagatcttgaaatcaggtttcatggccccaggatcagtgctgtttcctccacagttatctcaaaatatccaactatagtgaactaaagaaggataatatttagaaatcaaagaaaaattaagtactctaaatatttgttaaagttgtctgagatttcagcatgagtagagattactttgtagaaacaagggtcataaaagcagaatctgtctataagaaattgaagcagcttatt

SEQ ID NO: 121454 - DNA, 932 bp, Homo sapiens
tgggagacctgcagagagtgtgggtgctagagccttctgcagggctcaggacacattccccgacacacccaggccaataatttgcactgggatacagagaggaggctcggggcctctgtcaacagattgccatccacttagatgagtaaatggtgctggccccgtggtgtggtgacatctgtctgtctgtctggtctagcatccagcacagtcctgggcacatgaattggtgctgatgctgctgaaggagtgaatgcaggccagaaggaaggagtgctggggaagaagtgagccatggagcaggcaggaaccacggacagaggcctcccagttcactcggggacatatccgcagatgtgagaactcagagagatgttcaagtttcctaagagggcttcaatcatggctcacagactactaatttccagtttcttctctaccagtctggatgcccatggtgaactttagagatatccatcagctccatcaattccctcaactacatctacctagcttttgagcccagaagaacccaatcatgtgtgttctcctcagctcccaggctgctgagcaatgctggagaaaaatcacaaaactatacagtttggtatctctccagaattatggtttccagcttgagttggaaattcagaattacttcaaaatgtttaaatttgtttctggtcagtttcctccttcatttcccagtttcatttatcactctatttaacttgttacccatcgctgtctgctattaaccttgcctccttttacacgagaaaacagaggccatcaaatggcatttcccatcactccatcactccacctctgtcaatgaatccaccagtaacatctcagagatccttctgtctagcactgatgatcttattgtatcagttactccttcttccttttgtattttcaatgctcct

SEQ ID NO: 121455 - DNA, 886 bp, Homo sapiens
tgggagacctgcagagagtgtgggtgctagagccttctgcagggctcaggacacattccccgacacacccaggccaataatttgcactgggatacagagaggaggctcggggcctctgtcaacagattgccatccacttagatgagtaaatggcatccagcacagtcctgggcacatgaattggtgctgatgctgctgaaggagtgaatgcaggccagaaggaaggagtgctggggaagaagtgagccatggagcaggcaggaaccacggacagaggcctcccagttcactcggggacatatccgcagatgtgagaactcagagagatgttcaagtttcctaagagggcttcaatcatggctcacagactactaatttccagtttcttctctaccagtctggatgcccatggtgaactttagagatatccatcagctccatcaattccctcaactacatctacctagcttttgagcccagaagaacccaatcatgtgtgttctcctcagctcccaggctgctgagcaatgctggagaaaaatcacaaaactatacagtttggtatctctccagaattatggtttccagcttgagttggaaattcagaattacttcaaaatgtttaaatttgtttctggtcagtttcctccttcatttcccagtttcatttatcactctatttaacttgttacccatcgctgtctgctattaaccttgcctccttttacacgagaaaacagaggccatcaaatggcatttcccatcactccatcactccacctctgtcaatgaatccaccagtaacatctcagagatccttctgtctagcactgatgatcttattgtatcagttactccttcttccttttgtattttcaatgctcct

SEQ ID NO: 121456 - DNA, 318 bp, Homo sapiens
acgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatcca

SEQ ID NO: 121457 - DNA, 408 bp, Homo sapiens
gtgaacagatggacaagattactagggcatgagcccactgcccaggggaacttagatgactccatgggaagttcagtatccccagggggaggaaaaagaagagagaagatgctcccagcagctccttttccacaagggatcagactcagggacctctcttttggaggcaaataagcatagatgctgttcctttgggcagctcctctatacacagctgaggtcaagtaattgtaaatattttgagattaattcacaaacaacgtcacagccaaatagcacttatcctacttattgaaaaaaaaaattgaggaacagggagacagtcaccgactagggtcacacaagtcaaaggtgtcagattagagtcacacgaggtctctctgcagccacagctgcctcttctccacc

SEQ ID NO: 121458 - DNA, 248 bp, Homo sapiens
aatgcacattaaaaaccgcagaggttaccagctgggccttgggcacagcagcatgcggtgaggagaaacaagagaggtgaaggaaagaaagattagcctgaagggtattagcatctggtcacacggaagggaaaaggtcgtacttgggtcaactatttatagacagaagaaacaaggtccagtctccagagccagggacctggtgatcagaggtcaggggtcactagaaagatctctgggaaaagtat

SEQ ID NO: 121459 - DNA, 241 bp, Homo sapiens
ccctgtcctaatgatgcctctggcagcacatgacagggatgtcacctgtagcccttttgagacacattcctcttggggtcctgggacccaacacttggtttcctccctgctctgactgttcgttactgtcacatctttggagtcctacagctccctgggcctcttctctccatcccagccctggccttccacgcctggcatgtctgggattggatccgtctcccccatggtgcaggcccac

SEQ ID NO: 121460 - DNA, 456 bp, Homo sapiens
aatatctcttaaataaaatttctcttgtctttgagctctgttttttaactttcctgtatttgataaagatcttctctaggttaccccaagtttggaaatgctggagctacctgtgactcatatatctgttttactgacgaaaccctggattttgtcctaaaaactgacttgttaatctttactcatcttttgatgatgttattgttatttgacttaattcattgttcgcttttcctctgggttttattaatacattcaggttcagttcaagacatttttttcatgcaattttgcctgatttatgcccttgctcttcctcttctctaaccttcaacaatggttgatttctaccaaaagacaccattaaattgttgcctgccttatgatgtttgatgttgtgtgcacacaatataatcttcctgctgaaataaaagctcctagagttcaaaaaaaaac

SEQ ID NO: 121461 - DNA, 631 bp, Homo sapiens
aaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcaaaaaagtca

SEQ ID NO: 121462 - DNA, 632 bp, Homo sapiens
aaatataaggaagatgagggtcagctaatacataagcacaagtcttcaactatgtaatttttttggcttcagacaaagggcttggattaccaaggttgaaacataaaatgagtttttctcagtatacaaatttcatagaccagtactagaaataagcatagattctagagtgccaccaagaccctttatttatctatataccactcatcccccacgtgttaggttaagatcccctcgaccgtgctagtcactctttctcagcctagttttgcatttattttctgcaatctgtcttcagcctcacctcctacctccttccttcactttgggctccatgatccagccatgccctacgaattacagttctctaaatactctaaattttgttttatcagataaggatccaacatctgtgcctgttcaaacttgaggacagagtttttatggtctccagctctgaagtacagatctgccaagcttcccaataggtccacgttatctcgcaataaggattttttctctagtgaacagatggtactgatggctcttgagttgtcaccagtgtgcacaaaagcatacgcttttgatccacacagagagccagtcaagttaggcctgtttggatcacattc

SEQ ID NO: 121463 - DNA, 824 bp, Homo sapiens
gggggaggtaaggagcagcgagagtaggagggcagggggcctgtttcctgggtcctgctcctggacatgaggcgagacgaagagagggatgctgttgccctgagacatccaggaagaggacccagggccacgtcaaagaagtcctgaggcccaagggcagccccaagctgtggggagcagctgaccttcaagaatctggcagaaagacaaagagaggctgggcacagtggctcatgcctccaatcccaacactctgggaggatgaggtaggccgctcacttgaggtcaggagttcaagactagcctgggcaacacagcaaaacctacagaaagtacaaaaattagctgagcatggtgttgtgcacctgtagtcccagctacttgggagggtaaggtgggagaattgcttgagtctgggaggtcaaggcttctgtgagcagagatctgccactgtactccagcctgccagcctgggtaacagagtgagatactgtctcaaaaaagaaaaaaagaaaaagaaaaaaaaacaacttttcgggccgccttgggccctaaaaacgcgactaaaaacagagggaggaggggagcggggccgcccaggagatgtgccaacatgggaacgacaagcgagcccacgaaggaaacaaaccacgaggcgacagagaaacaggacagcaggatactccagacagaataagaaaaacacgcccagggggtgagaccggagcggtttgcgcgaaaaacccgaaggggcaagcacagagggcacacaaggggaatatcaccagcacgcggcccaaggggcacggggattacaagagggc

SEQ ID NO: 121464 - DNA, 169 bp, Homo sapiens
agaaggaaaattcagatggaagtaaggttgaaattcttgatttttagagtgattaaatactgaaataaaatgccaagggagactgcatacttttacacctaaaataataacagattgctgagtcagcagtctcaggtaaccagcacagtgagtatagaaacaaggacca

SEQ ID NO: 121465 - DNA, 524 bp, Homo sapiens
atggaatgtctcaggtggtggcaagatgagatggtgaatccctgtaccattacccccccagacccaggacttatacgtaacagggaaagagtatttgtgattcagaagagatgtgtaggacaattgaagtacagtcaatttaaggttgttttgacctcagggcaggatttacagtaaacagtagataaactggaagtcttagaagccttcccagggctagggttaatcataagtcaacatgacagatgagcatccaagatggagttgctttggcctccacaagcatgttgtttccctaaactcggaaccttcttcagaacttgaagtggcagttttcctgaggtcattaacagtagtgccatggcctccaccacaggctctgtctattccagcactccctgaaatgtaaagctgatgtgtgggttaggaaaaatagtgttttccttgtgttctgctttttctgccctaggaaatttcagggctaaaggaatttgagagttaagcagtgggaatatgtttatctg

SEQ ID NO: 121466 - DNA, 213 bp, Homo sapiens
gaaactcagaagagaataaccgacatatatgtattcgctggatacgaaactggcggcaggcatgttgacgcacacatgtgatccagcacaaaataaatgcaaaatttgcaatcatgaaacatgattgatttagaagaggcatgtaggctggggaggagacacagttcagcctgaaacaaacgtcaaagaaatctaaaactgcattctatggtg

SEQ ID NO: 121467 - DNA, 431 bp, Homo sapiens
aatttggaagcttgccaaatgtgacctaaggttatcaattaaatacattgaaggaatagttaatattcttccaaaaaggaaacttcaggaacagagggttttacttggaattctgtcggtatttaaggaataaataggggccaggtatgatggctcatgcctataatcctgactctttgggaggctgaggtgggaggatcacttgaggccaagagttcaaaaccagcctgggcaacagagcaagacgtcgtttctatgaaaaatttttaagttaactggacgtggtgatatgcacccgcaatcctagctacttaggatcccttgagcccaggaggatctcttgagcccaggagttcaaggctgcagtgagctatgattgcaccactgcactccagcagtgttctgggtaacagagcaagaccctgtcttgg

SEQ ID NO: 121468 - DNA, 618 bp, Homo sapiens
aatccattccagctacattccagttcgcagctatattcaattccattccagcgtatttacattcaagatgtatctcttctaagtataatataattgggcagaattcatttttaatatggtttggtaacttttctttttaaattggatatttagtctattaatattgaatgtacttacagataaatttgggcttatatttaccaacttgtttgttttcctgttttacttaaccgtttcttcaacttgttttatgttactttttctcttcttcttgtctttaatgaattacatatattgttgttccgttttcccctctattagcttgttaattatatattattttactattcttttagttgttaccctccttgacagcatgcattcttgatttttttagagtagaaactaattcttttattactccccagacaatgttatgtccttagcatactttaactccatttaacccaccaccacctttttaattattattttcattgtacatacattttaaaccttatgagccctttttttgtttatatagcaaacattcatttatatttgttccatttccctcttcaatcactcttcatttattcctatgcttctgtgtttctg

SEQ ID NO: 121469 - DNA, 220 bp, Homo sapiens
gttggaatcgggttaggggagcccagtgagtccatagaggtgaggctcaggcacttggtttaatgggacgtggccggtgacagcgaggcggcaaggatgaggtggcagtggcctcagtgtctttgctgacctagtacccttggctcaagtgccatggctggacctctcaggatgatgtccaacccaaggattgcctgggtaagaacacctctctcataca

SEQ ID NO: 121470 - DNA, 960 bp, Homo sapiens
tgtctcatgactgagaaaattaaggagcatgggtgaaaatgaaaatggtgaggttggagtgaaagtgtaatgaacaaaaaatgaaagctctctgcaggggagcggggagccaagtggttttccgtttttacagttgaatcccaaaagtttgtataagaaactcctctcagttctgtagctgtttgcgtaacttttcttcatctgaaaagctgtctgctcaactccctcccccttgtctgtgtagctgtgggtatgactctaggcaagcacaaagcaccgcttctcttgtttgtaaaactgtgggtttgttttagggaagccccctcctccctgtgcaagttcccaccgagcccactgcatacatgtctgaaaagaaggggaaacttttccctgggagctggttaatcacacgaagaacaaaaggcttctgtgccggaccttgcgtgcttgtctgtgcaggtgcatcctgagttttccccaggctgctctatttttgcctgtagctgcgatttttcaggcaggctgcctctccgaggaccagccttaactgtttacctaactgatttttccttttcttctccctcattactttcaaacttcttatacagaaccagaagtctcaattttctttttaaagaggctaaaaattaagaacagggtgttttatatttactcacacttttcccattttggtgctctttattcctttgcataggtaaaaatgtcaggctgggcttggtggctcgcgtgtgtaatcccagcactttgggaggccgaggcgggctgatcacgaggtcaggagatcaagaccatcctggccaacatggtgaaacgctgtctctactaaaaatacaaaaaattagctgggcgtggtggcaggcgcctgtagtcctagcttctagggtggctgaggcaggagaatcgcttgaacctcagaggaagaggttgcagtgagctgag

SEQ ID NO: 121471 - DNA, 343 bp, Homo sapiens
tgtttacactctgcctccatcgcaggattatttgtttccttccttgcatcgctttgggtatttgatgctctattcgaatcattccttttccctccctcctcactctctccatttcagatgctcaacatggaattcctgtcagaagtctttttagagtgcttctccaaagctctgaggacttcctgaattataagagttcaccaggcccaagttgtagtgaagatgccagtctgtctgctatagcaggatttattttaaagcatctctgaagctttttgttttattctactcagagtcaagagaacccctcttggggacagtgaaatatacttaggcacgtttc

SEQ ID NO: 121472 - DNA, 511 bp, Homo sapiens
cagagaatcaaatgatgtggtctctagaaacttggtgtcaaagctgagcagttaaatttgtcagcagctaatatagccgaagactccccagcttccaacacagacagcaatgactctcctctaagcatcatccccagagcagactgagttctagtttatctttacactaaaggagaacaattggtggtcatttctcaggatctcctaataactgaataaagatgtaggttaatgcaacattttgtaaacagaattgtgttttcaatgaaaccttgtaaagggataacatacatcctttcttttttaaaaaaatttttattgataattaagttgtacatattttgggggtacatgtgatacaatgtgtaatgatcaaattaggataattgggatatccacctcaaatatttatcttttctttgtgttgggaacattataattcttctagctattttgaaatatacaataaattgttaactataatttccctactgtattatcaaatactaga

SEQ ID NO: 121473 - DNA, 470 bp, Homo sapiens
gaagcttcgttctgcgtctctctctgtgggtgacccacatatcacttgtacccatgccacttctggtaccagcaccgaacacgaaggattcctaggaaatctgagcgcttatttcccaccccgcctccccaactatcatggaaaggaacatgggactactgaatctgtttgctgtgttgtaacgacagtgaaggccgcgactttcttgtacttagggtgctgaagtaatgatctgagggatttgctcgtcatttgctgtggcagagatgatgttgacaccctgggatgctgtgggagggacaaaagactcacgtatatgttctgtcaaatcggagaagtaaataatccattgggatgccaggatactttattctacagcgaagttaattttgtatccgtcgaggctacagtagaggtaaaaatgacattgagttgtactttgctttgaattaaagttgatgggtagcagc

SEQ ID NO: 121474 - DNA, 416 bp, Homo sapiens
gaagcttcgttctgcgtctctctctgtgggtgacccacatatcacttgtacccatgccacttctggtaccagcaccgaacacgaaggattcctaggaaatctgagcgcttatttcccaccccgcctccccaactatcatggaaaggaacatgggactactgaatctgtttgctgtgttgtaacgacagtgaaggccgcgactttcttgtacttagggtgctgaagtaatgatctgagggatttgctcgtcatttgctgtggcagagatgatgttgacaccctgggatgctgtgggagggactgccaggatactttattctacagcgaagttaattttgtatccgtcgaggctacagtagaggtaaaaatgacattgagttgtactttgctttgaattaaagttgatgggtagcagc

SEQ ID NO: 121475 - DNA, 303 bp, Homo sapiens
ttatacagtaaggaactaacattttacttttggttttggttttgtgtgtgtgtttggtttgtttctttttgttgtggtcgtggtaagtggtggggggtagcatatttatacacgtacttaagtgtataaggacataggtagaggagacacccaattattcatgttgatcgcctcagagaagtgggatggaaaggtgggaagagcagggaaaataacttttcttcggaaaaagttaaaatgcctatagagatgtaaatatatactttctctttacaaatctttatataatttagccccccgcct

SEQ ID NO: 121476 - DNA, 369 bp, Homo sapiens
tggtggggtttttttttgttgttgttgttcttcaggtttttttaagattttacatcacagtgaacatggccagaaataatttaaaatgaagaaattaaacaaaataatacctgttagaaggaagacactaaatgaaagaccatgttgtagtcatgtttctacaaatagaagttatacaaaaaagtagtcaatacattagaattgaggaaaaaaatggtcttctgagctagctggtttacaaaaatgattgtgacattacagttttatctaatcacactgtagaatttagacctcatcaagctctgcacagtcgattcccaatgtgcctacaaatgactatactgtcatttattgcccattttgctataa

SEQ ID NO: 121477 - DNA, 433 bp, Homo sapiens
tgataagggaccaaccctgctctcctggcgctcacaccaggggcaagtcaacaaatacacaagaaagaaaatgaatgaatgagtgaagaagaaaaccaggaagagtgaacaaggtgccctccaaacacctcagagatgcaaatcctacagagaaacatcttcagggggtgactggggagggatagttcctactaaggtccctggaaaggcctcccagaggaagtggcgttgaggtgaaggtgagatgaagccagtaacaggatggtctgcggggagagcaggcctgagagagcagcaggcaatgctgaggccactacagggctggcttcagggaatgagaatagaggcaaggtggcagggcctcagcagagtgagaccagggagagtgggaggtgatggggccttgtccgccacagatttaactccgtacttc

SEQ ID NO: 121478 - DNA, 915 bp, Homo sapiens
agagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtggcagaggagagggaagggtcgcgcctggtgggggcctgagagccaccgggctgcggtgcgcgagtgtggacaccgccccgccttctgcgtctacagccctgggttctgggacctttggaaaccgctttggacgaagctgagcatctctttccccacgctgacctcccccatagactccggatgggagtaaatgaggctcctgggaaatccagaaacttcactctagagaagcttgtttgccaaaccttgctttgggcggtggagacagaatatcatgtcccagatcagcgtgtggtgactgtggaggcatttacacacagcacactccagctctgccactgggccggctgaggtggctgcggtacacggcgcccatcctgagccccaggttcctcacatgtcaacagcatgaaaagtgcctctaagacatccacaggtgtgcagtgttaaagcaggcagcgcctcagcttggttagctcccttaaggactgcggctcccttaggacaaggctctgtccctcagagcactgagtgcgatctcatgctggcatcttagagacattgtattcaccaggtaagatg

SEQ ID NO: 121479 - DNA, 858 bp, Homo sapiens
aaaccaagaatgaggtaggcctctgtcttctaagcaacatcagaactctaagaacatgagggactcttagaaaactctctggagctaaccacagctgggtcactgctcatgtactgaagaccagccagagggttcccctgaaaaggagggaaactgagcaaacattctccagttctcttagtgtgcacatgtttcaggaggtgtgaaccccacatgtagcttgtgtaggcaagaagacaaatagtgctactgtctggtcaaggatttgtttgaagagccatgattatgcccatatggtaagccaccagtgctccccatccctgtaagacacttctttctcattattttctcctctgatggtgtgccaggatgctggccaagagaagccaagtggaaagaaggctgttcagtgacaaggaacctaagacttagtgccaaggactgaaaccaagtaaacttgtaattttccatgatggaaacatctacactttctcattagtggcctctacagcagttgccccaaagaagcgtctcattgtttttttactacatttatgtgaagcatacaggcaaactcagaaagactgtgataaggctcgccagagatgcctgcacaggtgctgggggaaaagcaggaccatcctgaagggagatggtgtctgtggacaaagaactctgcagtggttcttatttgcatgatttctgctggtggaggctgtaaatgtgagctcaaactcccacataagtgagttttcattgtaatccagaatgtttttaaatcaccctacttctattgaacttgcactatcatctgttaacctctactgtatttattaaataaacctgaataggtaaatc

SEQ ID NO: 121480 - DNA, 1056 bp, Homo sapiens
aaaccaagaatgaggtaggcctctgtcttctaagcaacatcagaactctaagaacatgagggactcttagaaaactctctggagctaaccacagctgggtcactgctcatgtactgaagaccagccagagggttcccctgaaaaggagggaaactgagcaaacattctccagttctcttagtgtgcacatgtttcaggaggtgtgaaccccacatgtagcttgtgtaggcaagaagacaaatagtgctactgtctggtcaaggatttgtttgaagagccatgattatgcccatatggtaagccaccagtgctccccatccctgtaagacacttctttctcattattttctcctctgatggtgtgccaggatgctggccaagagaagccaagtggaaagaaggctgttcagtgacaaggaacctaagacttagtgccaaggactgaaaccaagtaaacttgtaattttccatgatggaaacatctacactttctcattagtggcctctacagcagttgccccaaagaagcgtctcattgtttttttactacatttatgtgaagcatacaggcaaactcagaaagactgtgataaggctcgccagagatgcctgcacaggtgctgggggaaaagcaggaccatcctgaagggagatggtgtctgtggacaaagaactctgcagtggttcttatttgcatgatttctgctggtggaggctgtaaatgtgagctcaaactcccacataagtgagttttcattgtaatccagaatgtttttaaatcaccctacttctattgaacttgcactatcatctgttaacctctactgtatttattaaataaacctgaataggtaaatcacagtacagcaaaaggttctgtgttccccagaattctaatcaaactccaaattcctgaaaaggctctagtcctttcctatatgtcaaatttaaatgataagttttcattttggaacataaagagggattttgaagaccacagcatagccctgggtttttgcatagagataataaacagacaatctcttttcagactga

SEQ ID NO: 121481 - DNA, 300 bp, Homo sapiens
taaaacccacccccatgattaaggtacctcccactgggtccctccatgacatgtaaggattaaggaagctacaattccagatgtgatttgagtggggacacagccaaaccatatcacacactctgagttttgtttttccccctcattatacttgatagggaataacgttcacaatatatgtgaaaactattttttttttttttgagacagagttttgctcttcttgcccaagctggagtgcagtggcacaatctcagctcactgcaacttctgcctcctgggttcaagtgattctcctgg

SEQ ID NO: 121482 - DNA, 102 bp, Homo sapiens
gctaactgaaataagccagtgacaaaaagacaaacagtatataagtccaattacatgaggtgtctaaatagtcatattcatacaaatagaaagtaaaacggt

SEQ ID NO: 121483 - DNA, 243 bp, Homo sapiens
tcctctgctgccacagcggactgcctgcagactgagaagtcctcctcagttgctgtgctggcctcagcggcccccctcctcctgctgcccctcctggctgagtcctcctgcctcctatgcaggccaagctcagttgccagctttctcatgtcccagggtttcacccctaccccttaagccttttttctaaatggccacatggtctgtccctgtgagccagtggaaccaaatctaaccagtggc

SEQ ID NO: 121484 - DNA, 557 bp, Homo sapiens
gagacaaagcatgagtaactgaatccaccaccaggaccttttgcttgtaactatctggtcttcctctctccattcttgttctcctccagtttattccctgcatagcagccagttggatcacatcaactttgctaattaaagtccttcagtgtcaaggcacctgcatgatcaggttcctgtctgcctcttgcttctcacattgaaactattctcaggcacactggtttcctccataggacgaagcttttgtctttctttcttttttttttttgagatggagtctctgtcacccaggctggagtgcagtggtggagtcttggctcactgcaacctccgcctcccaggttcaagcaattcttgcgccttagcctcccgagtagctgggattacaggcatgtgccaccacgcctggctaattttttgtatttttagtaggcacagggtttcactatgttggccaggctggtctcgaactcctgatctcaagtgatccacccgcttcggccttccaaagtgctgggattacaggcgtgagccaccgtgcccggctgaatcaa

SEQ ID NO: 121485 - DNA, 404 bp, Homo sapiens
gaggccaaattagttttcacttttacgctgaattgctaacatcaaatgtgcccttcctgccccacccaaaagggcagaggaagtgacaaccccaggggccctccttctcccctgtgtccagggaagagcatccccacttccagtcactccagcagggaagtataaggaaagggcagaagaagtgaggggtggacatcagaccacagggactagctctcagggcgtgtggggactaggtgagtgggagaagcggatcacgctgactccactagatccagtaggagtagccaaagctggagttattatctacatgaatatggggaacgagttacccatttgttgtcccctacttgaggagggaatcaaccctgaagtctgggcattggaaggaacaaactcaagct

SEQ ID NO: 121486 - DNA, 158 bp, Homo sapiens
cagacagtgaatgaggacccactgatttaaaggcaacactgcagccccttcttgcctcattgaagtcccaagttttattacagtaaaagcacttaatgttgacatttctgaaagaatgaagaggccgggcgcggtggctcacgcctgtaatcccagca

SEQ ID NO: 121487 - DNA, 335 bp, Homo sapiens
acatatagctatgtttcatagtatcaaggaagtctttgactttaggcaagaatttagacactataaaaaaatttcaatattctgaaaacaaaagtctactctggattgatgaattattgcactaatcacataataaagattaaaactaaaattcacagagcacctattgccagggactatataagttacttatatgtactttctatgatttatatttccagcaaccatgagatattttatatccatgcttattaagagaagcaacatgtccagagctcacatggtgaaaatacttgtatttgatacagctggaatttaattccagatgtaattcc

SEQ ID NO: 121488 - DNA, 303 bp, Homo sapiens
agccatgggccattgtacgtggcagatgatgatacgagaggaatcagaggcacagcccaattttctgggggatacaccagaggctgactgttctatctcctgagcacagaggccagtggagagcaggtgtgtggaggaggggctggcaagagtcatgagtgtgcttttggatatgacataaaatgaaaccttgaatgcggagtgcttcacccaatgcctggtgagcaaagagggctgttattgctctgttttgttttgctttttgagacagagtctcgctctgtcacccaggctggagtgcag

SEQ ID NO: 121489 - DNA, 334 bp, Homo sapiens
ttacactgttggagttgacaggtggagggggttgtacctttggtaaagtgaatgtaaggctttagataggtacaacctattgaggaggtccagccttgacacttggtggtatagattacatctccctaagtatcacagaactaccagttataggatcggcctcagtccatgcaaaagtcagttctgtaggcagttttatttatcctggaagggcaaaggtacttttctgaagaggccagctgtctttggctttggagatccccacagggcataacaagacaagcattaaaagtaatggtttgaggggagctagatctggttatattaataataa

SEQ ID NO: 121490 - DNA, 380 bp, Homo sapiens
gccggaagggaaaaactgggcctggaaaggccgttgtgaggaatgagccccatgggcctgaagaggccactggcaggcgggagctgggcctgccaaagcggccgagaggcaggagctttggacttgggaggccgcagtgaggcgagagctagctgggcgtggagagtccgctgtgaggctgaggctgggcctgtgcaggccttcgggaggcaggaggccgggaaggccgccgggaggcatgagctgggctgggccgaaagaggccgctgggaggcaggaggagctgggcctggagaggctgactcgaggaacttttgcacctggagcggccgccgagaggccggagctgggcctggggaggccgacttgaggacgacttg

SEQ ID NO: 121491 - DNA, 246 bp, Homo sapiens
acagattgtagtacatcgttatgacttttaagtgctaagcaaattattgtccagagtggcaggcagacagtaaaaatcataattattgtaagctctgggccatacttgtaagtatagtaataaatctgcacttataagtcataacgatgtactacaatctgtagcttgtaagatttgatacataaaagattctgttccctcctctctctgtctcaacacacacacacacacacacacacacacaca

SEQ ID NO: 121492 - DNA, 347 bp, Homo sapiens
cttaccgtggggattctgaagggcagtgtcttatgagagaagagagatcaagttacttggtgagtgagatgttctaggtgctcagtccaagggctggccggatggctagcactgaacttgtgtggatgtttgttcaaactaatcagcctacgattggtttgttcctaagaatgataaaactttgttctagttttttaaattgtaataataattctgtaagcatttaagaagaatgctttctttaatgttgacttttttttttttttgagacagagtcttgctctgtctcccgggctggagtgcagtggcatgatctcggctcactgcaacctctgcctccgggttga

SEQ ID NO: 121493 - DNA, 273 bp, Homo sapiens
tcccttgttatataataactacccagataagatgctcaattttgtttcttggcccacaaagcctaaagtattttattctctagactgttaaagaaaaaattgcagacccctggcttaactgatgctgctgatgtggggatgactttgagaaccacgtaagccatttgctaagctaagtgtagtaaaccctccttccactgatttaatacaattccacgggcccaactgtcctggactatcacacaatgccgagagagaggcaccacccctcaa

SEQ ID NO: 121494 - DNA, 92 bp, Homo sapiens
ccacctccctcctggattcttgcacctctcaaaacttcaaaaactgacagcttcaaaaaattgtttagaaaaattgttcgaagaagaaaatg

SEQ ID NO: 121495 - DNA, 694 bp, Homo sapiens
tgtggtggcaggtgcctgtaatcccagcaacttgggaggctgaggcaggagaatcgcttgaaccctgaaggcagaggctgcagtgagccgagatgtgccactgcactccagcctgggcgacagagtgagactctgtctcaaagtaagtaaataaataaataaataaataaataaataaatgggtggaatacagacatttttagatgtgtaactcactaaaaatttcccttccaagcttccctatcttaggaagttactttaggaaatagtctaacaaaatgaggagtaaaccaagaaagcagaagaaacagtagagtggacaccagtgaggaagaaagtaccagctgaccatggtgcagtgtgtccagtgagtcagatgagaggtcagaaggctccaagagaaatttaaggggataacaatagactacctgacatatttgagcccttgcagcaagatatacataattcagggataattggggatttgtgttagtaataagcccatagaagactaatcaaagagaaaaaatacaattatcgactacagagaaagcagaatgtgcttgaaaagaaaataaatcatgatacacttgatggctgagttgtgaatagcatttacatagtcaaaatgatgtaatcaccctttttaaacttaaaacaccttttaattgaagtataataaacatactgaacc

SEQ ID NO: 121496 - DNA, 302 bp, Homo sapiens
aaaataacttatctgctgtctaaccacggagctcaggcatctaagaaaagcctaaataattcacgaaaactgtgcccaaatagacaaaaggagctcactgcttcttgcagaatatttaaacctgactcaactttggggttttaatccaaatatcttaagttcacatttcattgctggaacattccatgttgtatcaggagctgacttaggtgggtgaagttcttaaccctgaacagagaataaaatgttaaaaatagtaatgagagtgccgatacctccatagacaaccctaaaatgtgtaa

SEQ ID NO: 121497 - DNA, 602 bp, Homo sapiens
aggggagagaatcacttgaacctgtaaggtcaaggctgcagtgagtcataatcacgccactgcactccagcctggataacagagttagacctgtctcaaaaaaaaagaggaagagatctctggttagagtttgtctctgatggatactaaccatgcaagtagtttacacaaaccacattctttctgtagaatgagaaaatcttggatataatttagcataatgagctaaataactctagactgagcttcgctgcccagacaggactctacttgtgatctgggaagatctacccttgcactgaattctctcctcttctctcctgactctgtgagaaaagtttgcatgaatttactgagattagttatagaaggaactgtgtgtcattgaaagtcttgtacagaagttcacattaaaatatatcatagtcatctttgggaatgattctgcaaaattcataaaacaaagatctctgaaaccctaaggcacactgtgctggaggctaagggaataatagtgagctgagtggtttctgcctacacagagcttctaatatattgaggaaagagatctcaatcaaattccaattgcaaatttattaagt

SEQ ID NO: 121498 - DNA, 321 bp, Homo sapiens
actggtgtgtgcgtgggcgtgtgttgtttgcatgcgggtaggatgcctgcctcttcggattgctgtgcaggggcccgaacacagcaggcatttgtgagcattatgctgagtgtgttgtgctgggtgtgttgtgtagtgttgcatcgttccactggaggggcacaaagcgctggagtgggcatcaattccaactccaggcattcccccattagcatcttgggggaatcaaaccaagaatccaccaatccttaaggggcaagttcctatcgatctgctctacggagcattaagacctcaatgaccccagaccttgctgccatc

SEQ ID NO: 121499 - DNA, 389 bp, Homo sapiens
ggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagtcttgcgccggaggggtggggtggggggtgtgggaggagggacggctcagccgtcccctcccaagcaaggccagccacagcacagcgccacagtgtcacagacaccaaaataggagattagtgcgg

SEQ ID NO: 121500 - DNA, 152 bp, Homo sapiens
atggcaaaggcagtagatgggtatcttttaggtaggtgttgaaagtcatcttaaggaatttgagcttcctcctaagggcagatgaaggttttcaggcagggagattggcatcatcagattatcattctggagggaccactctgtggtatgga

SEQ ID NO: 121501 - DNA, 726 bp, Homo sapiens
cacagactgaatttcagctccctgtcttggccagggcacatcctgtctaatcactcatgttcacccagctttgcaccctcttcagcctccccacgtttaagcgaggcagctggcggtgcaggaagaatattcatccatctcctaggagctcaggagtcagaccctgggcccagactcctgcagcaagtcggggcttctgtcacaagcgcctcaccttactggctttggcgccatctagtggacgcatctgggtctgcggggaccgcagcccttcctgtgacccagaagcaaaaccagcaatttacctggccgtacattatttttgagtcccgaatcccaagagtccactcccaacccagctcagcatgtattgtccactgcctgcttagtgccggaccaacacaccttcacctcacatcaacagggactcaaacagagcctcttcccctcaaatcccagccccatactcaactgtgtgcacaaaagcaggcattcgtcctaacaaagcagaatgaaacaacccaaacttccctcaagatggggagcatgcattctacggaatattatgaaatggataaaagggtttgctggattggaaacgtctccaaaagcacattaaagaacaatacataccgcatgatgccgtttattggaagaaacaaacccaagcctgatccactgttcgcatatccgtgtgaaatgcagagggagggctggacacacacc

SEQ ID NO: 121502 - DNA, 494 bp, Homo sapiens
actaggtaaatacatgaatttaataatgattttggtgctccaagattcttagaagaagcagtgagaaatatttcatttatttgaactgctcatttgtaatagtattatttggaagtggtatagagctccaatggttaaacaatgtactttggagtccaacagacatggtttcataacctgtttgtccatttgctggataactttggttaaatcacagaacccctctaagaagttaatatttacccaaatagagatgatgtaagaattaaatgatagtgtacgtaaaacacataatagagattgtcacataataaacagtagccatcaccatcactataatcaccattatcaccaagaaggtcttgttacaccaagtgtaacaagttcatgttacatcaagtgtgagagtgtgtataactttactaacaaggcagaaattacaatatcctcgtcttgttgttgtttttttttcccaagacagtcctggctctgtc

SEQ ID NO: 121503 - DNA, 329 bp, Homo sapiens
cagagccaacccttatccccaggacctttcacattgctcttgtgaactttctactgtcagcacctgcatctcaaatgctgatttgcccatggacagcagttcattctagggaattaatatgcttgcttttccagcagccctcatctaataactctctagaggtgacatataaataccccagctccctcaccctcagatgagataattctgaagctgtgttttgcactagttctgaaagcttccccagggaattcagctccaagcacccactctggcagctgatttattagatgcttttccttctttgtctctcttccccacttccctac

SEQ ID NO: 121504 - DNA, 745 bp, Homo sapiens
tctacatatgttcatgcttacaattttgaacacttgtttaaattttgatttctcatcaacacttttactttatagtaagttctggtaattttgttctctccttaacattccctgcaaatcctctcctgctagaaacaacagattaaaaccagactggcagttgggaaatggtttctattgcaaccatgtgtgtcagaagaaaggattaggtttccttgtccaagaacatcaaggggaacctccacctctgcagacacacctctattccttagtaatggagagtttatacctagttagatttaaatgggataagggaagagtttaaatccattcttagctcaagcagtataatcagccctcaagtctcaaagtatccaattttctttctctaatttaattctaagtgtcaggttggtattagatgctgatcaaggtaatggagagttgccctacacatttattcacttaaagaagaattttgcagactgcaaagactagatggcaattgtattcaaaacttacttaaagcacaattcattcacccctgacctttcatttatattgagtatgttttttcaaatatagaagagattccataataaaagcaaacaaacctctctcttcataattatggactatagttctctgtacatgttctctgaccatgccatcttatgctggacctattataaggacccaaattaaagtgaggcagatcctgcttttgagtgagataacctccaag

SEQ ID NO: 121505 - DNA, 339 bp, Homo sapiens
atctatactattgcagccccaggatgctgatgaactggaagaattactcagcagctatgctttcatatgtgattatgttgctgaaggtcaataaaacattgagattcccaatgatatttcccatttttttctacatctcccttatagctaaggtgagctgtaaagcacttcaatcttatttaaagcttcataaaaattcttcagtagacatttaatgacattgtcttagtttgggttttgtcaaaagcaaagcctgagacaaagtcttgggtacagatgatctgctggggaggtggttccagaaagaggggtgagggagccaggagagtgagagaagag

SEQ ID NO: 121506 - DNA, 896 bp, Homo sapiens
taatcataatagtttgctaacatgtatttgtaacatgttaactttcctaaacacattcatgtgttttatttatttcctcaaagacacctatgacattggtagtaaaactatccctgttttacaatcatgaaatggatgcacagattgagtaacttgtccagagtctaacagccaagatttgaacttaggtgatcttcagatgtgggtgattcatgtaccaatatgtcagtcttgaataagaacttatattgtatatgcatgtttacaacaattttgtcccaaggtgtatttgaagatatatgttatttgggagaaaatgaaatagtgccttaagattctgggctttgttcttgagcttttaaataacagtctagtaattctgttttcagtaatggttaatgtgcttgtttcagaccattctccatttagaacaaatagaaaatctggaagtggggagggatatcaatttgaaagtattgagatctacaagatagcaagaatttgtggggccaatattccagggagaaggtaacccagaaaaggagcaacttttcccattcaggcatttgctgaattaaaagtctcatctgggaagctgaaaagctgagtggagtttttggaaaactcaaagagctgtgaaattcatattttgctaaggaggaggagctctggaaaatagctcaagcttttattgggacctcaaagggtttcactgtaggaataagagtgaatctgagaagtgatttctcacagtgactgaagccaagcttctgatcatgcaagcactagaaagaagtaatctgttcccagcctgtgcctctgctagctgcaaaagtgaatccactctggatgaaagtaacattaactgtagcctcagattttctctacaagttttt

SEQ ID NO: 121507 - DNA, 573 bp, Homo sapiens
gttaattagttatcctaatgagcttaattaacttaatagtcccactgcaggcggtgctaccaggcagccagggtggagagcctgtgctgtgaagtccttactcacaggttctggggccactgtatgtgccctgggggtagccctaggtgttggtcttgaactgcttgcatcaggctcatgtgcgagggaatagcagccatctgggcgatggctacccatgtttgcagatggcagtctcttaacacagtgtaaccttgaggatggccaggagggaagtgaatagaagccttgtctgagagtgctttaatctgttactaacattaataatctgttaataattaataatctggactaacactcagggagtgtcagtgaatgttatgagttccaagaacaagcccatgcctgcatggaaggaatcccctgtttcaggaaagcagtgcccttggctggactgcagactccacgtgcagtacagaccagagacatgggtgtggtgatcctgccttttaagatggggctcattaactagtgtatgcacgtgtaggcttatgccattggttggcataaatg

SEQ ID NO: 121508 - DNA, 656 bp, Homo sapiens
taagacatcaattaaaaatgtttaatatataaatttattgcagttataattcctgtgagaaccaatagtgaaaaataaatggatgacattatcaaaacattttcattgggaataaggatgaactcagcaaacttggaaaactgaacacactgcaacaatgatcaaaatcttatggccttgggttattacagtcggaaaaaagagtttatcttacaacacacaggagaaatggtatgtatctacaaccttgtttatttcagcattgtttataataagatatatttcaaatacaaatattctttagtaaaggactgataaatcatgatataggcataaaatgaaatcttatgaaagcttttaaaaagactgagaaagctctttgtacttttatgagattatcttcaatctatgtcatgtgcattttttaacacaaaacaattacctaatagtatgctacaatttctactaaaagggaggaaatgatacaaacttgtatagatacatatatagatatgtttgtataagcataaactaagcataagccaccaggcatggtggcttgcacctttaatcccagctatttgggaagtctaagggggaggataatttgaacccaagagtttgagacctgccagggcaacttagaccctgtctct

SEQ ID NO: 121509 - DNA, 378 bp, Homo sapiens
tgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgt

SEQ ID NO: 121510 - DNA, 297 bp, Homo sapiens
acaaataaagtcacatagtatgtactatagaggaaggctgatacaatcctttcttgttatacataaatatctaaaaatgtggttccaatttctttttttttttctaaaccatgctcattttctttcaaattacttccaaaaacgaaggtctctctgatgttaatcgtgtgtatacttcagcttacactttaaagagtcttcctctcccgggaagtgacttttgtatataaatcatggaaagctacttagacaaagtgctggagatgattaaaaagagccagattcaaatttatacct

SEQ ID NO: 121511 - DNA, 598 bp, Homo sapiens
tcccacttttaacagtagacaaatgatttagaaacatgagacttaaactacaccatggacatttacagaacatgaacagccgcagaatacacattcttttcaactgtgcatggaatattctccagtaaagatcgtatgttagagatggtatcaagtattttaccagatcacaactatataaagctagaaatcaacaacaagaaaaacgttagaaaccaacaaatacatggaagttaatatgcaccttaataaccaatgggtcagtgaagaaattaaaagggtaattagaaagttccctgggacaaaggagcgtggaaacacatacaaaaacctgtgggacacagtgaaacctgttctagaagttcatggcaataaatgcctgcatcagaaatgaggaaagatttctaataaacagattaactgtgcaactcagagaaacctgaaaagcaagaacaaattaaacccaaaattggtaggatggaaataataaagcttagagcagaagtaaacaaatagagactaaaagagcaattcaaaagatcagtgaaatttttttgagaagataaacagaatcaacaaacctttagctagactaaga

SEQ ID NO: 121512 - DNA, 102 bp, Homo sapiens
taagtatagcatcttcccccttttctaaaaatctaggctaaataaaataatgtaatgtgctagtatagccacaatggaaaattaagacagccttaatagttg

SEQ ID NO: 121513 - DNA, 359 bp, Homo sapiens
gaaaaatggaagcatcaaagttttaaacttatgctatcattaaaataacaacaacattcattgtctgaaacaaaaattaactgtgaagtgagaatttgagaagtctcagccagaacacagtgctgaccttcatctgcgttttgtagccaccacgtccaatccatcacctgctggttgtagcggcagagagaaggatgcaacccctgtcctgctgttgttttatggctgatgattcatgaagacagaaaaaatgccctcattttggcagctttcatttgatcattctttcccaccttccccagcctctgggagatgtgtttattgccagcttcactgcagaggagacaaataagtaaccc

SEQ ID NO: 121514 - DNA, 514 bp, Homo sapiens
cttctctgaccaccttacattcctttctcacagcactctccggtccttgctcttctccttagtggtcttcacttactacactatgtacttaattatctctcccacaagaaaataagctccatcaagcctcttttgttcactgctatattcacagcgcctgcaacaatgcactgcacatatcagatgcccagtaaatatgttagaacaacaatggttagaaaacctaaaacctgtggcaagtaataactagaaaactatagagactaggtaagtttatgtacattaaatttgtatctactgggattatacagtaacaacccaaacatgagtcaatcagttaatgctctccctctttcagaaatacaattcctatttcctatttattgggaatgaagtaaaatgtctggattttagcaacaatagatagctcccttccttactactatgtaatgagcaatgtgcctttgctaacttatgcaactcttaaggttttgattcaaagctaaaatcctat

SEQ ID NO: 121515 - DNA, 396 bp, Homo sapiens
tagagaaatttttggtgaaagaagagccaatcagcacgcaagttttgttgtctcaagaaattgccacagccatcccctccttcagcaatcaccactctgatcgaacaacatggaaccaagaccctccaccatcaaaaatactgtgtttcattgaaggcttgggtgattgttagcattttttagcaatacaatatttttaaattaagttaggtacattggttttttagacataatgatattgcactcaatagattacagtataagcataacttttatatgcctggggatattaaaaaattgtgtgacccggtttattatgctacttgctttattgcaatggaatggaatggaacctgcaatatatccaaggagtgcctgtagttggaatcataaaga

SEQ ID NO: 121516 - DNA, 234 bp, Homo sapiens
catcgcctaggtacgtgcacatacatggtctcatttggttcccttgaccaccatgtgaagaagttgggtgtcatgtttataaagatgaaaaaacagggtcagaaaggttaaggattctcaaagccctatgaccagtaatgagagagtttggttcaaacactaagtgtatggctcctggtctggaacttctttatttatttatttttattttttgagacagagtctcggtctgtc

SEQ ID NO: 121517 - DNA, 651 bp, Homo sapiens
ggatggctaaggattctaggttggaaataatttgccttcataattctgaaggccttgctgcattgttttctagcttgtcatccttttgagaagtctgaagacattctgattcttgattgtaaaaatgttttgctcaatgttttgttttctggcttttgtgtttcctatattcctgaaattttcataaggttgtagcttggtgttacgtctatttataacaatttttcttggatatttgtgtaccttctgaatctgtaaaattcattagttctgggacattttctttaattattttattgacagatgtattagtctttgaggactgtcataacaataccacagtctgctctctgtttgtctgttattggtgtataagaatgcttgtgatttttgcccattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaaatg

SEQ ID NO: 121518 - DNA, 184 bp, Homo sapiens
aaatttttcagcagtacaacctgctgagctcaagctccatgtaactttgtatttccctgttcataattaactaattatgctctaatcaatagtgtagatcctgattttacaatgtaaatcagataaatgagataattgctgggtgtcaatctcattttatttacaaagcccagcatgtgcatcc

SEQ ID NO: 121519 - DNA, 200 bp, Homo sapiens
atagacgatccccgtacatgtagtgaggacaggttcatgaggctcttcatcaatttcacattaggttatgacactgtagatgacagcatgtgacataaacattctgccacagatttcatcacattaataatagtatccccagtgtgttcaagtagtcaataaagcagcccaaaagggctttttgaatttacacgtgaaca

SEQ ID NO: 121520 - DNA, 690 bp, Homo sapiens
tgtggtggcctgtagtcctagtactttgggaggccaaggcgggcaaactgcttgagctcaggagtttaaaatcagcctgggcaacacagggagacctcgtctctacaaaaagacaaaaattagtagtggcccatgccagcagccccgactacttgggaagctgaggtgagagaatcacttgagcctgggggattgaggctgcagtgggccatgatcagaccactgcactccaacctggctgacagggcaaaatcctgtctcaaaaagatatatacaaataaaactttaaaaataaatttacaaatgtccaaaacaaccatactacacagaactaggtttctacactgtcgaggaatctaatattacagatttctttctggattggtgaaggagggttggtatttccccactgaagtagacagtgtggtgtgtattgggtattattcaagccaaataaaaggaaatgcagtgggatttttaacgtttttaaaaatgttaataatgtctcactattttgcccgggcttgtctcaaactcctgggctcaagcaatcctccccacctcagcctcccaaagtgctgggatgacaggtgtgagccactgcacctggcctaaaatttttacatttaccccacaaatagttaattctaatcagcaccttaagaatattgactaaatactacatccaaa

SEQ ID NO: 121521 - DNA, 468 bp, Homo sapiens
acttaaaaaagtctcaagaggctacaaagatcttttaaatacgttaaaagctctaaacgattagaactgcctaagataatgtttctcttcctgaaacctgctttgctttaaactcaaaacattccttcagtccttgagcattaccttattgattctgaaaagggaggaagtcttcatgagtaggagtgtgcttctttatcattattatatactatgtccactacctcgaaatggagtggttcattttatttgtatggtttggtagctagcgaccctggttctatactggaatcgcctagagatactttgaaaaacacatatgcttgagccttgcccttagaaattctgatttagtgaatacaaagtataactcagccaactgagaacatacgacgtgcggtcggggttgagaactatttatgaggatagcgaaactagtgttttaggccctgtaaaatttactttaaa

SEQ ID NO: 121522 - DNA, 457 bp, Homo sapiens
cacttagaatattgctgaaaaaattagtcgcaagccaacttgtgcattaggaacaagcacaatcaaaaatagagacttctcacagaacggaagcctcgctgggctttgtagaactgaattaataatgactttacctttatagttggtttttctggactcatgtccacattagtatccttcaaaagtctgaactcctaattttaaaatgagtgattaaattccagtatcctgttcatactcagaaaaagaatttatattctttcaaataatctgcaccatttctaaaacggggctgagcagagaattctctatagggatgacagtccgcacgccacacttaccttcaataactgttcataaatgtgagcaagtggtaaatatgaaatgtgtgtgtcactggcactcaagggaagtgctttctgtaaaacacaacaacttagcagaacatacacaaaca

SEQ ID NO: 121523 - DNA, 216 bp, Homo sapiens
ctggcagtgcagtgggttgtttacaccaccatcaccacaaacacgcaagtaatgaattgttctaggatgttatgatggctacaacagcactaggtgataagaatttatcagctccactataatcttgtgagaccaccattgtatatgtgcaatccattgaccaaagcctcattatgcagtgcagagtaccatatcctagcatgaatgcatagttag

SEQ ID NO: 121524 - DNA, 173 bp, Homo sapiens
cctcagcctcctgagtagctgggactacagaaatgcataggaatatgctggtgcctgaatgtaccatccggggacctggagattgactcacctgcctccagagctggtgctcacacttactactgagaggcctgaggaaacgcctgcctacccaccaccagaacctgtatagg

SEQ ID NO: 121525 - DNA, 456 bp, Homo sapiens
agatagaatgtgatcacagcagcacccatctttccctacatccaagaaactgctcaacagacacactgcttaagagctggccccacaaccttacttttgtgactaccaaattgtatcagcagatgttctcagctaattttacatcagcaggtcacctctgtgtgacaatagacaccggcaaaaggtatggtaggtaatttgttactaatcacattttaaaatcccaacctggagccaatttggtgtttaatataaaagtgcacctaatgccacaactccctttattgttgcatgtggagaaagagaagggggtagggggtgaattggagaaggagatccaaaggcagaatctgatcagaaaatccagagctcagatccctgagtgcttcctggctcccatcctaggacagggaagaggtgtgggcatcactagccaaagcccctactgggtagata

SEQ ID NO: 121526 - DNA, 231 bp, Homo sapiens
aacttgactgtggttggcggcaactgtgcggacttgatgccaggccagccagcactgagttgagactgtgtaagtgtgctgagctcgtatttttcctagtcttctggttttgaaggttgggcaccatctacctgtgtaatagatgattaaaaacaggtgaaaaataattcgaacccaacttcatgttagtatttcccatcctgttccagtactgcctgaataaagttgcct

SEQ ID NO: 121527 - DNA, 483 bp, Homo sapiens
ttttcatcagaggcacaggtgcagtgctgggctcatagggggaaagtctacatggaacatcagtattcctgcagatgaaaagagatgcctttctgatttgaacagctggaacagcagggcacatcactagggaatgagagaagcttcatgagacctctgccattccagccccacaggagacagtgaacctgctcacaaatccagcacatcactactatcatcagcatctgagaaagccatcacacaaagattctctacaactaaggaactcatacagagtcttcacactgaaaatgctgagtcaaagctagctaagaaaccataaagtcacatccccaacgagtaaaaaaaaactaaaaaaaaaaaaaactcagttgaattagaaataaataagttccttctcactggggtagacaaaatagtctaccccaataagaagaaaccagaaaaataattctggcaatatgaaaaaaacgggattat

SEQ ID NO: 121528 - DNA, 654 bp, Homo sapiens
tgaaccactacacccggcctattagaattttcaacagcatgtaagatcaagttttctagaaagagttataaacttagtatttcttatctgtcagatatttgaagtaatctatgtagtagtcagccaaattatttctctgccaacaaaaggttaccccattttccctaagcaataatgtctaccgtctgttactatcattatggtacagctaatttgggatgctatcaatcagccaggttattagcaaccaggtcagtttggttttcttatattttctactttgtctatctagattataatggctttaaatcaggatttttatttcttggtcagtgaatcaaatattgggttattggctttatgctactttaggaccaaaaatatctataccactgatactataaaataatattcttggccaggcacggtggctcatgcctgtaatcccagcactttgggaggccaaggcgggcggatcacgaggtccaggtatcgagacaatcctggccaacatggtgaaaccccgtctctactaaaaatacaaaaattagccaggcatggtggcatgcacctgtctcagcctccccagcagctgggactgcaggcacacgcctgcatgcctggctaattttttgcatttttagtggagattga

SEQ ID NO: 121529 - DNA, 399 bp, Homo sapiens
accgcagctctctctgagtgttagcctctctcctgaatgacgtggttgcacggacagagggtctcctcacttctcagacggggcggccgggcagagacgctcctcacctcccagacggggtctcggacgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccggccggagacgctcctcactttccaagactgggcagccaggcagagggggatcctcacatcccagacgatggggcggccaggcagagacaactcctcacttcccagacggggtgg

SEQ ID NO: 121530 - DNA, 279 bp, Homo sapiens
caggaaagactacagaagtagcgaaaggcaaaatgatgctgtttaagtaacaatgtttaaaatcagaaaaaatgtaaaaaatctagcacaactaggcctggtgtggtggctcacacttgtaatcctagcgctttgggaaggcgagtcgggcagatcacctgaggtcaaaagttagagacctgcctggccaacatggtgaaactaaaaataccaaatactaaatactaaaatactaaatattaaatactaaaaataccaaaaaaaaaatcaagcccaact

SEQ ID NO: 121531 - DNA, 168 bp, Homo sapiens
ttaggagctcctggatctgatctctgggttctgatggtccgagtggaagaaactgagcccctggagggtttgccagcacaatccatccattctttcactctcccattcaacgaacacacattcatgtagccagctctgtgccacacgctgtgtagacctgctgcgaat

SEQ ID NO: 121532 - DNA, 409 bp, Homo sapiens
aaaagatcttttagctcggggtggtagtacatgactgtagtcctagctactcagggggctgcaatgggaggatcacctgagccctggaagtggaggttgcagtgaaccataattgcgcaaccacactccagcctgggctacagagcgaaaccttcctcatcttaaaaaaataaaaacggccaggcgtggtggctcatgcttgtaatcccagcactttgggaggccgaggtgggcgggtcatttgaggtcatgagttcaagaccactctggccaacgtggcgaaaccccatctctactaaaaatacaaaaattagctggacgtagtggcatgtgtgctcgtgtgtgtgctgtgtgtgcgtgtgtgctgtgcgtttgtgtgtgctgtgcgtttgtgtgtgtgctgtgtgtg

SEQ ID NO: 121533 - DNA, 460 bp, Homo sapiens
acacggaggggaacatcacacaccagggcctgtcggggagtgcggggttaggggagggacagcattaggagaaatacctaatgtagatgatgggctgatgggtgcagcaaaccaccatggcacgtgtaacaaacctgcacgttctgcacatgtaccccagaacttaaagtataataaaaaataataataaccaaatcctgcccccaatccaaggccacaaataatttaattaaagcctataaaataggacacacagaaaagtcactctgtttccttgactccacaacttgtatgtgtggcttataatgcatttactttattatcactctcgataaactctgggggagaaagccggggataacacacctaatcctttcatgaaatgtctaacatggcctcgagtgtgtgggatcttttctcaagcccccatgtctgagtgccatttgctgatggcccttcc

SEQ ID NO: 121534 - DNA, 450 bp, Homo sapiens
ggcattccaaaaacattttcctattgtcaggtgtcatcacctgaagccctcttcaagcatagaacattctaacatcaattaggaaagacttcatgtatttcctggaaatgacaacagggaagttagaaatttttgaatgttcctttaacttattcttctaaatattctaataagtcaactttaaaggacaggttttaaagaaagggcttttctttctttccaggaaaggagagtactggctatctggaccttgtgaaaagatttttagtacactacttagcttcttgatttcatgaagaattcattttggtttctaatatactgatatggtttggatctgtgtccccacacaaatctcatgttcaactgtaatccccaacgttggaggtggggcctggtgggaggcgactggattatgggggtgtatccttcatgaatggtttagcacga

SEQ ID NO: 121535 - DNA, 289 bp, Homo sapiens
ctcctgcctcagcctcccaagtagttggaatcgcaggcatgcaccaccactcccagctaattttgtaattttagtagaaacagggtttcattatgttggtcaggctggtctcgaactcctgacctcaggtgatccacctgcctcagcctcccaaagtgcttggattacaggtgtgagccaccacgcccggcctgtgtgtgtgtattatttgattgtgctattgcactccagcctgggtgataccccatagagagatactctgccaggctggagtgcagtagctcagttt

SEQ ID NO: 121536 - DNA, 558 bp, Homo sapiens
aaatctgagttctgccatcctagcctcctttctctgggaatttttaatgaattgtgtcctaatgggtccctgtatagcactgtagcagctttctcaggaccgataggtaggactttggagaccaccctggtccattctcacattcctgaggtgcaggaaggtcttgcccagtttgtgcatgaacttgacaggcaaataaaccatctaatctggtgaaaagcaaaaagcaatatggagagacctttgggggacagcatgttgacttccaactataaaaagattaagtacagttagaatacttttcccatccaaagtaaccttcaaatttattacttactggccagctttacaaatgtattcacacagattaacacgttgtgaacatgctctgttaatattgggatctgaaaaaaaaaaaaggagcaagctccaaacaatgttgagggggggaaagcaaagtgaagcagggtaacattgtctctgctcagcaaaaagtggtaggggacattatctaagataaataaagtaacatggaatacaactttgagaccatacact

SEQ ID NO: 121537 - DNA, 323 bp, Homo sapiens
ttcttgaaacttatgtgcttagtcatatctgcttctgtcttcattcctgattgtctcttagtcattgtttaggtcttggcttaaatgtaaattcctcacataggcattccttaactgtcttcattagattaggctctctgctgtatttttccttaggaccctacacttaactcatcacattttaaatcatttattcattcatctattcagtagatatttaccaagtgcacgcaatttgtctgacactgtttgaagtgctgttgatatagtagtgaacaaaagagactgaacatatttttatgccctcaaggagcttacactat

SEQ ID NO: 121538 - DNA, 325 bp, Homo sapiens
ggttcttgctttttgtgttctaagaaaatttgcttaaacaggaccaagtgcggtggctcacgcctgtaatcccagcactttgggaggccgaggcgggcgaatcacaggaggtcggcagtttgagaccagcctgaccaacatggtgaaaccccatctctactaaaaatacaaaattagccgggcatggtggtgcttgcctgtaatcccagctgctcgggaggctgaggcaggagaattgcttgaacctgggaggcagaggttggggtgagccgagattgtgccgttgcactccagcctgggcaacaagagtgaaactctgtctcag

SEQ ID NO: 121539 - DNA, 339 bp, Homo sapiens
acaagtttttattactgcagttgtaaaacaaagactgatggctattttttatgtatcatcacagttaactattttcagaatcttgagaggtttaatctcctttctaagtcttttattccatttagtgacaactgttttttgacaatgtaatatatactctagtataatttaaaaatatctacaagttgtcaagttgaatggctgagagatttgtttaaagaaatgtgggcaacattcttgtggttggaaaaagtaagggaaaaatgaaagtattgcttaaaagctgttttcaaagcttgcattatgaaagggattatatgtgagatttagagtcttttt

SEQ ID NO: 121540 - DNA, 317 bp, Homo sapiens
atttccaccatttcacccaccaaaaaaagtccccataaacagtcctcattcccccaccaccccccacaccacccagctcttggcaaccactaacctactttgtttctgcggatttgcttattctggacagttcatataaatggaatcatacaatatgtggtcttttgtgactggtttacttcaattaccacaatgttttcaaagttaatctatgcttagcatatcaggacttcattcttttttatggccaaataatatccactgtatgaatatgctacattttgtgtatccattcatcagctgagagacatttgggt

SEQ ID NO: 121541 - DNA, 716 bp, Homo sapiens
cctgtaaaaagtgtggtcattcctgctaggagttctacccttgaatcaggcattaactgctcttttttaacctcaattctgttagtactataatggtgaaatattgagtaataatcatctgtcataagtgtgtgtgtgtgtgcgcatactaattacttgaagctttttttttttcttaaagctatatgttgctcaccactatttgatctcaggcttaacagttgaggtttagggttacaaaaatgggatctatctatacctgattaagcagaatcaatattaattgaaggatttaaggtggcttaaagaatcgatgaggagtttggagaatccaagctggacctgaaccacagaagacaaaaacttgagatagaatactgtatgttagaatctcttttgttgacaccgctgttgctgggctctcttcagcttacctttggagtctattgcccatacttgctccacagcactgggctctcatctctgtggaattcactggaagacaggtcgtgcacctttgcgtctcattcttaacactaaaaatcttcggagtatctgtttgggtgggctgaaatcgcccctttaaagggttggggagagagtgttagttcccctttggcatcagcagtggaaagtgcctgccatccatcttggattctctctgaatatgaagagtgcttagatgctgggaagacaaaatgaaatgaggctattgc

SEQ ID NO: 121542 - DNA, 718 bp, Homo sapiens
aatggcggagggaggtaccctgctgaggggaaggggggatccctgacacctgggcttccccgggagtcggctgtggagtcgagttgagctccctttccgggtctggggaactcaacctcaccttatgcctggggtctccggggaactagtgggctttctgcaacggggggaaggaggggacgactcccgcccctagtttacccctcaaaagttaatgcctttgtcggaggaagcaatttcagtccactctccttttcagtccctgttggccgcttaaactaaaaggctacagacgggcttaaatgcgtctccgctgtgtttcttatgcctcgggccggcagggtaacgggttctagtcacagcttgtagagttcaggatgggtgacattcaggtcctattgtttttgagtcaaggtttcggctatagcttcttgaattatgaagctgtcataataaagaattcctgattatctaaagctgttattcttccctacttccaaggcagaatttgaatatattttggtggatgaaacgaaaacaaggagagtcttgtgactatgagatactagctggttgatgtatcatgaaaaacttagtggtccctatgtgggaaggtaaatggaaaactgcaaaaagagcaagaatgaattacaaagtgaaattagaagaaatatctggcttacttgtggatgctttgtacaccaatacaatatattat

SEQ ID NO: 121543 - DNA, 137 bp, Homo sapiens
ttggcatgagccactgcgcttagcaatgtattctttaatgattttgaaaacaataatgacaatgctttggacatgtaatgtcaagcgcacttttcattatctagtttgaatttttatttctgaagatatttttgctg

SEQ ID NO: 121544 - DNA, 270 bp, Homo sapiens
ggaaatgacctttttcccctcctctgggagccacatctcatcctgcctcactgggctgctttcactatcagagggtcattcatactccgaacagctaggaggtggctctggagaaaaactgcctgagttcactccccagcccagccgcctcagggtatgtgagttgtcttctctgtacctgttttacagctggggaaagtagtaattgtacccacgtcagtagttaatgcctgcaaagagtttagaacagcttggtgggtgcagtggctc

SEQ ID NO: 121545 - DNA, 282 bp, Homo sapiens
cctgtcacccagatactgagcatagtgctggtatatttcccagtcaaagatggtcctgtttaaatattgttgatttgggaagagtaaggttaaatttcaaaaagagaagttcttgcctatttggaaatacatactgaaaacatttaagatgaaatgaaatggtctcagagatttgttcacaaataatctggaaagaatagtggggtagggttatagaggaaaaaagattggccttgttttgataatttttaaagctgagttatgggtacatgggagtttatt

SEQ ID NO: 121546 - DNA, 515 bp, Homo sapiens
acaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagc

SEQ ID NO: 121547 - DNA, 613 bp, Homo sapiens
aggacagtctcgattcgggcctgagccgtggaagccgttggccttcgcacaggaaagaggagcccgagatcagtctctctgcgcctccctgcttccccccttgaatggagctgcgttcaggagctgcctacagtgcccagcgcatggcaggtttagtgttgcctgacttcagatatggcctattgttggggctggatgtttgggcctcgtggcttgaccaccaatggctgaagcaaacgctagctctgctgagctctgggccagcccagcttgtccttgccgcctgcagtgggccccaaaggtggggggccgccttcgggagcctgtgtgagctcgggttatgcccttccccacatggggcttccctccccagcaccgccctcactctaactcagctggtccttgctgccaggtcttccacaggagcatatgccctcaggctgtgcacaggccccccagcaccccgtcctgcctccctggcctgtgtgagtgattgcgctgaaggccactgggagaagccagggcaggacgcaggctgcacagatgacggggatcacactggccttccttgaaggacacgatgcccgatgctggtggggggagggcagagcca

SEQ ID NO: 121548 - DNA, 238 bp, Homo sapiens
atatgtaacatacccattaatattttatactaaatacatattgaaataatgttgagttaaataattattcaaattaatttcacctgttccttgcctgctttactggaactattagaacatttaaaattacatatgtggcctacattatttttccattgatcagagctgagctagattgtaaatacttagttacattaccatgggcacacctgcacccacagtcacatgacgatgagct

SEQ ID NO: 121549 - DNA, 396 bp, Homo sapiens
gacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagat

SEQ ID NO: 121550 - DNA, 326 bp, Homo sapiens
cttttcgcaggggatcactggattgactctaggagaaagagaagctatgcatgccgcaaacacctgcacaccaccattcatcctgcccaggctgctgctgagtggagctcaggcttgcaagtttgtggatcagtgtgccccacaaagcgtgcttatctctgcctcaccccctagggggagtggggataggggtagtggaaagtaggtagccagcccctactttctgctgttcccactccaaaatgtacatatttgtcaaaaccttccagattccttctgagtggaggatgtggcagtatcaccttctgtctaccctgagtgcctca

SEQ ID NO: 121551 - DNA, 786 bp, Homo sapiens
cacagtggctcacgcctgtaatcccagcactttgggaggccaaggtcggaggatcacgtgagcctaggagttcaagaccagtctgggcaacatggcaaaaccccatctctacaaaaaataaaaaaaattagccgggcatggtagcatgcgcctgtagttccagctacttgggaaactgaggcaggagaatcacttgagcccaggaggttgagggtgcagtgagccatgattgtgccactgaactctgacagaatgacaccatgtctcaaaaacaaagaaacaaaaaaacactcaacaaactaggaatagaggaaactatctcaacataatagaagttatatattaacaacccacagcagacgtcacattcaatggtaaaataccaaatgctcttcctctaagatccaggaacattacaaggatgcctaactttgccacttatattcaacatagtactggaagtcctaaacggagcaattaggcaagaaaaagaaataaaaggcatccaaattggaaaggaagaggtaaaattatctctgtagctgatgatgtgatcttattttaaatgctgtgatcctaaggataccaccaaaaagtctgttaaaaccaataagcaaattcagcaaagtagcaaggtacaaagtcaatatgcaaaagtcagttgcatttttaaacatgaacaatgaacgatctgaaaaggaaattaagaaaacaatttcatttacaatagcaccaaaaagaataaaatactggggccgggtgaggtggctcatgcctgtaatccca

SEQ ID NO: 121552 - DNA, 312 bp, Homo sapiens
tgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttc

SEQ ID NO: 121553 - DNA, 220 bp, Homo sapiens
cttcagtcaggcttcgatgcagagtctgaacccggtctggacgaggagctgtagtcttctccagggctgtagaatgtccagtctctgtagtgggttctggaatgatggcaagtcccaggtctggaggctgagttgaggtctcctccgtggttggagatggtttaacctctgtagtaggttttgtagttatggtaagctccaggtccagaggttgaacggt

SEQ ID NO: 121554 - DNA, 348 bp, Homo sapiens
aattctgagccttgcagtgtgcctttgctattaaagtgaggatattgactaggaatgaatgggatcctgaaaattggaatggtgacatatgggaagatcctgttgaagctggtaatattgaatctctaaattctgatgagtcttcattgccagtagaagcagagttaactgatttacccaaactgattatacctaattgacattaactgctttccctgaggaaactgatgtcttcctctgagataattgccttgcaggacactgctgattgtcctcaggacccaccctgaccacccctctttggttctaaacctataactagattcaagtcccagcaggccccaaagg

SEQ ID NO: 121555 - DNA, 293 bp, Homo sapiens
tgatctgatgaaaatgtcaaatcagtataaaatatcaaataatgattaccctcaatttaaatattgtgatcataagcttctgaaatttactaagatataatgtatttatttatggagtaactaggatttgcatggcccaaatacaggatactgttagagagaacagcacttagttcccctagaggatcttgacttgtatggtatttttacatatgattctttagtatatggcacattaggtagataaaatatgttctttgccctaagctaactccggtatagtaggggaggca

SEQ ID NO: 121556 - DNA, 503 bp, Homo sapiens
gataaaggtctagtaggtgaataggtgtgtttactataggtgaattggtgtatattttattttgtccctgttcctaaaacattgtatctcatttctgaggagaaattccaacgagttttttaaaaaataaagtggtgtactttggctcgacaaatatttttaaaactaagcaattttataatgggttgtatagttatctttcaattaaataattgtaatcttactttgcaatagagtgaccagtaggtaaagcattatagttttaaaattagcatagcaaatatatagtattaagttttctttactttagctctttgcagaatctgtaaaagttgtttccgttggttgaatggaattgtggaaactttagaagtatatttcattttgataaatatgtgttagaaagagattctacaagcgtttgggggttgagttaaagaattatacaattttgaaaatcagtttgtccctgcttaatttgtaaaaagtggtgctgtatgtga

SEQ ID NO: 121557 - DNA, 685 bp, Homo sapiens
aactgaaaaaaattctgcacacattgggcttcctttccagtttataacatcataatacagttccatgttacatattatatgtttctcattcagctgttgctgtggaataactagagaaactgggcatgtggttaaacttcttttccaagcatctcctcttgttgattgcaaaaacatttctttttagcttaatcctttattcatgtattactgctaaacattttagagctgagtaaaccaagactcttttttaatcctttattttaaaatggcagcattagaatatttgaaattttcttaaatgaatataaaagtcgctcttcttttataaagacaattttaaagaatacttgacctgaggagtgcttactgttactacactaataagtctggattttacttgaaaatacagtgaattggtttagaaggctggaaacaaactgaagaacacatctaattcgtctgttctaagaaggactcactcattttaggaaaagatggtccattatgattttattttttctaagactctaattagagcctattctacttcttaataatactattccagtttcaaattgcccatgtttaaccatgtgctcttaataaaatttatgctttttattcttcctacttaggaaataatacagtctgttaacataaaacatgtttccataaacgaaat

SEQ ID NO: 121558 - DNA, 218 bp, Homo sapiens
tgacgatcactaatggacatcactaatggacatcagctgccaacagatacacggcttgcatcagtctttctgtgacaggcacatagctttccccctctacatctactgacaatcacattctgccctagtactcctttcttcatgtttgtgaaaagatactgtctccttaaacactccatctcatttggacttggaaaaagaagccaggaaagggtaat

SEQ ID NO: 121559 - DNA, 347 bp, Homo sapiens
gtcggtttgactctaaggatcccgggccagggatggatttggaatatgtatttccaaatataatcaatctgacatggtgatgaattggatgagaggtaaaaacaagaaggtgtcaagtatgactccagatttctggcttaagcgagtaggatagtgggctcttttgctgagactaaatgaggtaaaaatggactagaagaaaagcctagttggaagcaacagtcacgagttcagccttgaacatgtgtgagagacatttaagtggagatgtcaaactatatatgactaagaagctcagaagaaaggtttaggcaggagggataaatttctgagttactggcccataa

SEQ ID NO: 121560 - DNA, 547 bp, Homo sapiens
ggaatgcaatggtgcaatcttggctcactgcaacccccgcctccccagttcaagtgattctcctgcctcagcctcccaagtagttgagattacaggcacccgccacctcacctggctaatttttttttttgtatttttagtagagacggggtttcaccatgttggtcaggctggtcttgaactcctgatctcaggtaatccaccctcctcagcctcctaaagtgctgggattacaggtgtgagccactgcacctggcctaaaacaaaatatacttaatttagaaaaataaacaagagaaaataataagtagacatcttcttttccttttatattgctaatgtgtgcattctacataaactgcaatttttttttttttagtcagtaattctcatctcaaacttttagtgttccagtgtttgtttaaaatgcagatcccagggccctacaccatacttattaaaattggttctggtggtttctggaataagccctggaataactccctaggtgatcctgatgtaggtggggttcaaatctcttgcctta

SEQ ID NO: 121561 - DNA, 396 bp, Homo sapiens
cagctcttgtatccacagttaatccaggaaaaagagaaaaaagcaaatagatgaaggagcagtatggctgattttgtccttttaaaggtttttccagaatctcaaatcagcaatttgtgcttacaactcaaaagccaaaactgagtcatatgatttcccgctttcttgtaagagagtatgaaatgatgagtgtttcgacttctttgcctctgcaagcagagaaaattaataatagtccatccccttggctatccagcatccatgacatcaataaaggtgacatgcatacatacattttaggtggcatgcattaattctttcccaaaaagaacccacctcaaagctgtgattgcatctggtgactcggttatctccaacaggcccatggctcctcct

SEQ ID NO: 121562 - DNA, 286 bp, Homo sapiens
cttgcattgctgggaaacattgatgtgtggggactcactcctctccgtgtgctcttttgtcagatgacttccatagatctatgcactgagattcgtagaaagctgttggtggtggctctgctgggcgtgaggccgtcggtcacagcgaaggagcttgcctggccctgggaggcccaaggatagcagggccagcagagggcatgggccgttcttctggggtttgcatttggggccccagacttgggtttgccaatctagaaactgttgcactaagagtgacaccacg

SEQ ID NO: 121563 - DNA, 131 bp, Homo sapiens
taaattcaacaggtgtcatttctccttaaaaccaaatgatttcagtatgccaaaacacttgtcattggaggatgcagtagggggactctaaaagtctatcctttcttgttaatatgaagacagataaacga

SEQ ID NO: 121564 - DNA, 281 bp, Homo sapiens
tatccatatccccatgtgaaaagctgaggggcagagctgacagtcacaaactcaccccagtcaaaagtatggacaacacaatgattaaattccaccagaggcaaataaaaatcccaacttaccagaaagctatccctacaccaaattgaatccttttactttcactcccacaaagaaggtaatctgaaataaaagtcgggtaactgggtatggtatttaaaatgagtcgaagaaactacactgaagctactatagaggcgctgaaaaaggtaacccaaaag

SEQ ID NO: 121565 - DNA, 398 bp, Homo sapiens
ccaaatctctaatgggcagatttctctaaacacatgtagtcttgggagacacgtgtttccttttgaccatttacgtgtggtgcccaccatgcattctcaacggggatgagcaaaattggtactaggaaggggacgaaaaccttcgctattacaaaggtttttaccctccaaagtttagcttagcacaacccaataaaatcttattccttagtgttcaagttctcttgttagaaagaaactaaatttaaattcatttagtttttctctttaggcaggcggtaacaaaaaatgctggtaaaacactagtgtgcaccaccaacaatgcatgtcttcctcacattctcagggacacgtgcaagacacaagagcatgaggagtgtcttaaatatatccaaaag

SEQ ID NO: 121566 - DNA, 335 bp, Homo sapiens
actttggtcacaatcatttaactagtgtctaatatgtttcaaactttccctcatcttcctgttttcttctgagctctccaaactcttccaacctctctctgctcattacccagatccaaagtcacttccacatctgcaggtatctttatagcaatagtaataccccactcccagtaccaattttctatgttagtccattcgtgttgtcattaagaaatatctgagtctgggtaatttataaagaaaagaggtttaattggctcagcattctgcaggctatacaaacacggtgctagcatctgcttctagtgagggcctcaggaagcttccaatca

SEQ ID NO: 121567 - DNA, 191 bp, Homo sapiens
catcctggggttctaccgataaaatgtgacaatagcttcttgtagacacctaccacgtgtcaggtgtttttgacagatttcatcctctcaacaagtctatttatcacaccatcacactggccaggaaattggattaccagaagggtcaaggaagctaacaaagtcacactgcctagtgtcagtcacaagcg

SEQ ID NO: 121568 - DNA, 260 bp, Homo sapiens
atcacttgctgatggattggagggtgggatgaggaagagagaagaatcaaaggatgacctcttggttttggggttgagcagctggtaatgcaacaattgggaaggttgggggaggagcaggtttatagtagaaaatcagtagttccattttggcactcatatctgcaggcttaggaatcaaactatctggtccaattccagtctctgccactttgtatctgggcggccttctctgggcctcagttcttgtctgcaaaaca

SEQ ID NO: 121569 - DNA, 358 bp, Homo sapiens
agagagtccagcggcagcaggctggacaggagagctgccttatgtacagaaagagtccagtggcagtgggctggacaagatacctgccttcgtacagcccagtggcggtgggctgggcaggaaaactgcaattatctgcaaacatcacgcagtttatatagcattttcacttaacactctcccactaatgaccttgatacggtttaaatctgtgtccccctccaaatctcatgttgaagtgtaatccccagtgctggaagtggggcctgctgggaggtgcttggatcatgggggtggtttctcatgaatggtttagcaccatccgcatcgtgttgttcttatgatagtgttctcacaa

SEQ ID NO: 121570 - DNA, 351 bp, Homo sapiens
gctgggattatagatgtgagccaccacactgggccaaaagacagctttttttaaaaaaatagagaagctacaggctgggaaaaatatttgccagtcttttttttttcccgcttgttgatccatcactaagagttataagtaatatacaaagtcttacaactcaagaacatacccaattaaaaatgggtaaccagcagctttgtacatgttaaaaaaataaaaacaaaaagattgacttagattatgtcaccaaagactgacataagaatggccaataaacacatgaagaggtttgacatcactagttaacagaaaaacatgagttagaatagtttacaggaacataccaaa

SEQ ID NO: 121571 - DNA, 183 bp, Homo sapiens
ccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaa

SEQ ID NO: 121572 - DNA, 428 bp, Homo sapiens
ttccttgctgtgtgaccacttataagtcacttaacttccctgagtctcagtttccttaggtataaaataggactagtaatgctttgctcaaatatcatcatctccgtgaggcctcctccctggtgtcactccctacccccttcctgctttattttcctccctagttcttaccaccatcttttatcccatgcattaggcttaccttttctgatgattttctgttcctatctccacccacagggatgttaattctcatggaaccgggatctgtccgttttgctcactactgtatccctggcacttagacccagcaacaatacaaagtgcatgctcagaaattttggggaaaaatttatgagatactattgaattgtatccaccccagaggagtgtcaatgtatgcaaagtaggcagtgtggtgcttggta

SEQ ID NO: 121573 - DNA, 393 bp, Homo sapiens
agctatagttaaaatacactaatttacatctcactcctttgaaaagaggcgtataaagcatgatccctgtctcaaagggcttagagtctaactggagaagactaataatactcatgaaactactcatctcaattgaaggcattataataaagtgctaaaatgtgtggcccctacttgtgataaggttcaaactagcaaatgcaggaagactagtagaatttaaatcactatttatgctttgggaggctgaggtggtaggatcacctgagaccaggagctcaagaccagcctggacaacatagcaataccttatctctacaaaaatgtttttaaaaattagtggagtatgttggcacatgcctgcagtctcagctactcaagaggctgaggcgg

SEQ ID NO: 121574 - DNA, 243 bp, Homo sapiens
gcaactaaatgatgtatgttctactctagtgtacaactataaagacctggacagaattgcctacataaaattgttctacaaaaaagattattgctcttgtacatcctatttttatataccttcaaatcttttatgtcatttgactataaatggtcaagttggtttggtttgtcatcatgaagctataactatcagttgttgatatcctccaaaaaataaattgaggaaatatataggtaactt

SEQ ID NO: 121575 - DNA, 815 bp, Homo sapiens
accgtgtgagctccgcctcccgtcagagcattaccgtgtgagctccgcctcccgccagagcattaccgtgtgagctccgcctcccgacagagcattaccgtgtgagctccgcctcccgtcacagcattaccgtgtgagctccgcctcccgacagagcattaccgtgtgagctccgcctcccgtcagagcattaccgtgtgagctccgcctcctgtccaagcattactgtgtgagctccgccccctgtcatatcattactgggcgagctccgcctcctgccagatcagtggtggcattagattctcataggagtggaaccctgttgtgaactgcacatgcgaaggatctaggttatgcgccgcttatgaaaatctaatgctgatgatctgagatggaaccgtttcatctccaaaccatccccaccatccccacacttgtccgtggaaaaagtgtcttccatgaaaccagtccctggtgccaacaaggttagggaccaccagtttaaataaccaaatactaaaagaactggcatagaagtaaatgggctgctgctttatttttaggctgttctttttagagaacaatgacaattatttccaagtttgtcattagaaagtaatattaggttggtgcaaaagtaattgcagtttttgccattactttcaatggtaaaagccacgattacttttgcaccaacttaatatgataaatttgttccttaaagtgtatttttggtaagaaaaaccttttgtttttccttatattaattttttgttttttttcttggtagagacagagtcttgccatgctgccca

SEQ ID NO: 121576 - DNA, 279 bp, Homo sapiens
aggatctccatcagcagtggtacaatcatagctcactgcagccttgagctcctgggctcaagtgattctcctgcctcggcctccctgagtagctgggaagacaggtgcaccaccatgcctagctttttttttttaactttttattttttgtagagatgggatcttattatgttgcccaggctgacttaattgtttctttggttgaattgttccttcctgaaggtaggaggatacctctctgcctaaaggtaaggtccagcagaggaaaaaaggcaaact

SEQ ID NO: 121577 - DNA, 710 bp, Homo sapiens
cggcccccaaacacaggtggcttttgggcccaggtgggtcagcctgctgcccctggcccataccctctcaggccattgggacccctgcccttcagatgttctagggtctaggagtggaccagtcaccctgggaagaggccagggccttggcaggaggggtggcccaggcaggacccagtcctgagtcctggagcaaggccagggaggcgcccaccccaccccggccagctgccctctctgctgtttgttctatttgttcttcttttcacccatagccttgtgttcctgtcatccctcctttcagcaaaagtccttttcccattccctctgtccccaccaactgctgttccccaagaaaataagctatcattgtatttgcaatctatggattagaggttgaagtatttattattattggttaattattattaattatataaaatatatatattagaacttggctagccaattttattgaacaatttctgttcaataaaatgttgtttaaagtacagtttagaaaactatggtaggtttatttcttgaactttcagaaattcaagcttaaagcatcacacgtttttctaatattgtgtggcattttctgtcattttacttttttaacctttatatggaataacaaccatcagccttgtctttcagatgtgccatttgggggtgctaaagctggtgttaagatcaatcccaag

SEQ ID NO: 121578 - DNA, 428 bp, Homo sapiens
ctacttgccttacattagatatttatatttcatgttccttttcatgattgaggataatttggggtaagccttaggattatttgctgtaaattggaatgatccagaataaggcatgccttctgtgtgagaattcaacagtaagacaacaaattttttttttgtgctgctctttctagtgctatttccttagtttatttaaatcgaagctaggtggcttttgaaatggttttggggtacaggcttctcacagtaacattttaaaagtctgcccagtgtatcctatcttttcaacctgtttctcaatgctttgcatacctttggctatgtctgtatttaggtatttaatgtcccagtttcctggaactccctcttctcctttttcgggcaaatggctgtatgcctaccaagaggctatggttcatcttttc

SEQ ID NO: 121579 - DNA, 675 bp, Homo sapiens
tgcagtggctcacgcctgtaatcccagcactttgggaggccaaagcaggtagatcacctgaggtcagaagttcaagaccagcctaggcaacacagtgaaaccctgtctctactaaaaatacaaaaagacccagaaaaattaaccaggtgtggtggtgcacgcctgtggtaccagctactccagaggctgaggcaggagaattgctgagcctggaggcagaagttgcagtgagccaagatcacatcactgcaatccagcctaggcaacagagccagaccctgtcaaataaataaataaataaataaacaaacaaagtactagaactcaggattctcatttctgagatcaaaggggttgaccagatgatctctggggtcccttccaggttgaacactctctgattgcataaagtttaaattggttctgaagctcgtaacagtacaattttaagtttctattttaggaaaaaagagtgacaccagctgggcacggtggctcacgcctgtaatcccagcactttgggaggctgaggtgtgtggatcatgaggtcaggcgttcgagaccagcctggccaacatagtgaaaccccgtctgtactaaaaatacaaaaaaattatctgggcctggtggtgggtgcctataatcccagctactcaggaggctgaggcaggagaa

SEQ ID NO: 121580 - DNA, 927 bp, Homo sapiens
atttgactgaacctgggatataactgtgcgactcttgtcaccggagatatggggagatgttgttgtcaatggatcctctttatgaagacacaccagagagatgcctattgggcatcagcaccaaaaaaaggccatgatcctcctgagcaaccagttcatgtttgtcttacggattccaggaatcatttaattaacactattttccaggtttgtagtagctgctgcaaagctcaagatcaaagccatggtgcatctttatcacctacaaagaattttgtggtgtgtgtgttacatattgacttggttctgcattattttttgtctttttctcttcaccctctgatatggtttaggtctgtgtccctacccaaatctcatgtcaaattataattctcaatgttggaggaggggcctggtgggaggtgattggatcatgggggcagacatcccccttgctgttctctcaataatgagtttttatgagatctggtcgtttgaaagtgtgtagcacctcctcctttgctctctttttcctgctggccatgtgaagatgtgcctgcttccccttcgccttccgccatgattgtaagttttctgaggcctctccagaagcagaagcctgtatagcccacagaactatgagtcaattaaacctcttttctttataaattacccagtctcaagtatgtctttatatcagtgtgagaatgtatgaatacaccctcctttccttaactttttctataataaagctttttaattgagataattcacatatcataatattcgcccttttaaagtgtacaatccagtggtttttagtgtatttacaagattgtgtgaccatcactactaattccagaccatttccatcaccccaaaaataaactccacacccattagcagtcacttctcactctctcttcc

SEQ ID NO: 121581 - DNA, 995 bp, Homo sapiens
  misc_feature (461)..(461): n is a, c, g, or t
  misc_feature (485)..(485): n is a, c, g, or t
  misc_feature (524)..(524): n is a, c, g, or t
gatcacagctcactgcagccttgacctcctgggctcaagtgatcctcccaagtagctgggatgacagggacacgccaccacacccagctaatttttgtttttttttgtaaagacggggcttcaccatgttgttggccaggcaggtcctgaactcctgggcacaagtgatctgcccactttgtcctcccaaagtactgggattacaggcattagctaccacgccaggcctatgttttctatctgtgaaaattagatgaaaacatacatgtaagcaaatacatgggagacttcccttctggtaaaaagaaagagagcaatcacctaggtagtttaagaggacagctgataaaatggtggtgtgtttgttttaaggttgaagagacttttttttcttttcttttcttttcgtttctttcttttttttttgagacggagtctcatgtctcgcccaggcagagatngcagtgagctgagaccacgccatngcactccagcctgggtgacagagtgagactccatctcanaacaaaacaaagcaaaaccacaaatatttgggcaaactgacattgaaattattttttaaggagcaggagaaatggtgtattcaatatccttgtgtactgaattggatcatggaaggagttaaggggtcatgctggaaggctctaatggtctaggacttattgctattaaaaataatagttccagggccggagcgggggatcatgcctgaatcccaaagtggtgggcttataggggttgaggccaacgcgacctgggcctacaaatgcgcacttttcgaaatggaagcacacaggcctacggcttcgaacaccaatcactgaaggccggggaggagcccgcgcaatgcacggccaattgaagcgtgacaccattgtacaggacaaacgagcaagtggccagacatgtaaacagagcacgcgaagacgtacaaccaaatatgcactagaacagcacacctcagaacatgacga

SEQ ID NO: 121582 - DNA, 339 bp, Homo sapiens
cagaggaataaactgggcatgactaatgtgcacgcaaattgtcctgcacccgtggacacttcacccagagtccggtggcatctagcacgctacactggacgagaccctggcaggtggccattgaggagcctgcgtggctctgtgcttggaggcacagtgattgttcctcatgactgcttggcacttggccaggggaccatatgcctggagttgtgtaatgcagtgggatacctggccagtttccccaaccctcagggggcttcctggtctttttaaccaaccacatatgcataggctatattcgaaggaccaagctgatgaaaacaatatcagcttgtg

SEQ ID NO: 121583 - DNA, 546 bp, Homo sapiens
ttatatagtgcagtaacacggaagaaagaaaatgggctcagtgaacttatggacttgagcaaagaaaactccaaatgttgaaagcatgaactggttgctgttagatgcatattctaagcttgctgtaagacatgaagaattagctcagaaaataactggccagtttgcaagcagaattcagaggcaacaaaatttaattaaacgtagcatatttcagaaacactgggttagttgaaaacaacaacaaaaaatgttttctcgcctctatcctctccagctagcaaaagaatcccaaattaagtaacagcctgtgagcaaagatcaaatccagagcactgccaggaagccatggactcatagtaaagatcaaatcaagggtatagcttaaagcagtgcctcacagaccctcacaactagaaaagggggcatttaggaggcttgagggcgttgattcacggtagcctgacataccctaaataccagcaattaggccttgggagagaagcctgtctcaaaaataattgtgagcgtggtttgttgacacat

SEQ ID NO: 121584 - DNA, 252 bp, Homo sapiens
ttgtttcttataaagttatacatgcactttactatatgaccccaggaattctgctcctagatatttactgaaaagaaatgaaagcatatgtctgcacaaagagctgtattaaaatgtttaaggcaactttatgtttgctgaaaactggaagcaactcaagtgcccgtcagctgatcaatggataaattgtggtacaaccacatagtgggatattactgaataataaaaagtaatgaattactgctatgtgca

SEQ ID NO: 121585 - DNA, 384 bp, Homo sapiens
gggttcatttttgccggatgtgttacacatgtgcaagcgtagtggttttatgtatagaaaacctgcccagcggtgtgggcatgggtgctactcctggcgaggactgcagaaaggcccctggccaatcagtgctctcgtgaaagagggatgctcttgttaaccatcccgggcagggggcatgtgaataaataatcaaagactggggtgcctcttgcagactgagggagggacattccagagaatttgctgcattcttccttgaacaggacgggaaggcgaagataggctggagcttccagatttccatcctgtgcccttgagggaccctctgcaggagcctggctctgcctttgagccctggagcccctagatgcaggatgatgg

SEQ ID NO: 121586 - DNA, 719 bp, Homo sapiens
gacggaggctcactctgtcgcccaggctggagtgcagtggcaccatcttggctcgcagcagcctccaccttcctggtttaaatgattctcctgcctcagcctccagagtagctgggattacaggtgcccaccatcacgccggctaatttttgtacatttagtggagatggggttttaccatgttggccaggctggtcttgtactcctgacctcaggtgatctgcctacctcagcctcccaaagtgttgggattacaggcattagccacctcgcacaacaataatatgcatttttaagatcctgtaaatattttatttgttctagccaacacctttattgaaaagaaacactttttctactttagtgacaatttgtcatgttagacatgcaaatctgatagatgacaggagaaataaaggttgtccatttcccttgtaaccccgccccagagattttctttttctcttcaaaattactttagggacccgcaatagaaatgacgtaagaggccaggtgtggtggctcatgcctgtaatcccagcctgggtaacgtggtgaaaccccgtctgtccaaaaaaaaaaaaaattttgttgggtgtggtggtacacacctgtggtcccagctgtttgggagttctcaaacagctgagaggattgcttgatcccaggaggcagaggttacagtgagctgagatgatgccactgcactccagcctggg

SEQ ID NO: 121587 - DNA, 254 bp, Homo sapiens
ctacttgggaagctgaggcggtagtagaattgcttgaactcgggaggtggaggttgcagtgagctgagactacgccattgcactccagcctgggcaacaagagtaaaactccatctcatgtatacgtatagtgtgtgtatgtgtgtattttttgtctaggcttttgagataaagtgctatacataaccaggaaatacatgatgaaagtgccctgtcaagttagctagcccatgacctgggaccttttctttttt

SEQ ID NO: 121588 - DNA, 402 bp, Homo sapiens
tgtagctgtgacatgaatattggttgatattttcatttttattaagaagtaaggcaaaaacaaaataagacatatgtcagaacttcacttatccttctttgctgaattggataatggttttaaaataccaaaaaatatttcttcaatttttttctgctactcataatgtagcatctgtagagcgacacacttttgaatttgagttaatatttcttttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaattttta

SEQ ID NO: 121589 - DNA, 623 bp, Homo sapiens
tattaaggaagaagatttctaggcgtcgtgggctctgttaaacgatcaaactgtagactcttaaacagcattcacattgtgacatccttcccatcagacaaggttgtgcacccagttcgagcttcatctgtccccctcctcctgtcccacagcaccctgccactggcctctcctattcttgtagctttcctttcatcagtgttcatcagcctagatagagcggtgaaggaggtccattccccactgtgagggagattcacctggggaggagggccactggcagcagacaagaaacagatcttagttctcacatccaaataaatgttggctttcaccctcctgtcccatcatcaccagtctgggtcccagaccaagcacctcttccctgccactctggcaagagttggtttcctgactctgttttttgccactctagtccactatgcacattcttcccagattgttcttcataaatcctccactcacaagcttgcagcctttcctatcacagtcatatccaatctcaattcccctgcccagtataatgggactcgactctagacacctgacctaatttctctccactccatgcacgcttccttgagccagcctctgttcctctc

SEQ ID NO: 121590 - DNA, 399 bp, Homo sapiens
tcgtgtgatataatgtttttggggagggacgtactagttctagaatagtgctgatcacatatggatgcttgttaggcaaaccaaagtgaattaaatgtaaataaaattaaaaatttatagtttctccattgcactatgtactgttcagtgctcagttgtcacatgtagccagtggctgtcacataggatcgtgcagatgtagagcatctccattatcacagaaagttcttttggatgatgataggctgcctctggaaaagtccttaaatactaccgtccattaccttcattagcagaaccactgacaaactcaaatacttccctgggactctgactcacatcttttgaactctggggtccacactgtccacagtctgggactcctaactgaaggagggg

SEQ ID NO: 121591 - DNA, 328 bp, Homo sapiens
cattcctcattgtggggagggtggccttccctgcctcatgtctgtctaactacctactgtaacagaaggatgaggcctcggggagaaactgccaaaagcggtaagagttatgggcagccttatgtatgcccttcctgcaaaatgtggtaggccccaggagtcagagccacagaacacaccaagctcttagaaccaaggattccaaccaccaaccgcctcctaggttaactgactctaacctaacctgcgacatacacctctgacaaactgcacagacttcatgcaacaagaacattcattttggggctcacaggcccaaagagagctt

SEQ ID NO: 121592 - DNA, 408 bp, Homo sapiens
taaatcctgagtcactggtgtctattgggttctcagtcactgtttctgaatgaatcaaatgggaatgaatgaatatgaataagacttagaactgctcacagtttgggcagcacaaggaacatgtgtgtaatgctttctgggttacaaagcattctgtacacatatctcttaattttcctaataatcctacaggggaaactattatttttaaccttcttttcattgaagaagcaataactcaaagtgattaaggtcatactgtgaaactgttggtctgagactcagtcctgacccctcaacttcatgttccctgctttttccatctcctgtaagttactgccttcatattcagatgtatacaattctccataaactatcctcatcaaaatctcatatctggaaaccagt

SEQ ID NO: 121593 - DNA, 664 bp, Homo sapiens
cgatctcggctcactgcaacctccgcctcccgggttcaagtcattctcctgcctcagcctcctgagtagctgggattacaggcacgtgccaccacacccagcttatttttgtatttttagtagagacgggggtttcaccatgttggtcaggctggtcttgaactcctgacctcaggtgatctgcccgcctcagcctcccaaagtgctgggattacaggcgtgagccaccatgcccggccgctctttttgtttttaagaagaactatggatacatgaaggcgagtactgcctttcagtgggtgcaaggaatccctgggtgttgatgttgaagaaaccatttgagaaagtgaggcttgtggggtcggggttcctcagtggagggggttgggctgtgggctggcttcctctccactccctatttttctggggtagatgagtctccccagcacccaggcctcctggctcttccccggacctttcaggtgagaaactttccattgttgccttatctcagcaatccgcctcccctccttgcagcgaccgcaggtgcacacagatctgagggcctgatctgttccactctctttatgccaaacagaggagggacgcgaaccccagcatgaaacggcacccacaaccacaaggcccggtgtgcgccctctga

SEQ ID NO: 121594 - DNA, 468 bp, Homo sapiens
atggagtgctatagacacaaatgtattatcctacagttctagaagtcagaagtctggaatcagattcaccgggctaaatccaggtgtcggcagggcagtgtgccttctggagactccaggggagaatctacaggccacctctattccttggctcaattcatggcccttcctccaccttcaaaaccagcagtcgctggtcaggtctttctcaagctgcatcactctgaactccttttcacaggcacagtccactctccctctaatcaggcccacctgatatccctggataacctctccatctcaacagccttaacttaatcacatctgaaaaggcccttttatcaggtaggtaacatattcacaagttgcagggattcggatacgacatctttaggggaccatgattcagccttaatcatgcagtgattaagactgcatgctccagggccagactgcctgggtttaaac

SEQ ID NO: 121595 - DNA, 547 bp, Homo sapiens
acataatgtagtctgggcttaatctaagttagctctttacaaggctagtagaacctaactcacttgctccttggactttctcacactcttggaaactcacaaccatggatacatcctcttatctgcttgggccatgctcataatcctaaggctgaatgtagctggaaaaacgtgcacctatgctgacaggtcttgttatatattcatggccattgacctgcctcaggtaagccccagaggctgcccaaaaatcatatgtccctaatccattctctcttccagtcttctgtcaactatttcagacttcatttacttttcccacctccaatatttcttcccctattctcactcaggtgaggaccttgctgcttatttcactgcaagaaatgaagtaatctctgcatctctgtgtatgcaccctgctatctcttttattactgtttgtaaataggtcatgcacctaacaaaggccaccacctctgctcacaagtattgctctagcaactctcttcaccttgccttgtcattataaataatttcctccata

SEQ ID NO: 121596 - DNA, 440 bp, Homo sapiens
gcagacggagcttagctctgtcatccactgaactccaccctggggcacaaagcgaaactccgtctcaaaaaaaaaaaaaagaaaaaagaatgtaaactacctcatttaaaaaatttaaaaaatactgattacatgttgaaatgatcatatttttaatatatttgataaaatatatattttttgactttttcagtgtggctataatatttaaaatcacatattagcaaagtaataaaagaatggaaaataaggggctaatagaagataagtagaatattaatacttgattcatccaaaataaggcaggaaaggagagaaaaggaacaaagaactaaaggtatagtaatagatgtaaatccatatatgtaaaaatcacattataggtaaataggctgaatattccagttaaaagacaaagattttcatgttaaaaacaatag

SEQ ID NO: 121597 - DNA, 1472 bp, Homo sapiens
  misc_feature (3)..(5): n is a, c, g, or t
  misc_feature (9)..(9): n is a, c, g, or t
  misc_feature (47)..(47): n is a, c, g, or t
  misc_feature (114)..(114): n is a, c, g, or t
  misc_feature (122)..(122): n is a, c, g, or t
  misc_feature (185)..(185): n is a, c, g, or t
  misc_feature (195)..(195): n is a, c, g, or t
  misc_feature (207)..(207): n is a, c, g, or t
  misc_feature (255)..(255): n is a, c, g, or t
  misc_feature (286)..(286): n is a, c, g, or t
  misc_feature (293)..(293): n is a, c, g, or t
  misc_feature (736)..(736): n is a, c, g, or t
  misc_feature (779)..(779): n is a, c, g, or t
  misc_feature (789)..(789): n is a, c, g, or t
  misc_feature (815)..(815): n is a, c, g, or t
  misc_feature (940)..(940): n is a, c, g, or t
  misc_feature (952)..(952): n is a, c, g, or t
  misc_feature (971)..(971): n is a, c, g, or t
ggnnngagnattgtaggatgccgccgggcacaggggctcatgcctgnaatcccagcactttaggaggccgaggcgggtggatcatgaggtcaggagatcgagaccatcctggcnaacacggngaaaccccgtctctactaaagataccaaaaacaaattagccaggcgtggtggtgggcgcctgnagtcccagcnactcgggaggcngaggcaagagaatggtgtgaacccaggaggcggagcttgcagtgagcngagattgcgccacggcactccagcctgggcnacagagngagactccgtctcaaaaaaaaaaaaaaagaaaaaaaaattgtagtatgcccagtttgtatctacaagatgaggaatcacttgctgtggaaaacccacacacagtgccagaactcctatgaggagtaaaaacagattttcctttatatccaaacagaaaccatgagagctggagtggctacgtcaacatcaaaagaaagacgccactttgggaggccaaggcaggaggatcgttttagcccaagagctgaagatcagcctgagcaatgtagcaagactccgccttgcctacttttctacgaaaagtttaaaacttagccgcacacaggctgggtgcagtggctcacccctgtaatcccagcactttgggaggccgaggcaggcagatcacaaggtcgggagttcaagaccagcctggccaacatggtgaaaccccgtctctgcnaaaaaagtacaaaaattagccaggcatggtggcgtgcacctgnaatcccagcnactcgggaggctgaagcaagagactngcttgaacccaggaggtggaggtcgcagtgagccaagattgcatcactgcactcgagcctgggcgacagggcaagactccgtctcaaacaaacaaaaaaggccaggtgcggtggctcacgcctgnaatcccagcacnatgggaggccaaggcaggngatcacatgaggttgggagttcaagaccagcctagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 121598 - DNA, 897 bp, Homo sapiens
  misc_feature (3)..(5): n is a, c, g, or t
  misc_feature (9)..(9): n is a, c, g, or t
  misc_feature (47)..(47): n is a, c, g, or t
  misc_feature (114)..(114): n is a, c, g, or t
  misc_feature (122)..(122): n is a, c, g, or t
  misc_feature (185)..(185): n is a, c, g, or t
  misc_feature (195)..(195): n is a, c, g, or t
  misc_feature (207)..(207): n is a, c, g, or t
  misc_feature (255)..(255): n is a, c, g, or t
  misc_feature (286)..(286): n is a, c, g, or t
  misc_feature (293)..(293): n is a, c, g, or t
ggnnngagnattgtaggatgccgccgggcacaggggctcatgcctgnaatcccagcactttaggaggccgaggcgggtggatcatgaggtcaggagatcgagaccatcctggcnaacacggngaaaccccgtctctactaaagataccaaaaacaaattagccaggcgtggtggtgggcgcctgnagtcccagcnactcgggaggcngaggcaagagaatggtgtgaacccaggaggcggagcttgcagtgagcngagattgcgccacggcactccagcctgggcnacagagngagactccgtctcaaaaaaaaaaaaaaagaaaaaaaaattgtagtatgcccagtttgtatctacaagatgaggaatcacttgctgtggaaaacccacacacagtgccagaactcctatgaggagtaaaaacagattttcctttatatccaaacagaaaccatgagagctggagtggctacgtcaacatcaaaagaaagacgccactttgggaggccaaggcaggaggatcgttttagcccaagagctgaagatcagcctgagcaatgtagcaagactccgccttgcctacttttctacgaaaagtttaaaacttagccgcacacaggctgggtgcagtggctcacccctgtaatcccagcactttgggaggccgaggcaggaggatcacctgaacccacaagttcaagaccagcctgagcaacacagcagaccccatctctactaaacagaaaaaaatcagccgagcatagtggtgcatgtctatagtcccagctacttgggaggctaaggtgggaggactgtttgagcccagaagctggaggctgcagtgagctatgatcgagccactgaactccagtgtgggtgacagagtgagaccctgtc

SEQ ID NO: 121599 - DNA, 249 bp, Homo sapiens
cacctgctacaaaccagtgtctctgcgtattgacttgctgtgtgcattaagtgacgaacctattgtgtggttacagtaggagtaaaaaaaagagaagactggttgaaaggctaatttaaaacttgttatacctctaatcctccctctgtactcccaaaacagcatgctgattccctagagaaggtcaaacgctggtcttaggattgagtggccaagcacatttgaggacaagggtaccctatcagtgag

SEQ ID NO: 121600 - DNA, 317 bp, Homo sapiens
tgtcattttgctaattattaagaaaagactcacccaattaattgctgagtcctttcttaaaagtgaattaagatgggtgtggggaagaagtatttcaaaacaaactgttttcaggcacataaggaattctgtaagttacataattgtaagccatcaatattccaattgtcaattattcctacctgctcattaaaataaattttctaaggactgctcttagctgacttttagcattttatcaaaatttgtaaaattttaaaaagtctataattctgaatttttactttttcagaaaaccttttctcatttgtttgaat

SEQ ID NO: 121601 - DNA, 453 bp, Homo sapiens
cactactaaaccccctacaattctctttacataattttccaaaactgtttcccaaaaagttgccagcagtaaccaaattccagaagtgaaagcatgaccctggcccatggtgacaaacccgctttctaccaagttgatcaccacctaactgttgattctagcccttctaatctttagcctgtggtagcaagccaggtacaatttggcattaagatctaagaatggccaaagtctctcattgcacgcagtgctaccctgatgcagtggaaactacactaaacaagctccgtgggatccttgggccttctcccgtctccatgactcattggctgggagactttggaaaattttttctgcttctgtgaacttcagtctcagtggaacataaaaactggtaagaaaaagtttcattgaagcaggtttttgaagccaaaggaaaagatataagttcca

SEQ ID NO: 121602 - DNA, 443 bp, Homo sapiens
ttttctaatacaaaatattgctgcttaacactaaagagtaggtaaaaatactagtttaatttttttatcatttccaaaagattttagtattctttaaaatagtctcacttatcttaattgttcattaaagatctataatccattatgtatatgtatattgaaaggaaaagacctagttttgggcctttattttggaaaatctatgactctttgactctgttttctcatctataaaatggacttttgagaacattcaactaacttgcaattatggtgagaattaatatgtgaaagaaagtgctcagcttctgtcaaatgcttcttgtggggtgtgtgtgtgtgtgtgtgtgtgtacatgcctgggcatttgcatgtatttgtgtgcctgtgtttgtgataataatttctatttatgtcatgatctagtggtgcaaagacaaagg

SEQ ID NO: 121603 - DNA, 192 bp, Homo sapiens
tcagctgttttcagctaaagttatgggagatccctttctcgtgggggagataggcctgctggcattcaagtctgcagcagacgaaggacagaaacaagaccaagactctcacgtgctgctcttggagatgttttccaaacttctggaactcttgaccctccgccaccggctgatagaaatgagcctggagag

SEQ ID NO: 121604 - DNA, 417 bp, Homo sapiens
ctcttgtgccgtggcctggcatgggagaaggtgacaccctaggaggtggggaaggctgagcttaggcagatggagactccaaggaggtgccctccctggaaaaaaccccaaggaggaagcctgctttgagaggctctctcaagttctcactcagctccttctcctacctccctgcgcccggcctctgcgctccttgctccctcctcctcggcccagctatctcctccttcaagtggtagcatgaaagccaccacttccaggaagccttccctgatccccagggcaaccaaggagttccactgccaagagggtcggattgggcgggcgggaaggatggggcccagcaatgcttccttgaaaggatgagtggtgccccctcagatgtccctcccgcggcccctccccggcctgggggct

SEQ ID NO: 121605 - DNA, 744 bp, Homo sapiens
ccctacgcgaactcctggcagctaaggacactgcaggccctcttgctcccggctgtgacggctggcgtgccctactgggcacctctccgaataaactctgagggcggccagttattgaacgccgccatctaatctctgtcaaccattcataatctgagaacggagctattactgtgggagacctgatgtcccaattctttaacttggaggaaagattttcaggtttcctccaagaaacagtctctaagaacacagcactcagagaagctcgaggctgataccgtagattactagcggttcacgaggcttacagtaagacgaaactacagtcttagcgataaccaagtggcagacgtggcagaagacagaatttgaaaccatgggccacattgagcctgcaggcactgtctggcctgtactgacgacatgacatttcaagcacagagaggcacaggagcactgtgtgagcctggagcttaaatcgcgaatccagagagccctctctgagcatgcgttgtgcccagagttggtgacatgtggatcaactcaggcttctatggcagggccaccagacagggtccacagaagtggtttctgccaatctttgaagagtcctgatcttatataatcaaagaagcttcaagtctggaagagagaggcaaaaggtgagagtcaggagaatctgaagatgctacactgctggctttgaagatgaggatgggtcatgagcctaataaaaaaggt

SEQ ID NO: 121606 - DNA, 398 bp, Homo sapiens
ctagttctaattgacagagcaaatatgggaagaaaaatgtaatgaagctcaaggtggacatttttctctactttttctgtagctatggtagactgccaaatgactaccctgtccccaatgttcccctctatcatgtgactttgctgcctctttcatcaaaagggagggtttatttcgccacccattgagtctaaaattgctgtgtgacttgctttggctagtggaacattatcatgaataacataaagcaaagatttgaaaagtgtaagcatttggggcttgccctctctgctgctggaaacccttccactaccatgaaaagcccaggccaggccttgagagaccatgaggaaagaggccctcatctccccagccatgccagctgtctcagctgtgtg

SEQ ID NO: 121607 - DNA, 406 bp, Homo sapiens
ttttatttctaggaattataaacgaaagtaatcagggcgattagtcatcaggttactaacttactgccaaatggcttagtgaaaactagttgtatttgtacaataattaaaactggctgtttcagaaaaaattaaaaatgatttttttcttgattatatttcttgcatacgttaatggtagaactttggaaattattttctgaaaatactgatttgtagaaattctcagttaacgttttaaaaattatgtgtacatgctagttttaatttaggatagagtttttttcatctatggagataacagccaagtggatttttaaaaataacgttagtgatgttttttttcctgataccaaaaacaggtgtcaggcagggctcactttgggaggttgaggcgggtggatca

SEQ ID NO: 121608 - DNA, 258 bp, Homo sapiens
gttgagcaggtgagtaaggagctctgaatttaaaaaccctgtgtggcttaaggtgaaagttcaacagcagcactttcattgttttaaggttttaattctttgatcaactccttgctttccctgaataaactttaagttcccaacaatcaggcattgatggtgatccttgaattgaaaggtttacccctgtctcatcagtcacttttccttgtctcttgctgattaacttcaatgacacaggaacagcacttcacaggt

SEQ ID NO: 121609 - DNA, 179 bp, Homo sapiens
gcctagtctagcttccccaaaacatctcctccatcacattggcttcccatctcttgaggcttccttcaagagaaatattatttcctttcactgatattctagctttcctgttcacgatgctgcgggtccattctcaaatgccaccacctctgactctaccatgccaaagtgagctcacc

SEQ ID NO: 121610 - DNA, 179 bp, Homo sapiens
tgccgggattacaggtgcgagccaccatgcccagccagcacttatatatggaaatgtattcgtatttttcctttgtcatttatattggatcattatattttctttgaaattgtgtgaattatctatgaatttcacctcagcattataaaagaggtattataaaatattagttatgcaaa

SEQ ID NO: 121611 - DNA, 216 bp, Homo sapiens
ggtcactgtgcttcagacaagcggcaggcattgaagaaaagaccagtaagtactcttctaattcagaggggatggccagtcagtcaggatagggcagtacagaacagggagggccaaactgtcttggcttaaaaggcaaagtaaggccttagagtagttcttgagtcactgcctatcatggacgtctcctgaaggatgtgatatctgagagtttgg

SEQ ID NO: 121612 - DNA, 480 bp, Homo sapiens
catacacagttctcagttctcagtagggttcaagctcccatgagaatctgatgtggctgctgatctgacaggaggcagagctcaggtggtcatgcgagcaatagggagcagctgtaaatacagaagaagcttcgctcgcttgcctgccgccccctcctgctgtgtggcccagttcctaacaggccacaaaccacaacctatcaagaaaaactggcttcctaagaaacataaaattgtttctcttccctttcgctagtgcaattggtctaaatcgttttagaagtattgatagaagaaacaaacaggacaatcattagtttccaaaactttaaggagcgacatgtttgttggataattggatacctgaataaaaataaaaaatagcaaaagtttcttgttattatcactattacacagcagttcctatcattcatggagtacctagcaggtgccagattcagtactaacctctttacatat

SEQ ID NO: 121613 - DNA, 534 bp, Homo sapiens
  misc_feature (391)..(391): n is a, c, g, or t
acagacaggcaggcaggcaaggaaacagagtaagacagaagataggaacagagagagagagagagagagacagagagacgcagaaaaagaaagagagaggcagacagacagagaaagacagagacagacagagagaaacaggcagaaagagagagagagagagaaaaacagacaggaaaggagagagagagagagacagagagagaaagagaataagacagaagacagacacagtgagagaggcagagagagagagagagagagagagacagagacagagacagagagaaagagacagacagacagagaaagagacagacagagaaagacagagagagaaagagagaaacaggcagagagagagctagcgagagagaaacagaaaggtaangagagagagagagacggacagacagatggacaggcagagaaggagagtaagacagaagacagacacagtgagagagacaaggagagagagagagagagagagacagagacagaaactgaggcagaccacaggacggggtcgac

SEQ ID NO: 121614 - DNA, 792 bp, Homo sapiens
gaactcctgggctcaagcaatctacgcatcttggcctcctatagggttgggattacaggcatgagcccccgagccagtgtttggaaaattttacatatattaattaatttaatcttccataactattctaggagataccttttccaaatgaagaacttatctttatttcccctttattgctgaaggataattttgctggatgtagaattctaggtcggcttttttcctttcacattaaaagtgtcattttcttctggcttgcattggttcttgacacaatgtctaggtaatttttatattttatatttgttcttctgtatgcaatatgtcttctttttccttgtctgttcttaagattgtctctagtcatggattagtcaaaatggtttctgtggccttggagaggttaaataatttagtggagtcaggattaaaattcagctaatatttctctagaggccctgctcttaaccagttgaacatgctgcctcttttacggtagataaaatcagtttttttgataaggacactgaagcagaaagaggtgaatttaggtctcctgattctcaaggtcaacattcttatttccattaatcactcaggacagaatcatacctaactttttctacaaacttttctgaatatgttttttaaaagttcagggcaattacttccaacccagtatccctttgatctctagatagtagggctcaaaaaggaagtgtcaatatttaaaaattagaaatcacacattgactcgatacgagtacagtgggctacagaagtatttga

SEQ ID NO: 121615 - DNA, 517 bp, Homo sapiens
agagatcctactgtcgagtcaggctctgattctgacatagcatatatgagtccagtccctcggtcattatagtagacagtcaagaatcaggaaacgtaagtttaccagtgtattacttttttttttttaagacagggtctcactgtgttgcccaggctggtctccaacttctgggctcaagcgatcctcttgtctcaaccttccaagtagctgggactacagacattccgccaccatgcctagctaacaaagggtattttaagggtgaagagataaataggtggggtgaggtctgaaaggattcccagcacaggagcttctgtccctgtgggtgggttggggaactcattcttgttcaccttcctgtcagcctccacattcagttctctagaaactccccaaaccctgtcctcttgggcattttatggagatgtcattggataggcatgattgaaatgtggacaaccgtgttgaaatgtgattggacaaaaaaggtgtgatctaaacctagcaagac

SEQ ID NO: 121616 - DNA, 267 bp, Homo sapiens
ccagtactaacaaacttaaggaccaaactcgtcaatatgtaagatactagaaaaattaatcagaatatattttgaatatcttgtggaagcttctcaaaggatattacattgagcatcataggctggcatgttatttcatgttttaagtaaggcatttgtaagttgtccatttaaatatatttattttagaaagcaaatatatttgtcctgtgaagagcatccttattttgagggatagcttcttgctgttaataaaacttcgtagat

SEQ ID NO: 121617 - DNA, 362 bp, Homo sapiens
ccctggtaatctctctgaatttgcctattctaggtacccccacacaagtggaatcatatactagtccttttgtgtctggcttatttcactgagcataatgttgtcaaagttcaatcatgttttggcatatattaatattttgctccttttcatgattgaacagtatttcattgcatggtcataccacattttgtttattcttctaccttttgggtattgtgcatagtgctgctgcgaatgtgggtgtgaaagtatctgtttgaattcttgctttggaaatgctttttaaatcacagcggtctgaccttatctaacatttggaatatccattatagcctgagtaggccgctaggctgtgggaa

SEQ ID NO: 121618 - DNA, 444 bp, Homo sapiens
gactgacgtacacagaactcaggagcgagctacttcttgcagagtcaggatccacatctgcagactatacaaataacacagattaaaagcacaatcttcattgaaatcacagagcttccaagtgtttttatccattttaatggattaccagctgctaatctgtctgcagctccttcaagcactccagttcctggcattaaggtcaggtgtgctgggatgcttcaaatatctgttctttcaattttgcaatatccaaagacaagtttgtacggtgtccttctagatgcttttttattctttcccaaattttgatcttattaagagctattaacagtttccacaaatccttatgtttagctcctacaaagggccataccatttgaggttgaggtgccactacaccgccatggttccagataataggaacccttgccgtatttctta

SEQ ID NO: 121619 - DNA, 416 bp, Homo sapiens
gctcagggccaccccgaggccggggatagacttggaagacaccaagctcatggtgcaggcggccaccgtggccctcggaggcacccagatccggagggccggatggtcgggcccggcgatcctctcccagcggttcctccagctctgacgtgccatcactacagtcactgactgagcctcggcctcccaaagtgctgggattacaggcatgagccaccgcacccagccagctaacattatacttgatggtgagaaactagatgctttcccccaagatcaggaacaaggtaaggatgtcccttcttccaccaccatgattcagtgttgcactggaagccctttctaatacaataatgtaagaaaaggaataaaaggcttgcagatttgggaaggaagaaataacactgtctttgtct

SEQ ID NO: 121620 - DNA, 152 bp, Homo sapiens
agctgggctctccctgcagtggcacactaggctggatttagcccaacagcctggcacaaaggacaacaatgaggagaggaaaggggaggtgacgcacctggcaaggcactaagggatgagatgcaccaagccagctgtgagtcaccacgaag

SEQ ID NO: 121621 - DNA, 233 bp, Homo sapiens
ctatgcctgaactctctccacagcttctccatggccacatggcccctctttccctccaggccttggttaaatgacacctgtcacaggtgtcctctaatctctccctaggctgagttggtcctcctctgtggttctctcccaaggccctttcattcactcagttaacatttattaagcacttacaatgtgccagaaccacactagaccctggggatacaacagtggcagaaagt

SEQ ID NO: 121622 - DNA, 438 bp, Homo sapiens
ttgggggatgtggataaaataggagaaatgcactacactgattcagcagcttctaagcaacagagaaagggtttggctaaagtactagtatttttggtattcagtagcaaagaacagttagactctcattcacaactatttcaggacaaggtgggagtatctattcagtcatttgggagaatgaagctacgtagaactcaatccttgagagcttaatttactgccaataggactgccaatttcgcggggcttctgcaactcctccccggctctaagcaaaaacagcccctgtacctgttcttggggactgacgtgacatcgttgagtgttttccctcaactctttgatcttcatgcacttgtctatttcaatgttttttgaccatggctgtacatcagaatcacctagggagcttttcactccacagatccgtactgg

SEQ ID NO: 121623 - DNA, 417 bp, Homo sapiens
cacaagtgggagctacacattgggtacacatggacacaaacatgggaaacacaaacatgagactatgagagggggcagagagggggtggggtgattgttgaaaaaacctatttactatgttcactacctgggtgatgagaccaatcgtcccccaaacctcagcgtcacacagtatacccatgtaacaaacttgcacatgtaccccccgaatgtaaaataaaagttgaaattatatattcaaaacaagtggccaggtgcagtggttcatgcctgtaatcctagcaccttgggaggctgaggggggcacggatcacttaggccagaagttcaagaccagcctggactatgtggtgaaaccccgcctctactaaaaatacaaaaattaggctgggggcggtggctcatgcctataatccc

SEQ ID NO: 121624 - DNA, 412 bp, Homo sapiens
agcataaagatcaagctaaatggtctctgggaactctgtatttggagtagtagagcccttacctgtctctgttgttgggagacttggtatcccattcctgcaatgggctgattctgcatttgctgaagtaggagcttttgctgaagtggcaaaggtgaccttagcaaaggctggcttggtagagattgggcaggctgagaagatggttgttgctgctgctgctgctgctgttgttgctgttgttgttgctgctgctgctgctgttgttgctgctgctgctgctgttgggctgaaattgagctctgctgctgttgctgttgttgagctgaaattgaactctgctgttgctgttgctgttgctgttgctgctgctgctgctgttgctgctgctgctgctgctgctgctgctgct

SEQ ID NO: 121625 - DNA, 482 bp, Homo sapiens
actcactgcaaaatattaaatactgagacccgatcctattgtttctctcttccaagaactcagctttctacaaagactgccttgctcagttgtcatcgtgtggctggtcggggtgtcagtattctagtgttcctactcaacagatgcaggaatagagactcacaggggtaggatggtctgccctgggtcacagaacaacagagaagaatcagagtcaccgagaagttacataagcacagcccaccaagctgagagcagcgatttgcctgagggcctgcagaagaatttctccctccatgcatccaagccatgactgattcatttcctttaaaaacaaacaaatgtgtttttacatcaagactactaagacttctccaggaaatcctgggtctctgtcttaatctcttgtagcacagttctctcactctccgagcagaggtcaccatgttgtaaattggtggggacatgtcctgaaggagtgg

SEQ ID NO: 121626 - DNA, 369 bp, Homo sapiens
atttgaaaagattagagaggccagatgggcagcctctgttttcttatctgttcgatgggaatcatgacacaggtctcagagtgaggcacagggtcccatgagaaagtaccttggcagccacctttggccagcagcactgcaggcacttgctgaccgcccatcatgatgtgtctgtgcccgccccagctgaatggggtctcctggagctgtttccaggaagtcagagattcgcaatgggtctttaaaactggttgtccattctcttcaaagagcttgctctgccagggccataaacaaataagaaatctcaggactaataaaaggctcgctatttgtctgagacaatcagcccagaccataaaagacagc

SEQ ID NO: 121627 - DNA, 369 bp, Homo sapiens
tcaccatgttagccaggatgctcttgatctcctgacctcatgacctcatgatccacccaccttggcctcccaaagtattgggattacaggtgtgagccactgcacctggccgaacccacatgttaaggcctggcagcttccactttggtgctctggcggaagccagctgcaatgtaagaaatccaagtaccttgagacccacactgtgaagaagcccaaactcgcccatggagatggcacatggagagagaattggccccactgagattccatcttgaacactgcaggcccagctgatgccatacagagtggagcccagccagcccgcagattgcagaatcatgagcaaaataaatgattgttttcata

SEQ ID NO: 121628 - DNA, 628 bp, Homo sapiens
tgaaacgtatggtgtaaatgctatgaagaaaaaatggggacagggataggggaagtgaatttgtgatagaattttaagtagggtgcttggtaaggccttactgagcaaagccctgaaggagctgagtgagaatacatgcaggtatctgagagtagagaacccccagctaagagaacagcaactataaagccccttgaagcaagagcatttattaaaatgctttatgcttgctgttcttttatactgtcccaagcgtgattacaggtgttggaggtgctgcactgaacaaaacgttaaaatacaattccacctttttggagcttaacatttcatcatgcttggtgtgtttgtaaagctgaggttgatgtgaagagactgaggaggtggaaagccttaggagagttttgaggagagaagggttatgatctgaactatgtcttaaaaggatcactgattactctgaagaattaactaataatgggagcaaaggcagaaacaggaagagcaataaaaagtctcttttttttaagtcattgattttttaatcagtggcttgaaccagaatggatggtgttaaataatggttggttttgctgtgaacctaaaactgctgtaaaaaaaaaaagcg

SEQ ID NO: 121629 - DNA, 347 bp, Homo sapiens
gtcatctagaggatcccgatcagagcataccccttggagcttaacatttcatcatgcttggtgtgtttgtaaagctgaggttgatgtgaagagactgaggaggtggaaagccttaggagagttttgaggagagaagggttatgatctgaactatgtcttaaaaggatcactgattactctgaagaattaactaataatgggagcaaaggcagaaacaggaagagcaataaaaagtctcttttttttaagtcattgattttttaatcagtggcttgaaccagaatggatggtgttaaataatggttggttttgctgtgaacctaaaactgctgtaaaaaaaaaaagcg

SEQ ID NO: 121630 - DNA, 208 bp, Homo sapiens
aaatcatcagccctggcactaaaggggttaaacggcattcaccgagaaacaaatcagagatggagaccaaaagtagtgcagttttaaccaacacataaaccaaaagtggacctgcctcattgtcagcaccaagggtcagggaggagttagggcatgaggatcggtcagggcggagcttagggcaggaggactggtcacggcaggagct

SEQ ID NO: 121631 - DNA, 1030 bp, Homo sapiens
tacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaagac

SEQ ID NO: 121632 - DNA, 386 bp, Homo sapiens
ggtcctcaactgaggaccatcgttgccacgatggtcctcagctcaacgatggtcctcagctagtcctttttttatttattttgaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagaccgggtctcgcctaggccggatgtagtggtaccatcataactcactgcagccttgacctcctgggctcaagccaccctttcacctcgctaccacagtagctgaggaccatctt

SEQ ID NO: 121633 - DNA, 1355 bp, Homo sapiens
tacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaagacagtcctttttttatttattttgaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagaccgggtctcgcctaggccggatgtagtggtaccatcataactcactgcagccttgacctcctgggctcaagccaccctttcacctcgctaccacagtagctgaggaccatctt

SEQ ID NO: 121634 - DNA, 349 bp, Homo sapiens
gaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagatagaatgttgctggtctgctatgggttagtggagcataactcagccccaactggactccacgggtggctgaaccattagtagttgctaggggtacaactgaattcaactgccttcagaaacagggaacaaaaccagcctgacttgattcctggttggg

SEQ ID NO: 121635 - DNA, 458 bp, Homo sapiens
tagttatagcagacagggcaagtcatacaggaaaaacaaacaataaaaccaggtaacaacaaggagtgcagggacagactgagaggacagcagttccaaggaaggcacagtcagatctctgaactggggaggggagatcacagaagaaatagcttttaggcttagctctaagggaataagcaaggtctcaagatgccacatcctcctggccacctcctctctgatgtgtgtgtctgcatctttgtaactaaatagcctccattcactcctctgtatgaatgcagactgggagctggctgaggaggaagagccctcaacagccctagcttggatggcagccagggctctgtgtccctgggacataatcccaactgactctccttgctggatgagcacagcaaaaggtataaataacagcagaaatgaacccctcccaggactgctgtgggattaataag

SEQ ID NO: 121636 - DNA, 449 bp, Homo sapiens
gcccgtctgatgaacagggtgagtaagtggccaaggctgccaagctgggaaggggagaagcctggcacggcccagggtggccaacccagctgccgtccctcccgcaggggctgcaggggctcccgggggaggaccacaaggaatacagcctggctgtatgcagaaggttctgtggtttcctggggaggccagtgggagaagggggagcaggctgcagagggagagcgttggagcagcaggtgggcagggtggctgtgcccccctcacctggtctccagcatgccgagtgggtcagcctgaggttccccagcctggctggacaggagcaccctctgggtgctggttacaggttcccaggcccctgcccaggtagattgggctccaggaagaggggtgctcaggaagcaccagtgcctgggtaccccagggagcatcagagagagtgggag

SEQ ID NO: 121637 - DNA, 575 bp, Homo sapiens
catatagaatgtggcatgtggggcagtataaaaagaaattccccctttattgtctcagctgagcctcacactgaccttgtgtgagaaacactgaggttaagtgacttgtgcaaggccattcagatagagaatggtgaaatgaagtccaaatcatacccatggacttcagatatggtgttatctgatgcaactcctctcagctataaaagaggaaccaaagctgtcagaggattctactatcagtgataacacaagctggactagaacccaggacatctgacttcattttgacagattattctcctgccacacattcaactgcttccttggagacatctgagctgtctgtgagtacttaactcacagccggcctcagacagatgggcctcctgagctgttcttggctttcagctttggactgagcccctggtgaagtcacctggctacctatttctacacaatttacggctctccaggtgacaggcctcagagctccaccacaaatccccctcagactttgcctcgtaatcacagctccatctggtacagggagctccccctactaatatttcact

SEQ ID NO: 121638 - DNA, 382 bp, Homo sapiens
gtatctggtatatgcttgctgtatgtatttatgagacccaacttactgagctattttaagagcaaaagaaggatcctacagttagagaacaaaactatattattccatagctaataaagctattgatgacaacaggtgacccatttaggggacgattttcagctttagaagctgagctaatgggattaactggttttcaagcttgtaaatgtgaattaaagccaaagccagggaggactggctggttttgaagctggggccaaagaggtgaagcaagcccacccgtgcactgcctcacccaggcaggcgctttgtatctctcccagggcagagctggctcctccccgatctcagccccaaggctctgccctgccttccccaa

SEQ ID NO: 121639 - DNA, 266 bp, Homo sapiens
aatctgaacacgctgcttgctctgtgatctgcacagaaaagaagtgatttcagagatttccaagagcagtacagagataatataactaagggggtctcagaatagtgttaagggtcttgcttccccctgatttataggattgactatactctggcggaaaaaggagacaatgtcttcaattcctcaggtgtgagttagaatcaactgaaataaattaagtggaatataaaatgcatggaattgccttattaataaagattggacat

SEQ ID NO: 121640 - DNA, 355 bp, Homo sapiens
tttccagaaaatgccaggctttcctttccatgtactcaaaaaggggaggcctcaagccctccccacactctggaacaagcttggagcagtttcttggtgccaggcacatttctggggcttcccttcctgtaagaggaagcctcccggcttccatctcctccaggccttctccatggggcggcagcatgatgcaccccagctctgcacagggtttggggccctggagcagagcaggggacacaggagcattggcaggtgggcagggtgtggacaacggcgacaacgggaccaggggccaccctggtgaacctgacaggccagggatgggctcgcctgtgtttgaatgaggcctcca

SEQ ID NO: 121641 - DNA, 428 bp, Homo sapiens
agtttttcaacttttaactcaaactttaatacattatctattagaatgattatggattttctacaaatttgaaattgtataaaaacatttgtcaaatttatatcaactcaaatgatatatattatttattaatgaatccatgtttttctttcaaagccacttattgaagtcatattagtgattttttaagttgtggtctttggagtcataggactgtggttcaagtcctgtcccctcctaagaacaatattaattttaatgaagttacgtactaaataaaatggagattataaaagtaaatccttcatttggatttgagaagatcaaataatgcaattttggtgaagtacttatttatacatatatcggtgttatatgtgtataatgtaatattttgtgtatcttattttgaaagccaaacatggagg

SEQ ID NO: 121642 - DNA, 407 bp, Homo sapiens
tttggagttactgctttagaaatttgaaagaggtggagatgtcatcttccaaaaagcacatttctataactttgaagagttgagccctcctaatccaaccattaattatggattaagagcctctgataaaaatcctccttatacttattttctatgcctaccatttatagtaggttttttaatttctttttttctttttttttttttttttttgggaaaggggttctaactttttgcaatcaaggcgggggggcagggggtaattttgggcacacggaaacccccccttccggggtaaaggctatttccctcccaaaccttccgaattggatggctctctggggcccgccaaccgcccccaccaaattttttttttaggatttcttagaaaaagggggtttccttgg

SEQ ID NO: 121643 - DNA, 767 bp, Homo sapiens
gtatcatttctatcttaatgtttgataaaattcaccagtgaagacctctggactcagagattttatcatataaggacatctaagtatgaactcaatttatttaattaatctaggttaattcaaattttctattcctttttaaatccttgttgacacattgtcactgtcattgctttttgtgactttatgtaaggttgcatccagtatagccacttgcttcatccacagcatgagatttaaggagagagaaagacagacatgtcaaaactacagtctttgataattatacactagttgaataacatttggcagcttgcttcactcagaggaagatttaagaggagagggaaagacacagatgtcaaaactacagtctttcataattatacactagttgaataacatttgggttgattccagtttgaagtaacatactatcatttgtacctatgctacttgtcagacagacaaattctagtaaaatagttaaagtgattaaaagaggtttcaaatacaaggaggcagaggtcattgggcataatcatgtaggaggctaataaaacatctttactgattttgtttcaaacttctctcattttttcctgatggaagtgaataaagctctccaaataaaaattaaaaacttctatttctatattcaattctgtcaagtttttctgcatatatttcaagctctcttttaaggctatacaatctttcacatattttccctgtgtttttcatttttaatataatatacccctact

SEQ ID NO: 121644 - DNA, 894 bp, Homo sapiens
cttagggctggtgctcctgctatttcctcttcccaggtaaccatgtgaagtgcctccctctgccctctttccagcctttacttgagtgtcaccttctcagtgaggcctgccctcattcctctttcgctgtttgcaacccatctcctgtcccccttcccagaactccctttcctacttcgtttttcttcacagtacttgatactgcctaacacactccatggtttcttacttgccctgtttattattttcccccaatagacagaatgttccatgatggcagaattctctgttttgtttccttccatgtccccagcacctagaacagtgcctgacgcatctcctaagcaatacgaccaataagtatgtgtctggctgccttccggctgccagtgtctgcctctttcctaggggcagtggttgcgggggtgctttctcacatgtcttagtaggctgtgcaggctggaagtgctcagaagtcacacccccagggagcagcctcagccaacagcaccttggctgtaaatgccccagctccctcgccctcaggtaagcattgctgaggcacacgttccatactcttttccacagttcctccgtgggactgagcaccacccagccacccacaggagcagctaacctgataaccaccagcctcaccctccctgccttacttccccgctcccctttaccacatgctgacctcccagatgcatttcttgctttccggtctctgtctcaggattggctcctggatgaacacaaactaacactatgttcacaaatatatttgggaaatgctggatgaataattatacacatcagacagattactagaaattctcaccaaagggatgcacatgttacctctgcatggtgagatctcaggtgcttttt

SEQ ID NO: 121645 - DNA, 295 bp, Homo sapiens
tctccagttcccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctgtataaccctgcctgtgaggcaaacattattacccccatttt

SEQ ID NO: 121646 - DNA, 191 bp, Homo sapiens
cttgtcctgcctctgaggatgttactattttagaaagagggtaatctagaaccaaagggtcaggctcttatctctaagaggggaaaaaaaagtaaaaaaattgtactctgagatcaatgggcagcctttaaatctttctagtaaagacctgagactcatcatagggctctctaactaaattcctgagttct

SEQ ID NO: 121647 - DNA, 743 bp, Homo sapiens
gtcacctcaacttcctaatttataacttatttaagcctttgtctactaatagtttttaaaaaacatatcctactctatctacattgtctagctatatcttatcatttaaaatgtttaaaatttttaaaattacatttttgtctctaatattctgagaagacttactatattttaacaaatagttatgaacttaagctgctttgaaaaatataagaatgatttagatatcagctaaaactatagttcagaaaacctgtagattagaggagaaaaaaggcatctatgtaagtgactgtagttgaaatcatttccatgagaaggattattttctcactatcacataatactgagtaatgtttacctgagaggctcttatttattttgacttttgattttttttattggaggtggggagcatttttgtttatatgtaactatttctgtgtttcaaagagctaacatttaaagatttcccttaaactgagtaaagtaatttatatgttgcctaaaaagacagaccttctcaactggacccaaagcaatgatagttgactgtggataattgattaaccttactgattttatatttttattatcttctgaatataatatagcactgctatcttgaattaagtatctaataactgtctaccttttactcagaatcatagttgttcaaaactatgagaaactttagagggcatctgtcaactgactgatgttttttatagataaggagagaa

SEQ ID NO: 121648 - DNA, 736 bp, Homo sapiens
gtgattatatgtgaaagcttaggggagggcttaaagcaagaaaaacatgggaagatgggggtgaccgttgtcctcctggactgcaagctgcatctcaacagaacttgggatgctgcttggaccctagaaaaggcagactgtatgagaggcatagcgtgcttcaggccaagactggaatgccagagcaggggagagagactccaaacctggccagccaggtaggagggcaactgagaagcagtggaacgagaggcataggattcagggcccaagtgcccttaaggtcggtgtgggctctcccttctcggtatatctgcaactaaacaggactggggttgtgcgtccctctccggtgtgatgaaaagtgactggggctgcacagccactcctgaggacccgcctggaacaagtcacttcactgttgagccccatgctgcttctcctaatgcttagttctcaggacagtactggaattaaatgataatgtaagacctagcacggagcctggccaatcactagatttcacgtgtgaacagttgttctgtcccacgtccccctttctaacatgggactaagaattactcccccatcctatttctccgtcagtgtaagcaatataaggattttgagtatcaagttcctgaggcctggacacagaaacattctcattattattacgattgttattattttccctccagcagtcctgtctccttccctcccaatctggggcacc

SEQ ID NO: 121649 - DNA, 705 bp, Homo sapiens
atcataatttgggttttgtggaatccaaagaagagaaagcctacccagacttccaacctacggaagctgtgagataaaacattttgggttgttttaagccattaagtttgttttggcagcatagaaaagtaacatatagagatatggattctaatcagaagttctatttttaccactaaaggttaaaacatacttggggtagccttttctcaacgttttactttctttttatcaggagggtttagtcaggacaaaagaaaccattgcaggtatttcaagcaggaaagatttaacacaacatactaggcactttataaacagaaaacaaaaaaaagcgttgaggaaacaaaagtcaggaaaactgcctcacaaaatatggaagttgaaagaatcacagggaatcaccactgatgatctcagttatctgtggcatcacaataagtgatcatcagcagaatgtccggaagccactggtaaaatttcatgtctgcagtattcctgccttgccctgcgggaagaagaataatggcttcttcctcggttctgctttccaaatctcatgtgactgcctctcactggtggaagctaactcagatcccaggcttccagcccctgtactacagagaagagcacagaaggagaaatatggccccgaggggctagcatattcctctatctcattgttcccattgcattgatacccat

SEQ ID NO: 121650 - DNA, 718 bp, Homo sapiens
tgcagcggctcacacttgtaatcccagcactttgggaggtggaggtgggaggatcacctgaggtcaggagttcaagaccagcctggccaacatggtaaaacccccatctctactaaaaatacaaaaattagcctagcatggtggcaggtgcctgtagtcccaactacttgggaggctgaagcaggaaaatctcttgaaccagggaggcggaggttatggtgagccgagatcatgccactgcattcgagcctgggcaacagagcaagactcggtctcaaaaaaaaaataaaaataaatcgcgtttgaaaattctaatattggcatgttaaatacacataaacacatcactttattttctaataattgagattttattatctgctgaaaatattatgataaaaatctgaggccggtcacggtggctcacgcctgtaatcccagcactttgggaggctgaggcgggcggatcacctgaggtcagaagttcgagaccagcctgaccaacatggagaagcctcatctctactaaaaatacaaaattagccggccatggtggcacatgcctgtaaccccagctactcaggaggctgagattacaggtgtaagccaccatgtctggccaacatgttctattttctattagtgccaagctttaatttttttcattttcaggctgctcactttaaaactgatggcaaaagagctcccaacatgaaac

SEQ ID NO: 121651 - DNA, 285 bp, Homo sapiens
ctcagggctcaaagtgaacacgacaatctctgctgccgtggtagcctcttcttgcccttctctttgtctttctcatgcccacctgttccttgtctggggcattcacccttcctctgggttaagggactttggggcattccaaacatacctcaagaggcatgaggctggtggctgtacagtctcatcaccaccatctgctgcttgctcgagtccaagcatctgtgtcccacagttcctgtttcttgttcaaacttgcccaggtttatgccttaaatcaaaaccttc

SEQ ID NO: 121652 - DNA, 365 bp, Homo sapiens
catggatcctttttcattaaagaaataaaactagagataaagttgaagcatttttgatactatataaccatctctaatctgattttcctttttctttccctagagataattacaagctcaattcactgtttttatatttttattagatgtttgctttctcataaataatatagagcatttatgctatgggttttaattttacataagtgatattatactataaatatccctaaatagcttgcttttttctctcaaggttctatttttttttaattatactttaagttttagggtacatgtgcacaacgtgcaggttagttacatatgtatacatgtgccacgttgatgtgctgcacccattaact

SEQ ID NO: 121653 - DNA, 287 bp, Homo sapiens
gcaaacagttttctcaggattcttctctaagggcactaatccaattcatgaagggtttgccctcatgatccaatcacctcctaaaagtcccacctcttagtactatggtgctgaggattagtgttcaacatgtgaatttttggaggaaggacatattcagacctgagcaagccaggcctggcttgctcaggtctttcagcatttgcttgctttggtctgagtgaaagaattgtctcatttttttgagggccatgtacagcaaaggactcaccatctgtcagacacac

SEQ ID NO: 121654 - DNA, 228 bp, Homo sapiens
gggagccgatggtgtgcagcaggaagccatcccctccctgtggggaaacatgctgtcactctgctttgagcgccgtgcttacctgatacagggagaaagaacctcacctccttgcttttggtaaacgcctggttcaccttttctgcccctttcttttcagcctttctgcggaagctgtctcgtggacatctctcgtcaacagcacaaggctggattgttcaacgcaca

SEQ ID NO: 121655 - DNA, 733 bp, Homo sapiens
tcattcattaagaaggaggagtctagtatgctacttaggtgtttgctatgggaaaagacaaaataagtagactacaaaataacaaaaaattattaaaagaaaaatatttcaacttgattgcagcattaatcttttttactaattttttgtctttgttttgtttttatttgttttatttcctaaactcttagaagtgcaattcttgctcttagaagtacaattgatatttcaactaaaataatattgcagtgtgaatagattacaatgccaacatgtatcaaataattatgagatgaaaagtataagtgtctcctgatttattctaatagaacttgggatttatcacatggattttatcttttgcctttaaataaaatactagtaggtcaattagtcttttgaaatgtcaaagaaattcacctgagattggtattatagagtaggttgttcagatagaaatattcttctctaggcagcaaaagagcttattcttttgggaagcatccatccgtaaacatagttctccctctagtcagagttcagttcacatcaccagcaaactatgttctgaatgattgttctgagagacctccaatcatgcccagtttattaaattctctcaacttactgtattatataccatataccagtcatgtgcagtagtgaacaagatagaataaaaccctacccttggggagcatatagtctactgcagaaggatggaacaagatga

SEQ ID NO: 121656 - DNA, 234 bp, Homo sapiens
gcctgcgaaacagctgccctgctcgaggctggaggggaaaggtctgtggggagagagacaggagggaggccgttgctcacagacctcagaagcgatcatgagatttgtaacagagctcagcagcacaaatgggtccagacacacggctttagtaactgatcacctaaagcagaacctgcctcaccgtggcaggctctgtgcccccttttccagagcaaagggatcgtctagagt

SEQ ID NO: 121657 - DNA, 274 bp, Homo sapiens
ccagcaagctcttacaatctctccaaataccaataaacgcctccccttcctcgcaggagttccctagacttgtctatttcaggaacctcactgccttttaggaacctccttgaatctgcttggatgacgacacatcatccatccatccaacgaaacacacacacacacagacacatacatatgcacacaccccgactcaatggaggaccctcatttgtagaagggtaaaatgggtgaggcggaaatgcctgtatggcaccatggagttctgtgt

SEQ ID NO: 121658 - DNA, 249 bp, Homo sapiens
gggagggcccagaccgaagaaggtttggtggaaagcagaacctttgtctccctctaattgctcataagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccacctcctccaggtacccaacaggccccttctcctttcc

SEQ ID NO: 121659 - DNA, 450 bp, Homo sapiens
tttcaaggttggacaattcacctcattaagagatgaagaattttgacaggttcatgtgcatttaagactgtccagactaatctggatagctgagaagaattaaaataaatgctttaaaggaaaattttaatacaagaagatacaggttttttttaagaagcccaattccttggggcactttatactttcaaagctaataccaaggaaaatatattttgtattaacaatgaagataattaagtgggtgggaaggcacttggcagaaaaggcacttaaatgaagtaagcaaaggcagttttaaagaggtgactataacatgcgaaattcctatttttataagaaactgtgaggatgttgacagtagtattattcataatagccccaaacttgaaactacccaaatgcccactgacatgagaatgaacaagtaaattgtgtaaaagcacacag

SEQ ID NO: 121660 - DNA, 274 bp, Homo sapiens
tattttccttctttatgggactggcctttatctgaatgtactgctaatttatcattcaacaagacaggcccacagccaaacaaattctgattaaccatttcttgcttaacttgaaatttacattaaattcctataagtgtgcagataatacttcaatggtatatcgcagtcctcatatataagatttaagaaggcatactttaaatttttgtttattttctcgttttggtagtgtaaatgcttagaaccagcatttcaataaagaaggaaaata

SEQ ID NO: 121661 - DNA, 762 bp, Homo sapiens
gattacaggcgtgagtcaccacacctggcctcccctacattcttgaaggaaagcatttacttgttatttcttaaattatggttaaatacaggtaatataaagtttaccatcataaccattacgtttttttctttttgcatagaacatttcattgtcatgtacccattttaaagcataccagtgtcatcaagttttttcacagtgtgcaaccatcaccactatctagttctagaatttcatcaccccaaacaaactccatacctttgagaccagcctggccaacatgggaaaacgctgactttaccaaaaatacgaaaattaggcaggcgtggtggcgcacggccgtattcccagctacttgggaggctgaggcacaagaatctcttgaacctgggagctggagtgcagtggtgtgatctctgcttactgcaagctccgcctcctgggttcatgccattctcctgcctcagtctcccgagtacctgggactacaggtgcctgccaccacacctggctaattttttgtatttttagtagagatggggtttcaccgtgatagccaggatggtcttgatctcctgacctcgtgatccacccacctcgacctcccaaagtgctgggattacaggcgtgagccaccaaacccagctgatacagtgtgttttcttggtatatccatgttgtagcatgtattagtacttcattcctttttatggtcgactatttccttgtatggttaccacatttggttatcctatcagg

SEQ ID NO: 121662 - DNA, 387 bp, Homo sapiens
accctatcacatgagacatctctccacccccatcctgctcaccgaagcgctcaatgactactttccaccaacactgcactatacccccctgtgtgccccctttcatattctgatttgcaggctactggtccaccctgctggggtggtctttgttttttggggttttgtctcccttcacagttgacacaatccagaggacaggaagcatttctcttttctctcaatagcaccatccaactggctgaccagccataggtctccaagttcaggaaactggggtttggaaagaaatgctgagcatctcgaggggttggctatctagatgcagagcatactaggagtctccttccatcacaaggcattcagctgctctcttgggagtcccca

SEQ ID NO: 121663 - DNA, 285 bp, Homo sapiens
ctgagtggagccgagtgtgcacagagtaggaggcgggggaaccaaggtgaggcacgtttcacattgtccctctttgcctaggccatcccttcaatatgtacttcctcactgatcacttgaagtgtttgggtttcaaaactgaatagcacctgtttggtgttagccatggataatggggagaactctgggataaaggccttgtgagaagaggctacgttgttgttggtttttgtttgtttgcttgtttgtttttggcatgctgatttaaccattcagtaagcaagt

SEQ ID NO: 121664 - DNA, 692 bp, Homo sapiens
gggccctaacagcatatgaccccacttgctaatatactaatgacttgattccttcattattgttcattggactcagtattcctgaaattacaagactttgctcatagaagacaaaatgtatacacaaatagccatttaagaggatcttaatactatatggcatagtaaaaaaacaacaacaacaacaaaaaacatgggctttgtttcagatcccacttttgttactttctaacagtatagttttatgctagctactttaaaccttcttttcctcatttatcaaatgagaataatacctgtcttgtcagatagttataggatataatatatgacaattgtcctttctagcagatattaggcatttaataaatggcagctattatatgatgttatatacacatacccacaaagatatacagatatatagatatggaatttttatatagataaaagtgtttaaaggagacattcactagaattgtttacccataacagaaatatcagtgaggaagagaaagtcgtcaattcaaaaaaccaaagataaaatccaaagaatgtaagttgggagtacatgagaagttcagggtgaactctcttatccaattgcagtcaattagaatgacataaatgtaaagtaagaggtcttggttgtctatgtttagatcattttagggtcagaaagaaatctgaac

SEQ ID NO: 121665 - DNA, 379 bp, Homo sapiens
ggttataagacctttgttagtggtaaggccagtctggagcatggtctgagtcttagttcaggatcctctggaccttgaagagaatgaggtgatccccagaaggatctgggccttctgagctgagacgtcgcagcatactgcatgccacattccacatttctgagcaagagatcccttcttggaagggaagcagaaatgaggttggataaaagcctggccttttggggcaggtagacctaaattttgtctttatcggttaccagctatgagaccctggggaagttacttttttgtgcttcagtttcctcatctataaaatcagatgtccatgggtccacatcaaagggtgatgctgaccccatgagagagtgtgcataaa

SEQ ID NO: 121666 - DNA, 105 bp, Homo sapiens
agagagatttctattattaccatttttactattttcaagaatcttaggcccaaaagacattttggtcatttggtatgtagtacctgccttttgtttttgtttact

SEQ ID NO: 121667 - DNA, 100 bp, Homo sapiens
tctcactcacaggcaaggcccttacccagagcctaaaactctcagcttggaaataagcctaactcatctgattagtttcttagtgccactggagaaaagt

SEQ ID NO: 121668 - DNA, 521 bp, Homo sapiens
gaaatctgacaagagaaggaaagttagggttgaactaagggctcttctgctgataagctgtcccttcagaacgggattttttttttccagaaatctgacaagagaaggaaacttaagaatctaggttagaaactgaatagactcttgggtctcttgaaggggtagagtggatcaagagaaagaagcactgggttctaacccaactctgagtaacttctatcactagacttctctgggcttcagtttccttacgtgtggagtaggtagaataatccatgccccagagggtcacagggcagggaacccacaggtagtaacgttgttttgtgaagaaccaatgcaatatgaacacagcgacgctaaacagctaaacctataatggattaaatcagataccggccagcttctaggcagacaagccaaagattggtaccaaagattttttaaagagacttttcacttaaactcctctctattatttgaatatttttataacttttataaatgaacatatttcgtat

SEQ ID NO: 121669 - DNA, 251 bp, Homo sapiens
tctctgaaacaattttcaatatgcttattgaacaaaatccacgtataaataaacccatgcaattcaaacccaaactgtgttgttcaagggtggctgtacaaacttcgctgctagcttttaagtgtacaaatagctgcataaataaccgatgtgcatcatgaccagtcatgtcacttctttcaaagtctgttggtgatagttccctgcaaatctgttcagtttatgcaaagtgtgtagttgtgttgcttcct

SEQ ID NO: 121670 - DNA, 982 bp, Homo sapiens
tttacggtgaagctgagcatggatgttaatctcccactctgtctgcactaagccaggtagtggatgtgtggcaaaattcgtattcatgttcaggctgcaccctctgatcctaaggagatagctgctggatgtgaacccatcgtatgtccatctgtttgctttttgttgtctagggtcactaaggaatgcaaagcttcattaactctcagagagagtttgttaagaaggtagcctcttgggtgtgagtatagaagttgtggcacacagtgcatggccaaacttcttccaggaagaatgttaggcctgggatgagccagagaaaaggcttaggaactgccaagctctggctgcagctgccagtgggctattgtttgtttgccccattggctccccagtgcaagtttattagaactcaagctgtcaagtagccactgggagtgtgtgccatacaccccttgtggagagaaaatgggagctgcatattcctgcccctttttcacactactcaaagggggcatcatttgtaaacatgtttgcatacctgttaagaccacgtctttgttctgtcatctaaggagactcatgtatgcctagtgctttctcctcccagagctaagaagtttaggactgggttctttgggagggcgctgtaaaagttgtgacacttgattagtggcacaaacgtcttccagggagaaacagggagttgcattttattttctgacatggagtcttgatgtgttgcctaggctggcctcaaactcctatgctcaagtgatcttctcatttaagccttagctgggactacaggcacatgacaccacacctggaaggagcttcattttaaaaataaaattttagattcaggggatacatatgcagtttgttaacatggatatattgtatgatgctgaggtttaggcttcaattgatcctatcacccagatagtaaatatagaacccaataaatagtttttcaacc

SEQ ID NO: 121671 - DNA, 1047 bp, Homo sapiens
tttatcgtatgcaattcaaataaagccatggttattcagttacaggaaatgtttccatgttgaaatgcaagcccaggccgggcgcggtggctcacgcctgtaatcccagcactttgggaggctgagatgggtggcatcgataaacaccggtgtttatcgagggcagatcaggtcgactggaagactattcaaagatgtattcagaaaagggatgagccagtctttgattttctcaattgatttgaaaaaaaactgtcagacagaattcaggcatcaaggatttaaacaatcacagccaagcgtttcaatttgctttttctttcacagctcaaagagacccttagaactctagttcaacaacaagatgctgactggacctctagaaggccgcatgaattggcatccatatctgatcgcctctcaaaaagaatagaaaaggagaaagatattcaggcagcgaggacattcaaatgtcaggaagaaacagcaaaactcatggccccacacataaagcagctcaggagccttctgccaaatagcaggcccaatctaaggagcaaaagacacatcagtgcctgataccaaagaatgctctttattatttttgcaaggaagctggtcactttaaatgggattgtaataaatacaaaaaacagctcctaaagaataatcctgattgagctagaagaaacccattatttccccaaagcagactgacactagaccagttccttacttcattacaagaataggggtactgtggggagacaaggggaattttccctctaacaaattaatttaattgggagaaactgatctttaataattgaacagtctgagccctaatagatactgggggccatgctttcagtacttaactccaactcttttatacatccccatccaggagtaaccaaaccatataaacggtcagggtcactcatcaacctatgaccacttttaagtcagcactgatcactgatctgctgggtccccttgtaagtatcacagtatcttgcttgttccgctgcttctatctatctgata

SEQ ID NO: 121672 - DNA, 464 bp, Homo sapiens
ccacatcacagggctgctgtgagccttacatgaaagacgcaggaaagctgctcaccacattgctcgggagtttaaggattgagtaagtgaagctgctattatgatgctaatgatggtaccatcttcagaataatcctcaacagcagatagtgatttcctaagagctgagtgtgggagggcacgggcctctctgaccctcttcagggacggccagccactgagcacacaggagggaggctggcctgaagagcctttctagaagtgtgttcagatgttaataacctcagcaacaaaaaaaggcactgtggtccatgaagtctgggaaatgctggcttaccccaagttaaacaggctcctttgtgcaggacttatcagagcctttatttgacccaacaagcgtcttgactctctagaaatggaggcagagtacacactcgttcctaaacttctctgctgagcaactg

SEQ ID NO: 121673 - DNA, 142 bp, Homo sapiens
aaagatttaggggagtgagagtcaggatccacaaggaagttgtatgttatgttcaacaacctaagagcaatgacagaatgacagcccggataattaagatgccgttgaatatactcccattaacacattggggccagagctg

SEQ ID NO: 121674 - DNA, 383 bp, Homo sapiens
tttttttttttaaacaatgaagcaagcaatgtaaggaagaaaaaagcttggcacatggtatgtactaacaaaatgtgaaacagcagacagggcagttatttcagaaactgtctacctaagaaacattttgaatgttctgcaagatttagatagatgaattaaacatctgtaatcaatgtggccatgagtaaactacacaaaaagttgttctatatttttccacattttatccaaatgtatgctatcatatattgaaagctattaaggctgaaatcaaatagactaggtctcatactccacaatttccattttctaagagtggtaatatctctaaatggctttggtgatactaccagtctttcagagtggcagcaccgtgacga

SEQ ID NO: 121675 - DNA, 790 bp, Homo sapiens
agtccatgcaacagtgatatacaatggtgtggtttgctgtgctgtgctgtgggggcgagtgggagggtactggggaagaccttgcctgctcacgaatcttgaagacgtttggaccagaggacacaagtgatgggctattttggtttttaaagtttctttaggcattaatagcaagtatacttggcctggttggaaaacagtgcagctcatgcagattgagctatggattttcacccattctttgtttaccttaacataaagctagaaagctccattctatagatttaagatgaaccatcctaatctacagatttatcaaatgtaaaccatcctagacctccctccctccaatctttaaacgtgtatttttattttagaaactctaagccttgatttctccaaaagcctccttgtttaagagacaaggtcttactctgttgcccagggtggagtacagtggtgcaatcatagctcactgtagccttaacctcctgggctcaagcgatcctcctatctcagcctcccaaagagctggaactactggtgtgtgccactatgcccagctaatttatttttttatattttttttgtagggacgggggtctcgctatgttgcccaggctggtctcaaactcctggcctcaagtgatcctcctgcctcagcctcccaaagcattgaggttacaggtgtgagccactgttctcggtccccaaaagtcttctttccttttacacagatttcacaaatatatgtgctataaatatgtgtgctatgagaaggcataatatt

SEQ ID NO: 121676 - DNA, 335 bp, Homo sapiens
tgggagggcttcctctgggaggtggcatttcaggcaggcttggtgagagttggtagcctatttggcaacctttataaaggtgagtgtttccaatgtagcaagaagtctgaaagaaggcgagaaacagagagagccaatcagaatccctagagaggagatggggtgaagggggctcattcattcacgcatcctgcatccattcaggcacctctggagcctactgagttctggggatataaaaaatggatgcgacacagtcccaggtctccaagtgtaatgatggagtaccttgaagccaaatgtgtgggagttctgttttggggctaatagtggtg

SEQ ID NO: 121677 - DNA, 546 bp, Homo sapiens
  misc_feature (200)..(201): n is a, c, g, or t
caggcatgagccaccgtgtctggcctagaaactattttaatagaagcaagtagtgcccgaatggttggcatttgttagtgagatggtgaactggcagacggcacctgtgggtcaatgcccatggccaccgtcctgctttcggacaccagttctcttccaggtaaccttctggcattttggggaggattgtttgagcccannagtttgagaccagccagggcaacatggcaaaaccccatgtgtacaaaggattaaaaaattagccagatgcactggcacatggctggggtcccagctacccatgaggctgagttgggaggatcatctgaccctgggaggttgaagcttgcaatgagctatgattgccactgtactctatactacaacctgggtgacatagtgaaaccctgtctaacaaacaaatgaggaacgaaaatagctaggagacagtcagagcagatcttgggcttatgcggctcatatcaccccttaataactggcctgagaagagggtttatctacttgtgcaagtggcccaaaaatctg

SEQ ID NO: 121678 - DNA, 648 bp, Homo sapiens
agggaagctgatggcattctgacacctcttcgccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtcctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggat

SEQ ID NO: 121679 - DNA, 384 bp, Homo sapiens
agggaagctgatggcattctgacacctcttcgccaagaaaagcattgacacagggatgggcctggaacgactggtatctgtgctgcagaataagatgtccaactatgacactgacctttttgtcccttactttgaagccattcagaagggcacaggtgcccgaccatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatcttggaatgcaaacagatctggcaaaattttggggctggatgacaaccaaat

SEQ ID NO: 121680 - DNA, 262 bp, Homo sapiens
attgccgctcatccccctgtgtctctgtgatgacatctctgtgaattctcatcctctgtatgtgtgtgaaatacccagtgaattgtaaatatacataagtattcttctagttccttcccaggccatctgcactccatgcttctgtgtgtcagaagtggagtttgtttcttttaaggtcctgattacctggttctacccttttcttttctttctttcgttttttttttttttctttttctctagagacaaggtcccattattt

SEQ ID NO: 121681 - DNA, 552 bp, Homo sapiens
ttcactccctcttcctcaatcttccaaaccccactcaaatgttgcctcctctgtgaaacttcccaacatcctgaggttgagaagacctctctgccaccgtactctgctgcaccttgtatcctgacttttatcttttggaatggcatgttttagttacatgattgttctcgacaatgtgagctcaccgaaagcaatggctgacccagcatgtaaatgatgaatcctaaaggcatgctgagttccttcagtaagcaagtacatgttaaatgcctaccagagaccaacaatgtcctaagtgccaaggatactgcagtgggaaaagaaaacaaaactctgctttcatggtgcttccacaaataaacaccaggctgatataagtactacaaagaggaactggctgggcgtggtggctcacacctgtaatcccagcactttgggaggctgactcgggagaatcgctttgaacccgggaggtggaggttgcagtgagctgagatcgtgccactgcactccagcctggtgtccggaagagacccggaaagccgaattctg

SEQ ID NO: 121682 - DNA, 334 bp, Homo sapiens
tttttgtgagacacagtcttgctctgttgcccaggctggagggcagtgtctcgatcttgactcactgcagctgatgcctcctgggttcaagcgattctcccacctcagcctccaagcagctgggattacaaacatgaaccaccatgcctggctaatttttgtgtttttagtagagacggggttttgccatgttggccagattggtcccgaacacctgacctcaggtgatccacccgccttggcctcccaaagtgctcagattacagacgtcagcactgtgtctgaccagctcccatggtcttgagtcttggcacccacacatttttttttctga

SEQ ID NO: 121683 - DNA, 402 bp, Homo sapiens
cccaggctggagtgcagtggtacaatctcagctcactgcaacctccacctcctaggttccgcctccttggttcaagtgattctcctgcctcagcctaccgagtagctgggattacaggcacatgccaccaagcctggctaatttttgtatttttagtagagatggggtttctccatattggccaggctggtcttgaacacctgatctcaagtgatccatccgcctcggtctcccaaagtgatgggattacaggtgtgagccaccacacccagccaaatgtaggcagtttctataacccttactgcttaggagtcatgtgccagaagtcacaatatctgtggcttccccaattgtttctacagataacatctcctatagatagtttgagcccaagagatcaag

SEQ ID NO: 121684 - DNA, 464 bp, Homo sapiens
tgagtgaaacaggattgggaagcagaagaaactgagatgagcaaaggtgtgatttcaggggatatccagcttcacttgatccagcaggaaacttgggaacaaaattgcactacagagtgagtctgtcttgccttgaggcaatgaaactgggcttttgtacccccttccttgtatttgttagttattagctgtcagctgccctggaagtatgttgtgtgagtaaacagagaagagggctaggaggtagcttatattgcttccaaagaaagttactggtgtgaaccattagaagcaatggaagaaacacctggggaattggtgtaccaaaccattagaagggttccaggagatctaagctgggcacagacaacagcacgtgctatgggattctatccagactaatccctctgctcagaaggtcgtgttctttgtaatcgagtcctcctcacattgtcctctccaga

SEQ ID NO: 121685 - DNA, 715 bp, Homo sapiens
agagtcattcttgagtgcttgccatgatgagggcaggcgctaatggggaaggaattgtctcaagagctcctactaaagtcattgaccatagcatgcaggtgctatggaagtgcccagggtggcagtctaactagtttcagggagacagagaggactttccagaagagatgtcatctaagacctgaaaaataaatttggatggaggagtgtgaggaggagatgggaaatgactgttcagacaggcacagcagaatctgctctaagaactaaaagtatttctatttcactggaaggtgtaggagaatgggggtcctgcaatacgattgcatttgccttttttccttgtgttgacatttgcactaatgatgcaaaagcagtggtgggtaaaactgctggcactttagcatgaatcaatgcagtggctccaaaccgtagtcattttattcttcattgccacaaagtatctgcagtgaaaaaaatgcggtttcatttgtagaagcaataacattatttttattaaatctccacccttgagtactcacgagtttttattatgcatgatgaaatgggaagtacatagatagaacttttgtcacataccaaagcatgatggttatctctaagaaaagcacttgtgcagttgttttacttgcaagctgaactcaccactttcatagaaaaccatttttacctaaaagaatgacatacaaatatg

SEQ ID NO: 121686 - DNA, 408 bp, Homo sapiens
aaaatgtgtcaacccttattctagattacaagacatttagaaaagcttgagatgtaggaaccaaataggagtacaacttgtttagataccaattagaacaactgcactatatatttttacccaatagggaaaatttttattatggagtagttattagatgatattaaccaattattgttaattttgtaatattatagttttgtatggaagtgattttttttttatttctatcttttatagagacatggtcttgcactgtcacccaggctggagtgcagtggtgcggtctcggctcaccgcaagctcctcctcccgggttcacgccattctcctgcctcagcctcccgagtagctggggctacaggcgcccgccaccacgccaccacgctaccacggtgctatcacggg

SEQ ID NO: 121687 - DNA, 412 bp, Homo sapiens
tgattctttggggatgtctttgctagtgtatcatatagctattgctatgcaagcaccccaagacttagtgggcttaagacagcatcatgttatgaaaatcatgcattttcatctttaataagaagggtttggaataaaagaaggaatactgactattcctcctgaatattggatgatctggggtgtgcctcactgtgtgtcagctcactggcttgcttgcttctgcctgggcagtggccttgccaggggcatcttttctgagcagggctgctccatgcatctctccttctctgcctcctgggacttggaggcatggtccttgcatggccatgacaagcgcatgcaagctctcctgagacctaagctcagaacaggccctggaacttccccctcatttctgtggctccaagca

SEQ ID NO: 121688 - DNA, 137 bp, Homo sapiens
gcccatctcaaatccattaagccctacctagaatacagacataggagagaagggaaatacactcacaccaaactagtcttgcagttcaagtttctctctaagaaaaagcaagtaagaatgagcctgctaagtaaggg

SEQ ID NO: 121689 - DNA, 418 bp, Homo sapiens
gggatcgagatgagtacacaggaaacaccgaataaaccagggaagacagaaacaacaaagaggcccagagattaaaagctccagcggctgggcagcgggggctcacgccatacaagccaccgcacctggcctattttttttagagtaagggtctcactctcactctgtcactcaggctggagtgtagtggtgtgtccatggctcactgcagcctcgaactcctcagctcaagtaatcctcccgcttcagcctcccaagtagctgggactataagcgtgagccactatgtacaggtaagttttttatttttgtagagacgggatctcgctatgttgccaaggctttttcatgttatgctacataagatcatgaaagtgtaaagctagaaggaatcttggttcaatcctgtcatttggtg

SEQ ID NO: 121690 - DNA, 670 bp, Homo sapiens
ggtgtaattttaatgagtagcctttataaggaaactagaatctgatcacttggagctacagaaaaaaatagcataaaattttggcttaaaataagtttgtagtctagtgttcacatagatacttaagagctccagaggtcacatgggcttaaagtattgggaagcactgtggttgaaatcaatcaaatgaaaataaattttttgaattcatatttctgggaaaagctatagtataaaatacactactagtatggtagtcagcattaaatgggcaaggcatgtctttgaaaataggcttgaagaaatatgaccctttttgatgggaaaaacaataaaactgtttaaacaataaccatgtagatgagagcaaagagtgctgtgatttatgaaagtggctttatagcttctcttacttccccaatcctgcccattcccaaaccgttttatactataagcataatggtctctatgaaatgtaaatttaatcataacactcttctgtttaagttactatcagaatatctggttatcctagttttatatttagaagtctgtaatgtttcacccacatttacgaaattcacacacttccgaaaatattcgtagtaagcttgtaaaagcttgacagtaaaaactgaattgacagaaggttagcttttttcccatctca

SEQ ID NO: 121691 - DNA, 241 bp, Homo sapiens
cttccagttagtgggaaatgggatcttaccatttcgtttgcattccagttagcagaaagcgggagcggcaggggagtggaaaaggacttctgccctgctaaggagacttctgctttcaccttactgcccagaccatcatgtggcatccccggctgcaagagcatctgagaaatgtaagtgggagccatgaatcccaccccacagcaggaggcgaatgggagcaggcgaaatgcgaactgct

SEQ ID NO: 121692 - DNA, 455 bp, Homo sapiens
cttttcccctcacctcggttgaggcctccatggtttggacttgctggttttgccttgctcttcccttgataaatacaccatttattccggttcagcccttggaactttaaaccttaacccaagcctcctccaccccactatattagcccaagcctagagtatcagatctggatatttgggtaaagatgcagacaaattttgagttggaaaagaaagaacttaactcattactaaaagatgaccttgatagctatatatatgggaaactcagagatggaatgacatgcaccaggtgtagtgtgagcaaaggatgaacttcctgatacatcctggtttcccatatatatagctatcaaggtcatcttttagtaatgagttcaacgagggtcctcagcttcatcaatcaccaggtcatgaatcgatatcattttattattataattattttggagatg

SEQ ID NO: 121693 - DNA, 366 bp, Homo sapiens
actgcaagtcctaactccagttttcaagtgttctgaccatgagaatcatccggggtcaacccgccctgaagagggcaccagggaagatacctccaacataaccaggtcttggttaccccccaccccacagggttgacctcttctgcaggctggtactcagggtgccacctgcttcagtgacacttaaatacttaaatgaacatagatgctagaagccactctgaagttgaggagggcctgcctcatacaccagagacttataatattgcctcctaagaaacctattttccagtcttttgagaagaagatgcatgtgcatcatgatgactttggtggagaataacttttgataaagaggactccttt

SEQ ID NO: 121694 - DNA, 387 bp, Homo sapiens
cacaatgctaggaggtaattactattacaattacttttccagattactaattgagtcttagagagcttaagtaatttgccaaaagtcacggagctaacaaaaggcagaatctggattttaaccttggtctgcgtgactactctgtttgtagccaatacttccttcctttttcagaaaaatttattgtaaaaaaaaaaaaaaaaaaaacaacacattaagttaccacaattaaaataaataagaaagaaactaaacagctccttaaagcattttgacaaggtctaacattaaaggatttgtcaatttaaggtcatcttaggaagaaatcttcctgggaattcagggtagactgaatggacgtgtcttgcagcagataccagtgcattg

SEQ ID NO: 121695 - DNA, 270 bp, Homo sapiens
aggacactggcaatgcctcactgcccttcagctttctagattttcctcagccctctgacgggagcctctgttcatccttggtggtttagactctacccacaacaagaatgcggattcctgttaggatggcttaatgcttgtgcttctgcaggaccaaatctgagaacccccaagtggcatcaggaccctctaaacccacccatatagttccatatgctgcccttctcatgctggtctctttgcagagtgtgcgtgtcctctcactgacaa

SEQ ID NO: 121696 - DNA, 562 bp, Homo sapiens
tgtcaggggcgtggctgggaactggaacctcctgaagaccagtggaggccacaagcagaagccctcggctccttcccttccccgatgctgggggccaagggtctttctctgaccctgtccccctctcacgttaccagtggagggtgtccaggttcttggcattttgaacaaagaattggacaaaacacacaaacaaagcaaggaaagaatgaagcaacaaaagcagaaatttattgaaaatgaaagcactctttacagggtgggagcgggctgagcaagcagctcaagggccccggttacagaattttctagtgtttcaatatcctctagcggtttaccattggttacttggtgtatgccctatgtaaatgaagaggatgaagtcaaagtcattttctcggctgagcatactgtcacgcctgtaatcccagtactttgggaggctgaggtgggtgtatcacctgaggtcgggagttcaagaccagcctgatgaacatggagaaaccccgtctctactaaaaatacaaaattagctgggtgtggtggcgggtgcctgtaatcc

SEQ ID NO: 121697 - DNA, 225 bp, Homo sapiens
cctggacaggacaccattccatcacagggcacactcatacacacacccccacactcattatgagacaactgatacacaccagtgaacctaatgtgtacatctttagaatgtgggaagaaaccacagagtacccagagaaaaccccatgcagacatggggagaacatacaaatcccatacagacagtggccccagcaaggaattgtttttttttctcttcctcatg

SEQ ID NO: 121698 - DNA, 383 bp, Homo sapiens
cctttccccactctgctttcatggacagaccctaatgaccacctgggttatgtttttgtccctgtcaattcctttgtccttgctgataacctaagggaaccttgagagccagaacgagacaggaagaaaatgcctggctgctgcttgcggggttaattaaaccattcctggggtttcatttgctctctagttagcaccaaaataaatcctccaaatggctttgagccttccagttgacattgcattttgaattctgacagcaccagcattttacatcttcctgaggatgataaatgtttagatagcaccgaagataatggtaaaaggagaaactgggggtagttcaggctgtggctgagcagattgtaactctttggtgtgac

SEQ ID NO: 121699 - DNA, 474 bp, Homo sapiens
tttggaactgtaactgagcggctgttctgttcaggagatggccttcctcctggaggcagcaggactggcaggagctttgtgaaggaaagtacggtccccgccctctgcagcttagatgctcaagacaagtgatcggtgagccctaggcctgctctccctctaggccactgctgggccttctgccccctgggcagcctagcatgcgtgctggggaaccgctgcaggtgtgtgggtgcagagacgggcaggtacctacccacctgtatggaacagctgccacgtcactatttacctatggcaggtactccgagcaagagcaattggagagatgctagcttcaaagacagaaacagcactgtcactgggaactttctcgatcactgtcctgtggtgtggacaagaacatccttattcttcataaacccacactgaattatttagggtaaaggggcacaatgtcttcaattttcaaat

SEQ ID NO: 121700 - DNA, 462 bp, Homo sapiens
gctgttttgtcactcaataaagcactccttcaccttgctcaccctccacttgtccgcatacctcattcttcctggatgtgggacaaaaactcaggacccgctaaatggcggagctgaaagggctgtaacacaaacagggctgaaacacaccccttgtttgccccatggagggcaacgagagggaaagagaggaaagagaaggagagaagagctgtggcccttcaaggagcccagacctaggagctccctgagccagggctatggctcactctttggggctctgcagtccctggcgtctccaagcttccaggcaccaccacattccctggtgccaccaatggaagctgcttgcagtatgcctggtccagcagcagccttgtagggagctgatgcctggagctgcccgtcctgccacagctggcgtgcctgactgtgcgctgtggccagactccacactcactc

SEQ ID NO: 121701 - DNA, 417 bp, Homo sapiens
cttaattaatctgcacagccactttgccatgtaaagtaacatattcgtgggcatgaaaccagggggtgaaggtcatgtggctttgagagcagcactctcggtgacacatactcaattctgctcctccagtgcaaaagcagccactgacaatatgcaaaggaatacatgcagccacaacatggaagaaatacgtgcatcaacaacacatagcagcgtgtgtatgtatgtgcgtaaaggccttggaacacagctgaagaatacttttcaaatccttcactgttatttcctctagggaagagagtggaggccgaggctgggaatccaggagctgttcccattttattctgcatacttccctatcttctgatgacttcacaatgtaaccattaagaaaaataaaaattgctcatgcattta

SEQ ID NO: 121702 - DNA, 894 bp, Homo sapiens
ctgcacagtcattatcagttgagatactaacaacactatatacagttccactcaccaatctatcgtgcataacattggagtagatctttctgtgttgcaattttgatcatgtcacttccaacataaggtcactcagtgatcctcctcccagggcctacagagcaagtttaatctccttggtattgttgaaatgtgggtttggggcttttttaacctgctgcatacctccctgttttaagtcttctaaaataaacttcccatcaattactctatatgccaccacatacaataaatttgtaattcatcagccttgccatatgtataaaaatgtgtgctctcaacgcatgaggattcctcttcttgaaatgccctttttcttcagctatgtacatagttttgtcaaattctaacacattctttgcagctcagatttcatttatttttctttgagaagcagttattcccattagtatttaattattattttgctttgcttttttttttaaatcacaacttgtaaatactcatgctataatattcattccattctccctctggctaatgggcttgaagtgaacagacactatgtcttacttgtgcctctgtttccagctgctagctcagttcccaatgcattacagttggttggcaaatataaagacaaatgaacattattgttcatctcctcattttattaaaaaggcaaaaatggataaaaagattaaaggtataagtaagcaaaatgaagtaactcattattcaattatatcgcacagatctatctgtgattaacattttgatgcatatgcaagcattcacttatgcaaagcctacacaggaaaaaaaaagtagcttacaagacattcataaaatctgtttaattcagtaatgata

SEQ ID NO: 121703 - DNA, 295 bp, Homo sapiens
gggtgcagctgagaggcctgatggacgggccgcagtgggggaggaaggttccggaaccaacacaaccttcaccagaggggccaagggtgcatctgcttcttctgacggggcagctgggtgactacatgcagctttggggccacagtgtcaaggacacagggagtgagcccaatgggagcctttgacgtaaaaacactggcccctgtgcaggccctcccctctcctcggtgtctccaacaccacatggagctgggctccccaggcgtctctgaccgagggcgtctgcagcccccac

SEQ ID NO: 121704 - DNA, 557 bp, Homo sapiens
acggaatccagcgtggaagctcaagaatgatactgatcatgtgtggacacgagcaagctgctctcctgattcagatatcacaagggaaccccattttatgctgtcttggcaagacaaagaaaatccaagttgtgcatggcagtaaaggggagcctggaagcatctctggcagttcctttctttcccaattctgaagtgggaaaaagtgagaaagaagagaaagtggaagtaatgatgaaacaaatgtgcaaagactgacccttactgatgtgcatcaatgaaaggaggacaaagcaggcttctacctcctcttctttttgtattttctttcctctcttctcagtttttcctatttctatttttctttctcttcataagctttcttctcagtttttacactcccacattacatttcatcttggtctttgtttttcttccaatcctgtaatttatttggtacccaggggatatatctcaggaaatctgttaccctatgtctctttgctgtctagttatttgacaatgtttccttctctaataaagttttctccttcttt

SEQ ID NO: 121705 - DNA, 1180 bp, Homo sapiens
caagttaattgttttctaagtctaggtacttttgtatcaaagtctaggtacttttctcatctaaaagtgtctcagaacagacatgatttaaatgtatgaattttttggtaattgattaaaggaaagctttcaataatttctaatagttttgaaaatgattaaaagcaaaacataatttattgtccattcctgtatgacataatgaaaataataggaaaataaatggaactacaaaacatactaagaaacgcagtttatcagacgataatagtttgagatgtttaattacagatgcaagaaacagtacagatattagcaagaaccagaaattatatgttcttatatatgggcatactttaatatacattgtctacagctataatattttctaaaactggacattttgttacaaaaaaggaataatttaaaataagactgtcatcatggccggacgtggtggctcacgcctgtaattttagcattttgggaggccaagatggaaggattgcctgaggacaggagttcgagaccagcctggtcaacataatgagacttcatctcatttaaaaaaaaaaaaaaaagaagaagacatcctatttgatgtggaaacaaatgcttttatcctagaggctttgttttatgtatgttatattgatattgctataattgtatataggatgatgtttttacaagttaccttctcctggaaaaatatcatacatcttttgatttagaaaggaaaaatattgaataatacatcagattagcttttattatttacgtttattattattgaaaatatcagcttacagtatctcctgaagccattgggaaagttgctgaggcagcaggagtggggagacaagatgggaacattaagcatgagacgtttggcttttaacctcacatcaccattcacttaactctgtccttgaatttattgtttggcatttgtcagtggtctgagagaaaggtattaaatattgttgtctagatagtcttaaatccataagtgtatttcatgacataaagatgacattttaaaatgtatatatgggccaggtgcggtggctcactcctgtaatcccagcactttgggaggccaaggtgggtggatcacttgaggtcaggagttcaagaccagcctgatcaacatggtgaaaccctgtctccactggga

SEQ ID NO: 121706 - DNA, 737 bp, Homo sapiens
gctcacagcatggctgccttgggtactcggacttcacgtggaaggccagggctccgagagcaaatgccccagcaagacagaagctcagccgcctttgatgacctagaagctaggcagcatccattgtactgccttctatgggttgtgagtgagtcccaaacctgccttgactcaaggaaacggaattaggctctacgtcttgactaggtagtggcgaagttctggaagcacatgagtaggagatactgtgacggtttcatctttggaaaataccatctagcacacctgaatctgctttcagggggtgtaaggggatttccatggcaaaatttgaagccacatgtggtcactgctttgtactgaggaaacaaagtgctctgggcatccagaaagggggtacgttttttcttactgggataaatctggctgcattttagctaatcctggaaaattgatcgacaaaagcaaaggaccaagaaagctgcttatatcagtgtctcctccaccctcagcctccagtagcatccctacgttttacaattttatttatgtcactttaaataaggacattgagagggaaaaggcctcatcgacataccaactacaggccaggtggaccttcggtgcacacacaccccagcgcccacagagatccaggcctcctgtgtatgaatgtgtgccatgaatttagacctatttctcgccttccgggctctctattcctcatcctccatcca

SEQ ID NO: 121707 - DNA, 954 bp, Homo sapiens
gtaattatttaaatggagtcagtgtgagtataaatgtgacaactatttcttcacttaaaatgccaagggaaggaggatggtaagcagtgggaatttttccttctaaagagcttttttggttttgttttgtttcaattatttagattaaaaggttagaattatgtattactgtggacaaaattacaaatcactgtaatacaatacatgtgtgattggttaggttttacttatttgtgttgaattttataatattcattagtcatttgcacttgtctgcatataaaccgtcatcttaaagtggacatctaaattccaaaaactttatctcccatctgtggttctaagtttgcctcaccagacgctactctacaaaatgtagggcatttctcctactgccacctataaatagcacaggagcggccatatgtgctgctggaaccaggctttctcacagagagccctgggcacattccagaagtgagtccttctgctaacctagcaccactcagtcccaaacatgaagtgtcccgttaatgccctgccagtacagggtatcccagctccagcaggcctttacgaagaaaaaggcaatcacactaccacaaaaactgagaacctcctacctctggacttcctgcagtgcttgttaaaactaccgattctggggctcccttcagaattcttgaggtgggtccaggaatccgcatccctgaccacttccgcaggtagttttcatgcatgcaagctcaagtttgagaagcgccaatgtggaggtattttgctcaacagtctcctggcagatctgctgccagctttgtggggcattagctgtttaccagatgatttgctgttttgaaattgaaaaaaagaaaagattcacaaaactactcctagaatatcaatcttccagctggatcacagttttctgtcttgggacttcagggtctctcacaa

SEQ ID NO: 121708 - DNA, 525 bp, Homo sapiens
cagtatttgatgtaatttgttattcctccttttttaatattcttccttcatttgattcttgaggacaccacacactgttgccttcccttctataccgctggccttctggtttcttttcagttgtttttaaatttgtgttggttttctcttctcaccagcctatgaatttagaatgtgccaaggctcagttctcacccgcctgttgtcacaaatagtcacagggctttaataaaatactgtgtagctacttaagactcctaaatgtatatttccacctcagacatctccaactacttttttgacttcttaacgtgaatatgtgaaagacgcttcagcctaaatatggccagaacaaaatttctgatctttctctgcaaacctgctccatctgcagcctgccccattttattaggttggtgcaaaagtaattgtggttttttgcattaatggcaaattacttttgcaccaacctagtgggtgttagctccatttttttcatgttatttaagcaaaaaaaaaaaaaaa

SEQ ID NO: 121709 - DNA, 460 bp, Homo sapiens
cagtatttgatgtaatttgttattcctccttttttaatattcttccttcatttgattcttgaggacaccacacactgttgccttcccttctataccgctggccttctggtttcttttcagttgtttttaaatttgtgttggttttctcttctcaccagcctatgaatttagaatgtgccaaggctcagttctcacccgcctgttgtcacaaatagtcacagggctttaataaaatactgtgtagctacttaagactcctaaatgtatatttccacctcagacatctccaactacttttttgacttcttaacgtgaatatgtgaaagacgcttcagcctaaatatggccagaacaaaatttctgatctttctctgcaaacctgctccatctgcagcctgcaccaacctagtgggtgttagctccatttttttcatgttatttaagcaaaaaaaaaaaaaaa

SEQ ID NO: 121710 - DNA, 544 bp, Homo sapiens
tggctagtcttctgaaatgcctagtcatttacaagtcatttctatgtgtgattgtattagctgtaacaaatggctacaaattgcttgaagaacagaaatgtgttatagttctggaggtggaagtccaaaatcaaggtattggcaagattggttccttctgagggctgtgagggaaggatctgctccagacccctgtctttggcttgtaggtgaccattttctccatctctcttccctctatgcatgtctaccaccgtgtgtacatttccatttttttaaggacaccagtcactgaattaggacctacccatataagcgcatctcaactaattgcgtctgtagcaaatctgtttccaaacaaggtcacattctgagattctagggaatctgagacttcaacatagaggtgtcccatagaggatggggacacctcaacccgtaacagtaatgatgactgcacattatgagagggactaataagatagtgtgcattggtataaaacatgtacccagagggttctctgtttaactttcaatggcataa

SEQ ID NO: 121711 - DNA, 513 bp, Homo sapiens
tctctgtccgtctgtgtgtgcgtgcgcctcgggacacatgtgccctgtgcgccggagtgtgggtttcttgcacgtcggcctttcttctggtcagcctctccccgcgtctctgcctgggtcgtgtggccggttggcagtcgtcgtcccggcggttccagtttgggggtctgtgaaggcctgggcaacgtgggcatcggcgtcggacccgcaggggttttcatcccctccccatccggagcagcctctttgctaggctggatccagacgagcgctccccaaccaaggacaacggcctcccaggcgctcatcgtccacccgcaggagggtgcccgcagagcttcaagaaggtggttgtcacgcctgtcgccctctgccctcatcgagaaatgtagccacagctcgacgcagggacggagaaggaagccggcaaggggatggggcaagcatgtctgtctctcaaaggctggccttcctggccgagtcacccgtttgacactcctccccggatgccgg

SEQ ID NO: 121712 - DNA, 344 bp, Homo sapiens
cagtcccctgaggttctgctcttctagagttgatggtagatttcactttgcacgtgaatcatctcagcctttgaaattaagttctgctgtgggggccctctccacagtcacctctaagactgcatttattcatttatatttattccttcaacacatgtgccaggcactatgctaggtgctgtgtgtcagatgacactgtatatcctgtttcctttacgacagtaggcctttgacagatttctgttttctcctgtggggcagaccagcgctgtctttgaattctgctttttaaaatgcactggatgtcaaccagatttaaccagatgggcttctccacctaaaag

SEQ ID NO: 121713 - DNA, 475 bp, Homo sapiens
ggactgagcttgacagaggtcctgcttccatgaaactttcaattccaagtcactgtgttctctgggcctcagtgtccccatctgtaacaaagatattggactagatctggctttcccaagctgtggcacagaggagagttttgtaagaaagatgacgaggcattgaaaaccatgggctgcagagcaggaaattattctcttcccaattctcattcaatcatttctgatttggacaaggcgcaggtttcatttgggtgcgaatgtccaacacagctctcaaacactgggtcatctcccttttttaacaaggaaggagtgagaacttgaggtacagctacttagaattgttttcattgcatttacaagtatgcagacttttaaatttaaggtaaggaatattggtattttatttatgataatatataaagtttccttttaaaatctttacatttaggctttaaaaagtaaacttatt

SEQ ID NO: 121714 - DNA, 487 bp, Homo sapiens
tctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaa

SEQ ID NO: 121715 - DNA, 348 bp, Homo sapiens
ggtgggcaatgccgtgatttacttaattggtctcatgtggttggaaacatagctgggatccagttttcactgttagaaataacttgcagcaaagctttttatacgtgcaaaggtgtctgtatttggattatgtctttaagctggccacctgggaggccatttcttggaggctgctgtgtgacccccaagggcaggggtaggaccgtaggtggtagacgggtgttcacggggctgaaggagaacccttttagttagcttgtgtggactaggaaggaaggtgagccacagaaggtagtgatgggcgtccctgctgagggcatgcagggagctgagaaaggatccagcctc

SEQ ID NO: 121716 - DNA, 195 bp, Homo sapiens
ttcccctcccaaatctgcttcacccagtctttttcatttcagttaatagcaaatctgtctttccatttaggagtcattgattcctttttctctctcactctacgttcattctgtcatcagatcgtttttgtcctaccttcagaatacatctagagtctaatcacttcccactttctccattgttactattatggt

SEQ ID NO: 121717 - DNA, 234 bp, Homo sapiens
tggtcaaaaggatcccatcaggcgatgagtgtggggacgcgctggtgagggtcccgtcctccagcagggtccttgcccacacagcctgcggagaccacctcccagtccctgaggggcagctgcgggtgccccaggctcagcctctgcctcggtttccccctcgcgggtctgacatgcctcatccccaggcagcagtgtcctgggaacgctgcttcggaaggacaccaccgtgag

SEQ ID NO: 121718 - DNA, 801 bp, Homo sapiens
ttcttttttgtttgttttgaacgaataaatgatgtcaagttttcttgcttggtcaactactaggttatgccctccactgagaaagagaacaactggaacagacaggcacatgtagtacttttatgaccactgaagcaacagcaacacaaacaaaaaacagtaaagcgatttctgtttttggaagaaaagtaaagaagattcttcctgttgttaaggaactccagatctactggggagagagtcaaacagataatcccaatatactgtgaaatgggccacaataagagtaggtccgcagtgctgtggaagcattcaggagaagcccttgcccaggcattagggccagataggtttcttttagtaggtaatatctgacttagatccttatgggtgagttgggattagttaagtgagagatgggtgggaattaaagagaagtgaaattctaggctaatgctgctacccatgcaaagtcctggaggcagcatgagcctggtgaattcagaaataggaggctttctgtcatggatggagcaagggagggtcaatcggggttcatgttggctctatcttttcccttatccccctacttctggtcaaggcattattgttgcagccatgggcattcatggtatcactgtggactcttggtttttggttttgttttgtttttttttttttttagacatggtcttgctctgtcatccagacttgagtgcagtggcacaatcttggctcactgcagcctcgacctcccggattcaagtgatcccccacctcagcttcctgagtagctgggac

SEQ ID NO: 121719 - DNA, 377 bp, Homo sapiens
ttgaggttcataagcgcgtcaggttaagcctctaggatgaggtcctatttcagctgggtattgaaggaggagtgggagatgtagtcatgacaagagggaattgtatcctggcagaaacaatagcttggccaagaggttaaggagcatggtattttcaaggtccagtgaatagttgtggccaaagatgaaactatgtgagtgacagagcatgcatcttgagagctgatttggggccaaacttttaaagggctttgtgtgccatgttgaagaatttgaactcatcctttaggtaattgatggtcattgcagattttgaaaaatagagcctgatcagtgtattttgtatttgcttgataattgctttgatcctaccaaat

SEQ ID NO: 121720 - DNA, 295 bp, Homo sapiens
ctcacctgtctgcccccacatccgcacgtcctctccacctgcttctttgtttgattaccaataaatagtgtgggctcctagagctcagggcctttgcagcctccatactggcgttggcccctgagacccaccctatgtactcttgtcttgtctcattcctttgactctgccagacttcatagccccagtgaccaggtgttgggtctgatcaccccaacactttgcctccaccggtcccatgccaccctcgctttaagcccctgcctttgaaagcaggtcatgttcactgagatgc

SEQ ID NO: 121721 - DNA, 480 bp, Homo sapiens
tctcaatggttatatttgaaaataaaggtatgaattttacattactaaagagaattaaaactaaatttaacagaaattattgcaatatttatatttaagtttcttgaggacacacttaaatattacatttgtaatttgccatgttgacttttaatttataagaactatatcattggattaaagatagtttgaaatgctctgcattcaaattctagtaattccttatgtatatatttctttcttctggatcaaatattcttgtacaaattttaatttttaagtagaaaaaaatatttggagttatgacttaccttcccacacgaaacttttaggtggttatgatgatacaaaatttaccaggtcttctacctgtgcattgcttttatttttctttggataagaaaaaataatgctcactctatcttactggctcatctatctagaatatatgtacacaaacacacagacacttgtattttc

SEQ ID NO: 121722 - DNA, 323 bp, Homo sapiens
tgttgccatttcccatgctacatccactgcccaggggctcaagaacccacccaacagcctggcccactgctgccattcccagcacctgatcaagctacctggaggctcaagaattggcctgctaacactggtgccagcagacacactctggggcccagggacaggcatgctcaatccacaactaccaccactgcgacctgaagactggcctacttggcattccaggccccagcaaaactttaccacagcctccactaacaactgcaccctaagtcactgatgaaatcacagacaccactgatgctgtttacagccaaataagt

SEQ ID NO: 121723 - DNA, 200 bp, Homo sapiens
cctgcagctctctctgatgttaatagctcaggagatattttatgtttattgttcttccagaaaaaggcgcaaacatgaaaagttcactaaacacccttgggtcacttacttttctttcttaatttaaagggtatatcggtctcctaactttcggtcttctcagaatttctatggcatatgccaaagggcctattaagtac

SEQ ID NO: 121724 - DNA, 294 bp, Homo sapiens
cagccacggcctcccaatgtgtgggattatgggcgtgagccaccgtgcctggtcacaatccaggaatttttttcttaagagcctaagagtcttgtctttgaaatgtaaacctggaggaaaatagtgtccctatcttcctgttgcctagggagtttagcctaggcaacttgagctgttactacctgcttgtcaaggagatgtgagaagttttattttttcattgaatacaggtaattaactagcatggatggccacgttgatttccaggtgaatttaggatgagtgtttaagaat

SEQ ID NO: 121725 - DNA, 581 bp, Homo sapiens
ggttgtacagatgaggaaattgaggcttagcaagccaggaacttggctgaggtcagccatagcagcggtgcacagagcttagtgggcacatacatgcttggtgcccagctctgggctccttcccccagcatctcacccaatccttacagtcgccctgtggggagcaggctgtttgcacccctattttgcagctgagcagttatgctagagagctgaagccactcaaacccatgtctggtggacttgacctctgtcctgtgcctggagtgagcgctcactggattgcagctgtggttccttctctccctgtcacttcctcccccgacatcaaaccctcagtttcatttagtttttgcctcgggctgcaaatgcagcttagggacctgcggaggctgagggaggggggtgccccacccgctgctgggagggcaggagcaacgctgctgtctgattgcatcattttcccaagcccatctgcccagctcatttctctgcatgcatacactggccccaacacccacacacgtgtgcatgcacacaggcacacatgtgcaagcccaaacacatcacacacatgcatg

SEQ ID NO: 121726 - DNA, 437 bp, Homo sapiens
acactacatacatgatacattaacaccagcccccaacctttttggcctcaagggctggtttcgtggaagacaatttttccatgggcatggttgggggtagtttcatcaggcattagattctcataaggagcataaaacctagatccctggcatgcgcagttcacaatacacttgactcttctatgatactagtgccaccactgatctgacagaaggcagagctcaagcagtaatgctgtcttgcccgccactcacctcctgcattatacctatatctatcttttcataggttggtctgtctaccccatgagattaagagctttttaaaagcaggccacgtatcttaattctctttgcatgcctggtgtctagcagtatcgagaacagagcagaccgtcagtatgatagattggaaggaggataaaatcatcgcaggt

SEQ ID NO: 121727 - DNA, 332 bp, Homo sapiens
cctcaaggagctggtttcgtgaagacaatttttccttgggcatggtgtcacaggcattagattctcaatcatcttctatgatactagtgccaccactgatctgacagaaggcagagctcaagcagtaatgctgtcttgcccgccactcacctcctgcattatacctatatctatcttttcataggttggtctgtctaccccatgagattaagagctttttaaaagcaggccacgtatcttaattctctttgcatgcctggtgtctagcagtatcgagaacagagcagaccgtcagtatgatagattggaaggaggataaaatcatcgcaggt

SEQ ID NO: 121728 - DNA, 369 bp, Homo sapiens
aatctgtcatttgctatttttcatgtggcttgtaaccttgatggttgctttgtttaggtatttgccttagagcccttctctgttcttaatttacaatgtttttctttattaactttttccaaggatagacatgtactaggacacgtagcatgtagattaatttctttggcccaaatatgactatagagatattagtgagtatgaaacaaaacaaaaataaaataaaaactaaaagaaacaaaaaatttggaaaccatcagattgtattaaaccaattcatattcttggtagggttctaattcattcccagggaagaccaggaagttactagagcaagttacatcaaaggatatgtgaccagactccctc

SEQ ID NO: 121729 - DNA, 478 bp, Homo sapiens
aaatgggcaaggccttccctcttccaggatatgtgggtttccttcatcacagtggccaccacatgaatttctaggatgaaggggtcaaaatctcctggcaaccttgagcttaaattgtgtttgtgtaacaccttccctaaggttccaataaaattactagggggttttacagagtgaagtagaagggactgacaaagaccctccttgaccaaaccctagacacagtctcctcacccctttcccacctatgcttggaccttggacattgcctcaagagcccagttttagccagcatcccctatcttcaatatctgattcgccctcgatatctgaccacattccttattctccaattgatatctgatcaccctggtctgcctatagcaagaatactgttaggtcactttagaaaaaattaacgtatccttttagtaattttccattcactaacccctgtcctgccccacgttccatccct

SEQ ID NO: 121730 - DNA, 249 bp, Homo sapiens
ttccatgagaggagggatttgcttttcctcaaaaccacctccctgcacttcctggagttgaagtagggaaagtcccctggggtgaaggagcccagggacccttcctctcccgagcagctcagcgcaggggagtcctggctcagttccactgagaaacagggagggcaatttcctctgatcctgctgtggccatgaaaatacaaattctatacattctaatgaaagagaagtcccttcggtcttctggaa

SEQ ID NO: 121731 - DNA, 637 bp, Homo sapiens
gactctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgtggaaaa

SEQ ID NO: 121732 - DNA, 535 bp, Homo sapiens
attccattgagtactttgtaaatttttaaaaatcccaagcacaggatcattaataagttaaacactatacctcgcttattttctgtgacttctgtacaacagaactattagctacagattgacagatccccagcacctaccgcagggcccaacataacaaaaagtgcttagtaaaagtttctgggaaggatcgatggatgtaccaaagtacactaagttaaagtaaatgaagacatttttacatgtgtgaagatattaagtagcctactcccagtgcattccctaaataatcatgattgtgtcatacattgcatcatatttttctttcaaaaagcattaagcaaatctagttactaagagaatagaaagagtactttgttcggggtgattcttaggcctctgtccatggtctcagggaagccaaggaagcccattctcctatagactttattgactgatttttgcctgaaacattagataagagaccatgatgctgtttatactccattttctaatcttcaaatgtagttttaaa

SEQ ID NO: 121733 - DNA, 345 bp, Homo sapiens
ccgtgccaggcagatcctacgtgctttatatcctttaaattcccaccatggccttataaggcaggagttgcgattttaacctctatttacaggttagctagatgaggctcagaggagctaagtaagttgcctacggtcacacagtcattatgttgcagagccaagactggaacccagatctgtctgactctaagatcaagctcttcttccttatccccaagatatgccactaagaccccagacccctcttcatacacctcccttccacagcacactctacaccacctccaagcaaggattttctagacacagatatcagatatcccttctcattggcactgggaa

SEQ ID NO: 121734 - DNA, 432 bp, Homo sapiens
taatttttgtatttttagtagagaagcggattcaccttgttggtcaggctggtcttgaactcctgatctcgtgatccgcccgccttggcttcctgaagtgctgggattacaagcgtgagccactgtgcctggcccttataaggatttttatatgcctttagtgtcagttgcagtgagtgtgggaagacacttttgcctttccagaactaactataaattgcttttaattctgaggctgatgttttttttaaatcagctttgcaatttaatgatcagctgcctcctcttaagctacgtcttgctttttatcttcgtttaactgatgttccagtggatggtatgaataatagtctgttgttttgcattttgtactttttgacttttgcatggcaaggaagttaaatcagcaagtgagtttgaggtcttggattt

SEQ ID NO: 121735 - DNA, 462 bp, Homo sapiens
aataaaccaccacctccagggatgggaatcatgagaggggttaaaaagcagctaggattgagaagcagtattctaggagttgcagtatctagtatgactaccacatctaggttaatttagctactacagatgagcttgttctgagctgacagccattctcaacaaggaactactttcgctcaagagcttacagtccactggcaaagacagacttgaaagaccagtcatcagatcacagtgaagtaagtgccaacagaaagattaaacatcttctgaggagagagcaagtaatggctggttaagttagggaaggctcgtcaggggaaattatacttgaacgaggtctggagggaatcatccagcccaaaggatgaggggcaaaagacgttttcttagaaacatacattcattctttaaaatattttaattacctatgcatactgacacataacatttctatta

SEQ ID NO: 121736 - DNA, 890 bp, Homo sapiens
gtctgtagtttggtggtattcagtacatttgcaatgttgtgcaaccatcacttatatcaagttttgaaacattatcatcgccctaagataaatctacccatcaatcggtagttctcccttcttacctcctctcagccacaggcaactactaatctgctttttgtctctatgtacttgcataatctgggcatttcacataaatggaatcatatattatacgaccttttgtgtctggcttcttccacttagcatgtattcaaggttcatccacattgcagtatgtatcagtgcctcattcattttttatagctgaataatattccattgcatgtacatgtcacattttgtttacctattcattcatctgttgatggaaatttgggttatttccaccttttgactattgtaaatagtactgctgtgacgtatttgtttgagtaccattttcaattcttttgggtataacatctaggagtagaattgtcgggtcatatagtaattctatttaactttttgaagaactgccaaactgttttccacagcagctgcaccattttacattcctaccagcagtgcacgaatgttcaaatttctccacttcctggccaacacttgttattttccatttttttggtagccatcctggtggttgtgttatttattgtggctttgatttggattttcctagtgactaatgatgccgagcatctttttgagcagcttttgataatgtcagcacatgatgctacagtgttagtgactaagattcattacattgtagaatatttgaaaagcagataagtcagcatttctggcttcatcctggtgtcctgtactctttgttgacctctcagcgagttatgtgaagttccagtcatgccatcaagagg

SEQ ID NO: 121737 - DNA, 824 bp, Homo sapiens
ggcatcgaatgggcaaatataatcataaatcctggttcttggggcttccaacttcatgtctggaaaataacagatgattcatacagaagatagcaaaagggtgcccagtgcccgtcataatcctatccttcattttataatcctaggtctgatttttggtttatttgtttgttttgtatgtttgcttctatttactgcctagaattcaactatggaggtttatttggtagaatttatctgctaaacaaggatttattacacttaaaaaatgcacatattctgagaaagctaagatgccagcgaatattcactcagttcagttatttttaaaaaattttccacattcccggtggaatctgctataggggaagctgttttaatggaggccgagagttggacaattttgtgttatggagaattctgggaagaaggaaagacccggatgggactgtttattaaggcttatgactggactggagataaggtaaattagcattgagaacatacagaaccacaggcaaagttctagttttttagtaataaaggggcttatctatacattttcaatatgaaggagtcaaaattgaaattcagctttatttctttacttcacaactcaagtttatttcttttatttatccattcagcatttgttaaattgttggattgtgccaggcatagaggtaccaaaaagcatttttagctcagatttgtagtatcattcaaacatatcaaaagtctagccaggaaaaccaagcgatatttaatatttgtctttataaactggagaatgccaatattctactcccatccttcaaggatga

SEQ ID NO: 121738 - DNA, 225 bp, Homo sapiens
tgcctgttaagataatgattatatccaaaataacctctgtattagattcacttatgaggtaagtagggtagaagacacgttggtgaaaaaggtaagcacaccagagctgataatgtaaagttaagaacaaataacacaatataaagacaacatcacttctaagccatacaaagaaagacccacgacaaggaagagattcctctaagggatggtaataacatggcc

SEQ ID NO: 121739 - DNA, 716 bp, Homo sapiens
gagattggctaatgaatacaaaaatacacttggagtaataaattctagtgctcagtagcatagtaggatgactattgttaaaaaattttttttgtgtatttcaaaatagctaaaagggaggatttgaaatattcccaataaaagaaatgataaatgcttgaaatcacaggtattccaaataccctgatttcatcattacacattgtatttatgtgtcaaaatataatatattccattaatatatataattattatgtatcagtagataattgtaaaaacaggagccttttaaggttttgatcaaataatgtcaaggatgtacattaacaaaataaatctggtaatggattgcaagccagcagagtgcactggtctttaaacttttattgttgacatatttcttaatcttgaaaaacctaggtgtctcctcaaagattttttaaatttgtaaatttgtgaattttaagtctttgtagacaatatacattcaggaaattattgaattattgttttcaaagacaaaattatggtcctcttttagattaatgaaatgtaaatgctgtagcaacttttattcatctctcttaaaatgtataaactctcaactgtaatcccagcactttgtaaggtcgaggcaaaaggattgcttgagcccaggagttggagaccagcctgggtaacctggtgaaaccctgtctctattaaaaaaaaaaaaa

SEQ ID NO: 121740 - DNA, 718 bp, Homo sapiens
tgactttcctggactgattgtcttttatataatgacagagctgtctgcttaaattttattaataacttccaagttctcagtcatatattttgattctatttagggcatttttctcggagccctctgacttcttgttctaatgtggaatgatgaatttccacacttcctatactaccattcctggaatttcatttcattgtactctctgggttacttctgtcatttattggatattgtgtaatagcttcaaatcagagagatagggaaggttgtgagcacacatcaagtgattttctgctatgtaaggagcacctttgggtcttgatatatctgacaaaggtcattttttttatgcttccacactagattaatagtgtgattggagtacaaaatttgggttcaatattcatttccctcagagaacttttagcatctgtttctgctataggaagtctgatgttaatataattcttatttctttgtaggttactaccccttcccttttctggaaactgtgagaatttctttgaagttccttagagtactaaaattgataagggaagtgatgaaatcatattgcatgtagcaaactactttttaatgtttgcctgtatttagtcattgtagtttcctgtgactttgagttagaaagtaaacttattggcccagcgcagtggctcacgcctgtaatcccaacactttgggaggccaaggcggt

SEQ ID NO: 121741 - DNA, 866 bp, Homo sapiens
tctggaaggcaaattatatgccacctaacaaaagaagttggcaatcctagtaagtcaggcaaggcggggagatttgtttaagtcgtctggatacttggttacagttattctctgttttaattggttagtagatcctggaaatagtctggccactgtgcatgcagctcaaacctcacactttctaatgccaccagccttgaggcatggctaggcaccatgcagagtacacaaatcaggcagcctcggttcccatcataggttaacactcgacaaggccggaaatgggctgtgagagaaaactgagtccttacacacaaaaggtaggccttgaggaggaatgatggtgtcattccacttaaatattaagatcttatatctagagatgtggagatataattttgctgactagagctaccatttggcctccaacccaaaacaaaacccaacaaatgtctggcctcagagcactgcttagcttacctctaagtgattctctccaacactcctgtgtaatcaggttctctgtcttctggaatgatttgatgttgccagttactctgagcacacccttgcctggggacaggtagaatggggataagtgaacttataacttgcagaatctatgtcaggatataaatagcaatatgaatataccaataattattactcatatctgttctatttcaaagaagtgtgcacttcatgaaaggattagtgcttacccgactaaacctagcaaagtaaattcttgaataaagatatcagtctgtcagagatggtgacagtgtacagacaggcatatgaaagcttctcaacccccaagccctacccagtctggtccggtctttgccagtagaaaattccta

SEQ ID NO: 121742 - DNA, 210 bp, Homo sapiens
tcaagtttgtggtaacttgttacagcagccacaggaaactagttcatttatcatacaggttttggaataatgactagcatttctccacttctgaggttttcattgcttagtctagcatttccaaaacacacctaataagaatcaacctggttgcttgttaaaaatacagaatctggctgggcatggtggtttacgcctgtaatcccagca

SEQ ID NO: 121743 - DNA, 525 bp, Homo sapiens
aatgcaagcatgatcacctcgctctgcaggtagaaatactcgtgtggcttctgtcaccctcaggatcaagctcgaactcctccgcttggcttagagggaccatctggactttcccggccctctcatccccttgcggcctatggctgttcttctgcccccgccttctcccacctcacctttctgggtgcactggctaactacagtttttgtgtctgataagagcttacaaaggactgccttctgggagctgtcccaccgtgcccgcctcagctctctgccctcttgtatgctgggccagcttccccaccctccatcccagccctcgcccaccctgtgctgggccagagctgctgtctccctagctgggctgtgcgcaaagagcaggcaccatccctcctccccacagcaagcttccagcagggttctggagcacagtagacactcagtatggactggtagagctcttaaagaattttcttgaagaatccttttgagaagtaaaatgaagccagcgaggaatgaaac

SEQ ID NO: 121744 - DNA, 581 bp, Homo sapiens
gaacatagctgaagactatggatgtccaggtcttggctcccaacaactcaggacctcaaattcagatgttcctccctataacaattcccttaggaattatgatacccattttagtgattgattgatagaaacctggggtacagagtgatcgtggggttgtaattacaaccccacgatcacctatcaatggcaaaactgttggtccacagagcacgtgtccaggccagagacagccccacctctggggtgcaccttttcctttcatttccaaatgtcccccaaggccatggaagggctctgctccctccaacaaaggaacagcatcccaaagcccggtgcacacacagatgaacttcctctcctatgcagcctgagacgtggaaatgaggaaagcagtgattctcaaaactggcagggaagggctgtgggagagtttcattcattgtagggagggtggatctgagaactgtacactcttgagcatgcacacacgtacgggcacacacacagagcgtagcgtggcagctgagaagcagtggagaagcacagagagggaacagaatgggggccaatttggaagt

SEQ ID NO: 121745 - DNA, 366 bp, Homo sapiens
tgagccaccgcacctggcctaaacccaactcttttgacatcaaaccctttccccttttttctgtgccatgtgtgaaggacaggcaaatggtctgagaagagaacaatgtgctagtgtagggagttttgttcccagcgggagggaccatgtcttgtcccttattgtttccacactagtctctagggctgggcccttctgtcttggagcttggctcctgtgtttgactgagcgacggttcttttggccagtctcaccgtgtgactagttatggtcatgttgccaagaaatttccttttgccccaattttgccttctgatttccactcgtctccatgaatttggatgtttcttgaccatggaatgctta

SEQ ID NO: 121746 - DNA, 384 bp, Homo sapiens
tatgtaacaaacctgcatgttgttcacatgtaccctagaacttaaagtatattaaaaaaaacagagtgctgaacccatctttttaaacatctttaaaaaaatagttatgttgcctgtggagttttagaacttaatgtaatgaaagtactatctttctatgaaccttacagtttgtttttgttgtcatttttaccattatttgataaaggtaagtagacaaatagataacacattcatattggactattcattaagaggtctaagaagaaaggtactcttaaattcacaagtggggactacaaagcaatatgaaaatgatcaggatttccgttttaatgaaataatggaatcacatttaaaacattattttatttttttccaatt

SEQ ID NO: 121747 - DNA, 770 bp, Homo sapiens
gtctgttttattgttgtaactatctgagagctggtaagttgagaccaaaacaacaacaacaaaacaaccaaaatcatgcttaaaactggttctttccaaggttgcatttttgttaagatctacttaatagttgattggatgatttttttttcccccctccggtctgagggatggttgcttctactgtataccactgttatcgccagtatttaattatatttgttctggtctgtgaagtttggtaggaagggaagaaagagctctggttggcttttctagattgacaagttagaaatttcacttaagagttaactgttctttttattttaaaggacaatttgataatgtcaacatttaaaaaccaaactactagatacactagttaagttcacttcatagtatcttctctcaggaaatgtgcctgcatatgtatacagaggagaaaatacgaggatatatattgctgtagtttcacacccctctgcccttgtaattggtcaggggaatactctgcctccactatgagaaaataaccagctgtctcaataaatgttatgtattattatatattgttagaaaagcaggctgctgaacaatattgtttctagtttaaaaatgcaaaggaaaactattgtttctgtagacatacagtatgtgtgtaaactttgtaaacaaagttttaaaggatatacagacactccccaatttttcgacttaatgatggtgtgaaaatgatagctattcaatatacccctcagtttatgatggga

SEQ ID NO: 121748 - DNA, 400 bp, Homo sapiens
gcaccaggcagggtccaccatgtgccccgcctcacactggcactgagggcacagagaagatcagccccagtccctgccctggaggaactcaccaacgacagtggagagggtgggtgcgagtccaggccactgggttggaagacccaaagccaaatcctagctcttcatatcttcgctgggtgcccctggtcaagcgacacttcactctatgcctcagtttacttttctgtcaagtggggagagcaccagaaaccacttcatggggctcttgtgaagagaaggagagagaatgcaagagaagtggtcagtacacggcctgacacacagtgtgtaacaaagggaaggcagtgctattgtcatcattgtcaagaaggaaatgcataaagtcatgcaaaatgtg

SEQ ID NO: 121749 - DNA, 360 bp, Homo sapiens
cattggtggtggcacagctgtggagatatgaaaacgcgaaacctacgggtgagctgggtgaaccttatgaggcgggaattaactgctccggctctggcgctgaggaaaaggaggaccggaggatggtaggcggaaccaggcccagcaccacccgctagaacgccgtgatgttcccacagccctacagggccaagggtgtctatgcaaggtgggtacagggtcggcctgcatctggagggccacacccccatgttacaggcgaggctcctgtgcagagggctgggggcctgccaggacgcaccccttggcagtgaccgggcctcttctgaggtgggaccctcagcctcaaaccaacgcatg

SEQ ID NO: 121750 - DNA, 288 bp, Homo sapiens
tgttttggatcccaagtaaagcccttttgatgtcctcaggggtctgcgtgttcacacaagagttatcaagtggacagaagtttgttattcttctgggcttcctagggcctcttcttcaaggatttaattatttgtgaacctttcaattgtactcatgatgtgttatttaggagtagatgtgtttttctatcaattactgtagtattaatatattgctaactcttagaagtggccaccattatcttctaaacaaaaaacatattttatgtctaagattatttgcctatg

SEQ ID NO: 121751 - DNA, 513 bp, Homo sapiens
atgataccaacagaacacatggtcaacttatttttttcccatgttgaattgctttcaatatactatcaaaaaactcttctcaaacaaaaataggacctaaaggattttgaatactcttactattccaatacttctggtacctagagctgattgtaatgcaatattgaattggccagttagtttaagaaatcagattctgctttttaattcagtagataataataatagctaacagtgaaagttactctatccctgaaataattttgtataatattcacaatgaccctgtgaattagactttatccagtagcacagatgaggaactttaaacaggttgcctaatttatccaaaattgtagagctggtgcttggcgaggtctgcagttttaactagtacattgtacattcttaacatgttaacctcactgtagtatccctgcagccagaagatcatacagggttgaagacaagctgttattttacagggtgtaatggatattcccaaggccctta

SEQ ID NO: 121752 - DNA, 323 bp, Homo sapiens
tgtttcccaggctggagcgcagtggtgtgatcccggatcactacggcctcaacctcctgggttcaaatgactacaggtgtgagccaccgcgcctgaccgtgagccaggacttctcaatatagttttcttctcaattcccactcccatgtttttctagaaacatgattgtaactcctgtcttacttgatacaaaagctcttgttctctttaccttgtggcatgcagtctagttagaccttgccagattctatttcagtttttaataagcctttttatgtggaaggatggccttctcttgttaactgaagtttacatagtcataa

SEQ ID NO: 121753 - DNA, 407 bp, Homo sapiens
catcatggggcctttgctcctggtgaccccttggcctgagcactcttccttcccagactgctccatgttggcctctgtcctcctccaggtctcagcttgagagctgggaatgggcctgcagtcactgggctcccaggccttcccatccaccatgctcttaagcctttgctggacccatccccacagcaatgacctcatggtgtcataaggcaaatgtggaaactgaggcccagggcgcttcatgtttctgacacccactcctatcatgccccgtccacctccatcacaaagtctcccctttgtcctgcaggtttggaagtgcctcaccctcttctggcctttgatttgtgtgccacaagcaaaaaagttaaaatcaggctgggcatggtggctcacgcctataatcc

SEQ ID NO: 121754 - DNA, 363 bp, Homo sapiens
gcctaccgagcttttcgacggtgtctgtatctacggaagtttcatggcttcaaagaccaatatcttatcgctgacctttctgttccttccgcacctctggtcttggtctggtgtctggaatgagactggggcctaataaaaaggagcgtctatacaggagcttaaatgggctgtaccttgtagcattctgaggacaggtctgacttctgaaaagggaaagtggtaaaagtattgtccagtcctttttaagttggtggctgagcttggtgaggtgtgtctttaaaagaccattagtccgttctacctttcctgaagactcaggactgtaagggatataaaggtttcactgaataccaagagcct

SEQ ID NO: 121755 - DNA, 184 bp, Homo sapiens
tgcctgcctcggcctcccaaagtgctgggattacaggcgtgagccaccgtgcacagcccacaagcctttatcttaacccagacacccctttcttttttctttgtgtgtgtgtgtgtgtgtgcgcgccaaagatttatttcttcatttcttgcatttgaaggactcttcgatgacatccttggcc

SEQ ID NO: 121756 - DNA, 510 bp, Homo sapiens
actctgctttccattgccaagcatctttggcacaagagctgtaataagaagtgtaatgaacataaaacagtttttagaatcactcctttggtagctggtatatgaagctgacaaggccccctctgccaaagctgcagaaggtcgggcatatccttcccttagctcatatggctgcagaggaaggaggtgtctttctttgggcttcatcgccaggcaacccacacactttgatgctcacctgtctgccttgggggactggagttgaatgactgcttgttttgctcctgggatctgtgggctccacagtcgtcccaggcctccttgcttaatcggactcccacccatggcatctgagtagttcctcttctggtcctgtcactatcatctccctttctctctctcaaggcctgtccttctgtagtacatctttttaataactggtaagagtctcctccgaccttccctttggagaccttttctcttcagtcaatccccgccccacccaatccc

SEQ ID NO: 121757 - DNA, 675 bp, Homo sapiens
ggaggagggctcagggcaccccctgagctacccctgctggccattgcaccaccccataaagctgctggcagtcacttctctgaggggttagcatgtaagaaatgtcctcctgaatgctggccagacaaatggaaatctgccagggttgggtacccccatgacagcagccagcctgccctcttagtccctgacagctgcagtgacagcatctgtgattgcaaagcgtgacaatttatatctctcatttcatcacaccatctatcagcagacagtcaggctttaaaaatcaatcccacactgactcagtccccagcagagatggcctctgacaacagtatccacactgcaggctggacaagggccctattaattttgagactcagccaaatttccttctgaccctaagctggtgaatccctgctcctttgctttggttggggttggtgtgagctaaggctgtgatcccatttgctcctatggcctccaggtggcctgggcctccatgaatgggccacatggtcatactgaatgcttgattacactcagacctagcagtcgtctgggcgcagctggtttatggatcactttgtcacaatgttccatccttccaggtccccatccccgcggtgggaaaacattgctttaggcagtgctagaggacttcagcaggcattg

SEQ ID NO: 121758 - DNA, 1098 bp, Homo sapiens
gtgatttccacagacatggcataattcctgtgatttgatgtgaaatgagagaccagctcagtgctgagtgatgagatctgaacggggaataaaatatgcttgaattaatttgcataatagaattggattggttacaaagctgtgtttgttgaaagggataccagagccccttagctcaccaacaaggggactttgcagatacagaatggggttttgagctctggtgtgggccgtggtaatattcttaatgtaataataacctgtctctaactataaattagctacctggaaatgaaaaaacaggtcagcctgtctgatccttccagctctgtggggaggggacagctgaaaaaccaaatctgcttgctttctgctaagcgctttcgtctttcattctccacccaataacaatttccagcaggagtccaaatatacttaaacacccgtatatgtcattttctttaacggagacaaaagcaggcacagcaagagagttttatgctcaaggcacggtggcttctgacgggctatctgctctcaagatagaggggtgatccttccctttcgagctggtggctttgcacatctattttcctgtcatgttattactgctgtgactttcaacaacatttatttttccctccaagcaatatgctcccatcataaaataaagtcctcctatatgttttagtagaatcccaatgcttaggcatcctggcatactgctaaaaagtgttttaatggattgttcaagaactaccttgggggtctttattaaaaccaattagaacattgatatatttccctaattattaccaacatcaaggtctccttaggagggcagcctcctattaattttcatgggagattcctactaagtccctaccactgaatacatcaatcagttctctcaattctagaaatatttcataaaacaaaacaaaacaaaacaaaaaactgaaacaactctgaatacacttttgtaacctacacatttagaaattctgaaacaggtatttaaaataaaaaccaaagatcaaattttgtgtcatatgttgtttaaagacctggttatactatgttattgatggttattga

SEQ ID NO: 121759 - DNA, 435 bp, Homo sapiens
cagtataaatatgtcactcataggagcactgccatctgcacccaaatattcctacgatcctcatgaaataaatgctactcctattgttctctgcaacaacagagacagtctctcaaaacccaatccataacatactcatatttttcagaggccatctataaatctaacagatgggtcgggatggtttgatggcctatcctccctcccttatgtaactgtatctctctcttcctccactgtacctctcacagacattctctttagctgaactgcaggaatcctctctcactctgacagctgaggttccagagcagcccaggttgaccataaccacagcagaaagattctcaaggcccatccctgacttgctttaagccaccagacaatggaaaccccaaaggacatggagttacatcagtgacgttcctcagggtt

SEQ ID NO: 121760 - DNA, 455 bp, Homo sapiens
agtttggtcgtctcctcatttaagggagggattatggtggtatccaaccccaggggtgctggaaggacaaagggagttaatgtaagaaaagtgctttggacagagcccagcacagggcccttgggaattcatgtgcaggcactgccccagagccagctgtcactgatgtgaggatgccaccctccagcccagggcaggggcaccgatggtcaggaaggttccgtccactgcacagacttttaactttcagtgcacaccacagccgtcagggaagcttttaacacatgcagtcgggagcctgggtgtgcctgcgtgcgtgcgtgtgtacgcgtgagtgggtgtgcatgaggtgtgtgtgatgtgcctgtgtggggtgttttaactcctcagatgattttgacatgtcccacgggtgggatgactgggaaaacggccttttaagagggctttctttt

SEQ ID NO: 121761 - DNA, 245 bp, Homo sapiens
gcgcgttgggacatggaggaaatgaggatgtcctggaaggagaggagtgccaaccacatcgtgctggcttgccatgttgttcttattaactgcctgagttctcataacaagcctgtgtgtagggactcttacccctattttacaaacgggcaaaatgagatggggccacacagctagctaggaaagggcccagccaggatttgggtcctagctggtctataccacacatacacttcaagtccagc

SEQ ID NO: 121762 - DNA, 659 bp, Homo sapiens
acttatagcagccaacacgccaaacaatcaaaaacaccagcatgtgaaaccctcaaagtacggacaccaagaaagagtttggtgacaatccatcagctacatagaaatagaaagtgagccaggcagcataaggatatatgatccaacgtgatctttttttatttttttttttgaggcagagtcttgctctgtcacccaggctgcagtacagtggtgtgatcttagctcactgcaacctccgtctcctggattcaagtgattctcctgcctcagtctcccaagctcactgcaacctccgtctcctggattcaagtgattctcctgcctcagtctcccaaatagctgggactacaggcgtgtgccaccatgcctggctaatttttgtatttttagtagagacggggtttcaccatgttggccaggctggtctcaacctcttgacctcaagtaatctgcctaatctgcccatcgcggcctcccaacgtgctgggattacagctgtcagccaccgtgcctggctgtgatcctgttttttttttctgagacagagtcttgccctgttgctgttgcccaggctagagtgcagtggcatgatctcagctcactgcaacctctgcctcccgggttcaaggattctcctgcctcagcctcctgagtag

SEQ ID NO: 121763 - DNA, 428 bp, Homo sapiens
tcttctgccttcgggccgcggggagttgcgcagactctaaaaaaaaaacctttaaaaacccaaaacctcccctccaagtccctttcgatctacgccaccttccctctcagggctgatttcttgaatttggggcgtcgaggcctccccacccgttgctaccagcccttttgcagcacttcctgggcaggccaggggagaggacggaaaagtgaaaaaagaacgtgtgcgcccagcggacccgacttaacctgttggtggaggaggaagctggcgtcgggctgaagtcccccgagccacccctggagccagagcagcccccgagcattcagagaaagccgcccgtccccagtcccctcggaagccggtcataaacccgacttctcatcacccgaattacttaaatgagctttgatggtgttaggtccttt

SEQ ID NO: 121764 - DNA, 179 bp, Homo sapiens
aagttgtagtatgtaatttccccttgaaaacttgaatttcatcattgacaacacatgctgtcagttgtttttttttgaagtgataggctcagtttgtttgtttctgagaaattgtctgccaaatccacaggtctgaacaacgacaatttgtcaatcttggaagttaaaatggtgctccg

SEQ ID NO: 121765 - DNA, 413 bp, Homo sapiens
ccccatctctacaaaaataaaaaaaattaggcacagtggcacatgcctgtagtctcagtgagctatgattgtgccactggactcaaccttgggtgacagagtaaaaaaataaaaggagagaaggtatagatacagatatgtggggaagataaagttagcatgtttatgaatattctggctgcttctatttttttcagtgtattacatagtaaggtcagcaagtgagagtgggatctgagaaaaggtatgaaatattcatctaggggagagacagtcattggcccagtggaatttcatctgattgccaggagctagaaatcgccaagtagtactggggagtgattcaggctcccacagataactacagccaaaggtagtttgtggtacgatgtaatgactgcaagattcaaaac

SEQ ID NO: 121766 - DNA, 172 bp, Homo sapiens
cagcacacgcctgtgtgtgagtctgtgtacttgcgtaaccatgctcttactgcattctccacaagcgctttgccacgtgcacccataccattgcgttagtcaccttctttttaataagttgactgcgttttaaataccaggagcgtgtccaataaaaatactttctgaatga

SEQ ID NO: 121767 - DNA, 446 bp, Homo sapiens
agccctgcaatctcaatgcatcttcaggaaaaccttcagcagtgactgctgccattcacttttcaatagaccccaaaatggggctccaagcctcagtccaatcagcgtaactaagggaaggagctggaacaacaaggattgtgggagattaaccagctctcccactgagaggccaggcaacctatgttactaaatccttctaccggattaagccagagcccacagatcacccacaggcttgaacagatgtgacacaacggggcactttctgggccttggtccaaggaaagagctaaaagtagatggtgcatgggcacaaggcacttgtcactctctcccttgtagaggcagtgggccgtctcagaaagaacatgagtcaaaagacctggttagcccagcttggccatgtgccagctgtttgaccttgagtgagtcacttcactgct

SEQ ID NO: 121768 - DNA, 479 bp, Homo sapiens
tgtcatatacatgttttcatgttctagtatggtagtatgtggataccaggtgcttcttcaatacctaagtgaatgaaagatgtattagtctgttttcacactgctataaaaaaccacctgagactgggtaatttataaaaagaagcggtgtagtggacagttctgcatggctggggaggcctcaggaaacttatagtcatggtggtaggtgaagggaaagcaaggcacatttaacatgatggcaggagagcgagagagagtggggaactgcgacacacctttcaaccatcaaatcttgtgagaactcactcactatcacaagaccagtatggggaaaccactcccatgatgcagtcacccgcaccaggtcccccctcgacacgtggggattacaatttaagatgagatttgagtgaggtcacagagccaaaccatatcacaaggtgacttggcctgaggaagggttggaaaaccttcat

SEQ ID NO: 121769 - DNA, 127 bp, Homo sapiens
tgctgtgattacaggtgtaagccactgcgccccgccccagttaacgttttaaaaattttctgtagagacgggtttctccatgttggccaggctcatcctaaactcctgacctcaagtgttctgcccg

SEQ ID NO: 121770 - DNA, 530 bp, Homo sapiens
agatctaaatgtagaacttagaactgtaaactcctaaaagaaagaacaagaaaaaatctttaggacctgtgggtaggtaggcagagaattcttagacatgactggaaaagaatttatatataaattcttatatataagaaaaataaattagagttcatcaaaattaaaaacttttgttcttccaaagacactgttaagggactgaaaagccaaactacagactgggagaaaatacttgtaaatcacatatccagtgaaaggacttgtatcccggctatgtaaaaagctctccaaacttaacagtaagaaaacaacacaattaaaaaaatgggcaaaagatatgaacagacacttcaccaaggagaatttagagatggcaaataagctcataaaaagattgaggggcatctggacctgaacttgtatgtgtgaatgagtttgtgttgtttagagtttctcctagaggcacaagagactaatggtgatgtcatactcccaagtggctttgggaaaaaaatgaggcaaagtta

SEQ ID NO: 121771 - DNA, 433 bp, Homo sapiens
acaagagctcagcagcagaccaacgattgcgtcccctttttgaaaggggtgtgttatgggttgaaatgtgtctcctgtctccaaattcatatgttgaagccttaacctatagtacttcagaatgtgatcttgtttggagatagggtctttacagaggtaatcaagttaaaatgaggtcgttagaatgggccccaattcagtgtgactgatggctttatgagaagaagaaatttggatacaagaccatacaattcatactggactatgcataccgggaccatacaatgtgaatatgaagacagctgtttacaagccaaggaaggggcctggaacagatgcttctctcacagccttagtaaggaacaaaccttgcagacaccttgattttagatttctccccttcagaacagagacaataaatttctgttgctta

SEQ ID NO: 121772 - DNA, 995 bp, Homo sapiens
aggcaggtagatcacttggggccaggaattcaagatcagcctggccaacatggtgaaaccccatccctactaaaaacacaaaaattagctaggtgtggtggtgtgtgcctgtaatcccagctgctcgggaggctgatgtgggagaatcacttgaacccgggagccagaggttgcagtgagccgaaatcgtgccactgcactccagcctgggcgacagagtgagatcccatctccaaaaaaaaagagagagacagagaaacatagggaagtatttcagggtgacagaaatgttctcttggttgttgtggtggttactgctggacagacagtcctccgtgggcctcacgcactccgacatgtcttattgagtatgccaggaatgcaatcactcttgaacctgggccattctgtacctggtaaccttgaaagacgagataacatctcccgctagacaaagagcaggcttgctcactgctttctataaaagtagtggattccccaagtttgatgttcttcagctgcaacacagaaccactgagagagcatccatcttggtcatagtatgtcaccctcttgggacttgggggaaggggaaactatgcaaatatagcaattctcatgctgtgtgctatgacaagaaaaataaattccttcatctctcactcaggagtcccccatcttatgtcagcacccagtaatacaagttgagaatcctaaatccaaaaatccaaaatctgaaactttttgagcaccaatatgatgcttaaaggaaatgttcactggaaaattttggattttgaatttttggatttgggatgctcaatcatttggtataacacaaatattccaaaatccgaaaaaaatctgaaatccaaaacacttctggccccaagcattttggatgagggatagtcaacctgtaacagtaataggctaccttttaagtattagtagggtaaaatcaaattccacaccagacggcgacatgggttaaa

SEQ ID NO: 121773 - DNA, 529 bp, Homo sapiens
taaaaaaatgtgattcaccacataaacagaattaaaaacaaaaaccatatagtcatctcaattagatgcaaaaaaaatttttcaataaaatccaacattccttcatgataaataccctcaacagactaggcatcaaaagaacatatctcaaaataatagccatctatggccaggcgcggtggctcacacctgtaatcccagcactttgggaggcggaagcaggcagatgacctgaagtcgggagttccagatcagcctgaccaacatgaagaaaccctgtctctactaaaaatacaaaattagccaggcgtggtggcgcatgcctgtaatcccagctactcgggaggctgaagctggagaatcgcttgaaccaaggaggcagaggttgcagtaatccgagatcgcaccattacactccagcctgggcaacaggagcaaaactccatctcaaaacaacaacaacaacaacaaaaaagaataattactattactgaatacattgcatagggcaatgtaaattacctctttc

SEQ ID NO: 121774 - DNA, 387 bp, Homo sapiens
gaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggt

SEQ ID NO: 121775 - DNA, 431 bp, Homo sapiens
ggactggcatatggcgctcgactctccatcatgaggagtaggattgtcgtgcagtgccagcctgcagtgacagtgagacatggtgtttgaattgctctacaagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacttgtgtgccatgacagttgttgattgctgcatctccagctttgacaaatcggtgctcaccttagccagtgctgggtgtaagagtgccagcctgaaacattgtctgaatggtga

SEQ ID NO: 121776 - DNA, 449 bp, Homo sapiens
cgcggtggctcgcgtctgtaatcccagcactttgggaggccgaggcgggcagatcacgatgtcaggagatcgagaccatcctgactaacacggtgaaactccatctctaccaaaactacaaaaaaatagcagggtgtggtggcgggcgcatgtagtcccagccactcgggaagctaaggcaggagaatggcgtgaacccgggaggcggagcttgcagtgagctgagatcgtgccactgcactccagcgtagataacagagcaagattctgtctcaaaaaagaaaaataaataaatcaataaataaaaattggccttgatacttatctacttatagcagctttcttcagtcactaaaaactggaaaaaaactaaatgtccataaacaggtgaatgaatacacaaattgcagtctatatactggaacactactcagcaagaagaaggaatg

SEQ ID NO: 121777 - DNA, 557 bp, Homo sapiens
ctcgaactcctgacctcaggtgatccacctgcctcggcctcccaaagttctcggattacaggcttgagccactgcgcccggcctatttatttatttttgagacaggatcttgctctgtcacccaggctggagtgcagtggtgtaatcctggctcactgcagcctccaccttccgggctcaagtgatcctcccacctcagcctcccaagtaactgggaccataggcttgtgtcaccatgcctggctaattttttgcatttttagtagagacagggtctcactgtgttgcccaggctggtctcgaactcctgagctcaagccatctgcccacctcggcctcccaaagtgctgggattacagacatagccaccatgcctggtctcataacttgctttagagcataccaagtggctgtagttttgcttttttccaacttatcaataggatggaagcatgtataaaaatgggactaatttatcagaactttttattgatttggacacaactagagaatgggaccttatatccaccagactggaagtgggttcaagagattaa

SEQ ID NO: 121778 - DNA, 358 bp, Homo sapiens
gacacgtgggctttttctagtttgaggctatgctaaataaagtcactatgaatatttgaacaaagaaaatctacacacagtcacacatccaaattaccatgatccacaattgtattttaaaaactcattggagaatttggactctagaatttatttcagagagatctaatgatctaagggcaaattctacctctcccacttactaactgggtgagctcacgtgagtcccatgacctccctcggtcaccctgagtgagatgcatggtggatgctccacaagctgaagctgctaagatgaaatgataagcacggatgaatgctgtctgggcaatggatgcatcaagcctccctcttctct

SEQ ID NO: 121779 - DNA, 541 bp, Homo sapiens
attgttaaagaaggggccctggagcctctgattcttgttctttattgtccttgcccctcagtaaaaaatcctttaggaaaacagatgcgttgatgactgtgctggtcaaaggtcaattttggaccccagactcctttgtaaaagcttaatgaatctgaccaactcttctaagctcttctagaggtagctgccactcccaagggagagattcttgagctcctttggcttaccaagtgggatggggtgagatggtatgcaaagagggaaggtgaaagaaagaagggggtcagtcttggagaaaaaggcgtattacctctattcaggtagaagcaagagaaaactgcctaaaacctgggattccagggatgagcttgccaatcctccccctactcaggcctctgcccagattcgggactggcattggagaaggagttagggagaccttgagaagtggttaggacggtggactccacctagaggcaagtagtgactctgattccttcccatatgacaaaccagccttctgggaaaggtgaggaca

SEQ ID NO: 121780 - DNA, 269 bp, Homo sapiens
aaaagagttccttagagaatagctgatgccctgtcctgtgtggaaaatgtgcttaccacatacccggcactgttctgtgcatttatatgtattaactcgtttaaatctcactgtcagttgtctgataagtactattgtcacctcattttacagatgagagaactcaggcatagtgagatgaagttactaacttaggttacagttaataaatgcagaacctagatttgaaccctagcagtctagcttctgaatctgacttataactgcta

SEQ ID NO: 121781 - DNA, 618 bp, Homo sapiens
agttgtaggaagaggtcctgggtaaaggagcaggtgtgttcttagaaggccctcctgtctgctgctggaacacatcacctgtttattcgtcctccatttcccgctttgcagagcactgaaagtctcttaagttacagcttcacaacagaagtctaaagtctgcgcagaactagcacatctgcagccgtaggagcagcagaatgaccaggcagcagagctttattccatgttttcatctccattcctacaacagcagcggcagcagcaacaactgctactacttctaattgtggtaaaaatacttagaataataatgcataatgacaattgtagttgacatttttggtttatatatgattatttgtaatgttctacaatttacctttagtaatatacacataacttttgcataaacatcaggaccctaaaacaccacacctgatgattgaatctcacctatggacctaaggtcttcacatgctggtgcaggccctctcaccactccatctccaaacagaggatatggtccaccttctgagtcaatatagtagccctgacactcacatgatctatttgaggtcttggaaaacaagcttgccttgttaaaaatcaaaggat

SEQ ID NO: 121782 - DNA, 471 bp, Homo sapiens
tgtagagatggggtcttgctatgttgcccaagctggtcttgaactcctgagctcaaacagtcctcctgcctcagcttctcaaagtgctgggattacatacatgaatgcacctggcctgaaagtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattctgattaagagaaagaccctaagtggctgaaggaacaaaaagagttattgcaaaaaaaa

SEQ ID NO: 121783 - DNA, 209 bp, Homo sapiens
aaggtttagtctttttattaaaatatagtctccatgagtagactttgtattcttcatcatatatttcctagcacaggcagcagtcaataagtatttgctgaatgaacaaaaaatggggccgggggtagatggcaaatggaaacctactctggaagcaacattcattctaattcttttcctgaaaaaaaaaaaaaaaaaaaaaaaaaaaa

SEQ ID NO: 121784 - DNA, 455 bp, Homo sapiens
tgtatttgtgatagtgtagcatcaatgaacaaagtcagtgctaatggttttctctaaagtaatgttgcttctttgtggactctcccaaacatgtattgattcatagacaaggcctggactctgcttctgggaggaaaagctgagctgggaactggccctctgcccaccaccttggaagatcagcccagaatgctgagggtgacaagtcagtgtggtaactgggagccagggggctggagaagggctccctggactgacatcatggttactgaactttgaaggtcaaaggtggtgcagtagacctgcattgagaggaaagataggttcaggtttgggagtacaaggggagaagaccaaagatttagggaggcaaagagagctcctgtctttggacagggaaggaaagccttgagttggagtggaggacaaagcggggtgatgatgagctatgctca

SEQ ID NO: 121785 - DNA, 264 bp, Homo sapiens
actgtaggttctcacttacatgtggaagctaaaaaagtagatctcatagaagtatagagaagaatagtggctactagaggagaagaaggggagccaaggaagggaagcggagaagggagagtagccaaaggttggttaatggatatataagtacaactagagaggaggagtaagttccagtgttctatagcactatagggtaactataattaacagcaacttgttgtatattttcaaataactataaaagcaggatttaaatgt

SEQ ID NO: 121786 - DNA, 476 bp, Homo sapiens
attcaacacttcagaaaaaatagaccaattccttaaaaaacaaaagttactaaaatgtacccaagatgaagtagagaatcttagtagtccattaatgactaaagaaattgaatttgtaattagaagttcccaaaaaagaaatctctgggcccagataatttcgctggagaattctatggtacatttaaagaagaattattactagctgtatgcagtctcctctagaaaatagaagaggagggaaccattcccaactaattttacgaaaccagtattacactgataccaggaagaaagacagtgtactaaaggaaatcatggaacaaaatctctcaagaacaatggcacaaaaattctgaacaaaatatgggcaaatcaaagccagcaatatcttagaggaattatatgccatgaccaagtgtgatttattccaggtgtgcaaggctgtttgaagagttgaaaatcaaccagtgtat

SEQ ID NO: 121787 - DNA, 92 bp, Homo sapiens
cgccccaggtgagtcctgcgcgttccctactctggggcccgcgggaggggctggagcgcaggcggagggccggccggggtaggggaggaccg

SEQ ID NO: 121788 - DNA, 238 bp, Homo sapiens
agagcaaaactcccatctcaaaacaacaacaataaacttagtagccactcatttattgaatgcttactatttgcttagtgctgtccatgcgctctctcatttaatcctcattaaaaactctttgagaaagcactatggcccccattatacagatgaagaaacctaggtttggacagattaagtaacttgccaaaagtgatacagcaaaaccttggcaggattctcattccagagcctc

SEQ ID NO: 121789 - DNA, 157 bp, Homo sapiens
cccgccccgctggaaagagcctgaagaaggtggagctcgactctcaagcccaggctctgctgccgtccacgtcttctgagcaagcctctgtgccctggcccagctcaaacaggctctctgcctttgaaccttccccctggatttgtcagcccccagg

SEQ ID NO: 121790 - DNA, 613 bp, Homo sapiens
ggagaatgggagagccacgacgggttaaggtctgttatcattcatcccctgggactgaaactactggggttctgctagcaagaaagacaaagggggatgagtggcaacaaatagtgactgccacaatcatttgcttggtgcaatcttgggtgaattacttaacatctgttttggtcagcttgggctggtataacgaaataccataagctgggtaacttataaacaacatgagtttatttctaacagtactgaaagctgggaagtccaagatcaaggcagattcagtgtctagtgagggcttctttcctggttcatagatggcaccttcttgctgtgtcctcacagggtagaaggggctagatagctctccaggtctcttttatatgggcactaatctcattcatgagagctataccttcatgacctaataatctagaagcccccacctcttaacactatcacattagtgattgggtgtcaatatataattttgggttgagaaggacacaaacattcagaccatagcagcatctgtgccttgatttccatatcagcaaaattgagatagtgataaaacctaactcctaggcttgggatgagaattaaatgacat

SEQ ID NO: 121791 - DNA, 786 bp, Homo sapiens
tgcaggcaaactccaccccggggagctgttgtgcttgcattgctgggctgctgatagactgattgagtggtggcgtgtacttttgtcacaagaaccataaccacaatgacagccacacagcatggacctagcgtgtgctcagctctggacaagacatggatgtaggcagacatgcttcctgcctgctgggcttagtgcaccaatgctaaggacagacatgaagggcttgggaaaggcatgaagatgcagggagtctaggagagaggataagaaaaacaagcattttgtggtgggttgaattgcgttgtcgtttttagaggcatttcgtgatccatggttgcgctcccgtgaagagcgagtctagagaaggaatccgaaggtgggtgagagttgagggaatttgaattccataattacgactcgaatttctgcaatcagctcgcggctgtgttgcctgctcctgccacaaaaacgccatgcagcgccgagccaagtcggatggaagtgggttagggtattatataagcccttgcgggagggaagatggtcttttatgtgtgtttcttttgcagcggcggcggcgagcgcggctcaggttgatttagaatacgggtgacagtggcctggcgcgagcccactgctgacgaaagcggcttatcccgcgcggtttccatggagacgagccggagccgcggcggcggcggggctgtcagcgagcgcggcggagctggcgcgtccgtgggggtctgcaggaggaaggcggaggccggggccgggaccgggacc

SEQ ID NO: 121792 - DNA, 486 bp, Homo sapiens
gctttgaatgtagcccaacacaaattcttaaactttcttaaaacattatgagttgtttgtttgttttagttcatcagctgtcattagtgttagcgtattttatgtgtggcctaagatagttcttcttccagtgtggctcagggaagccaaaaggttggacacctcctgtcttagacccgttccttaaaggaagtaaggcaaccaggacttaatagatgattgcatattgcattctttactagtcaaaggaaattcgtgtgactaataccagaacaccactagcagattgtgtttgattggcatatcaaaattattcattagcaattgtgagaattgctgaaatggtacaacaaagtaaattaggaacatctggatttttcaggggaaggcaagagatagcaggggtagtcgggttgttaattcctaaattaagtgaattaacactggtgcttagtatcctaagtacagaaatagcctgaggccctt

SEQ ID NO: 121793 - DNA, 273 bp, Homo sapiens
cctgcctcggcctcccaaagtgctgggattacaggtgtgagccactgcacccatcctaaccttttcactgtttagagatttgtttcccagtagatttatgttcatctttctgtccatttatcaggaattttatgaagatttgatgagtgacagaagggctgcttagcaccacaggatttaaaagatagtaccttccctcaaagagctcacagtcttcgtgttccaactgtaatatgggatggattctataataaagtaataatagagttctct

SEQ ID NO: 121794 - DNA, 473 bp, Homo sapiens
  misc_feature (435)..(435): n is a, c, g, or t
ttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttcctttagtagatctggtccagggtcacaactaaacactaaattacaaaaggcacagtcatttgatgtggccagtgtcccaccagtggcagagtgggctgttcctcagtcatcaagactgaaatacaggcnattattcaatagtcatgacaaaactatgagtggacact

SEQ ID NO: 121795 - DNA, 514 bp, Homo sapiens
attttattctactgtggtctaagaagatacctgatacaatttttatttttttgaatttaataagactcaatttatggccaacaatgtggtctattttggagaatgttctatgtacagataagaacattgtatattatgtgtttgttgggtagaatgttctgtaaatgtctattaggtgcctgtggcctagaatccagtttaaagttttctttgctgattttcggcctcaatattctgtctagtgctgtaagtggtatattgaagttctcaaccattactctattgctatctctttccttaggaccagtagtatttgttttatgaatctgggtgctacaatgttgggttcatatatatttgaaacagttatatcttcttgttaaattgaaacatcattattttatgaccttgtcttttttttaggtttgttggtttaaagtacattttatctgatatacacatagctactcctgttcatttttgctttccatttgtgttaaatatcttttctcgc

SEQ ID NO: 121796 - DNA, 599 bp, Homo sapiens
gaggtgggatgtgaagtgtggaagctgcggacagaaaagtgctataccttacactaaggagtgtggatgttctcccgtaagcactgaagtaccccgaaggctatggccatttaccaagactaaaatggctctgtcaactattctgagaaaaatctttgattcttctatctaggtcataaactataaatctggctaaattggcagtcatagtggattaacataggctttctaaccagaatgacttccgttaattgacaaaagtgctgccaaatggcttcatctgaatagaagacagcatgggggaaaaccagtaaacagaaaactaggaagcatttactctgccttttcagtactaactacattttaaggtaaccaaagagttacatttaaggtaactctcttgataagggaggaaaaactctttgctacagaagaaagtttgccaaaaaaaaaaaaaaatgtaaaagaggctgggtgcggtggctcacgcctgtaatcccagcacttagggatcacctgagggtcaggagttcgagaccagtctgaccaacatggagaaaccccatctctactaaaaaaaattacaaaattagccgggc

SEQ ID NO: 121797 - DNA, 720 bp, Homo sapiens
ggatctatagaacttcatctcttacccccacagacctattaataaaaggatacattcataggagactgtgttgacccttttacacacccattgcctgtgtgtgccgattaatggacttaggtaaactttagcgttttggtaggcaacgcaatttttcaatgccttttctttctttttcttgtacatctttaaaggccttactccagtaagtgtgcattgcagtttattaatgcctatcccttaatgagtccttgtcatgcatttttgttattaatcataattcacaattcttataattcagagacaccagagattcacataagaagaatggcattgagtttttatttatttatttgtttttttctgtagattatcaaattcattcatttgtatcaagtcactaagtgtatactttgttttctaaaaaaaaaaattccaataattttttttttaagacaggctatcgctctgtcacccagactggagtgcagtggtataatcatggccactgtaacctcagcctcctgggctcaagtgatcctccctcagcctatgtagtaagctgagaccacaggcatgcaccaatatgcccacctaattaaaattttttttgtagatatgtgtgtctcactatgttgcagagactggtcttgaactcctgggctcaactcattctcccaccttggcctcccaaagtgttgagattacaggtgtgagcca

SEQ ID NO: 121798 - DNA, 381 bp, Homo sapiens
gaaacttggagaaattaaggggctttaccaagtacacatggcaagttagtgaagatactaagataatatataggccgtaagacatcagagtctgtgctaaatactgaagagagaaatgaataaagtgaacaaggaacaaacccctgctgtcacagtgctcacaatctcaagggggaaggcagcaactaaatagtttcagaaaactatgtgcagatgagaaacacacaatgtcacatagtagttcagagtattaattacctaactctaccacaagagcaagttgattaggaccttccagagaaagtgactcttgattggcatcttgaagaatgactagaagttcagcgtgtgggcagagaaggcactggcattaccagcaga

SEQ ID NO: 121799 - DNA, 242 bp, Homo sapiens
aatcagatgttggctaaacgaagaggccttatatcactaggattaaattagagataatggtgtgattttataagcgcatactaggaaatatgtcttaaggagggcctgtttggatgattgtgaaaaatgaggtgtagctgatgtttgctgcattgaaagaaggtgaagtggggattttctgccccttctccaagtaccatgtgcagagcttctcttttggttccattctttgtttttttgct

SEQ ID NO: 121800 - DNA, 236 bp, Homo sapiens
ggcgagtgctgggtcaggactgaccaccaggttgtttcaactcagagccggggccaggaccggaccttcctgccacaccacacagatggccatacaccacacattccccacatctcctgctagctgacccagccacagctggagccggaagccctttcactccctccagccctctgcagggaagcacgtgctcaaccaacaaggtccctctggggccgggctgggggcctgtgtcc

SEQ ID NO: 121801 - DNA, 451 bp, Homo sapiens
tgaggtttatgtgcgggtaaaattaggagggcacccttaaaggctctgaatgttagaaacggtgctatgaatttgtgagtgtccaaaatcttttattgttgcagaattttctggtttaggacaacattgtttacaatccattaattagctggaactcaggaacctttttggtatgaagtaatttcctgtgccaaggaatttgacctgtttatcagtatttggggaagttcctggaatgtccgtccttccttctttgccctccctcactgctgtatctctttgtcacatttcttctcttccttcaaatcatagttcccacactgcctgtcatactgggttatcctgattggaattactcttcccaaaaagtatgcacagtgttttactttttctttattatcaggtacgtcatttgtccttttcccctgaattagtgggtatattgaccaaa

SEQ ID NO: 121802 - DNA, 681 bp, Homo sapiens
aggtggctgggccttcctggtcccctccttggctgcggtggaggccgaggacagccaggacccaggggaagacacagttctgtggtggccaggcctgtgggcaccaggagcagagggaagggaggatggctggggccaggggtctgggagcagagggacgctcagccacctgctgcggtgggcggctgatgggctgtgcgagagacactggtgtgggcagaggactcgggaaactgcagcctcccaagcgggtcgggagctggcccagccccgggaggcccctctgccggggaacgaagccaaggcctgagagtgacgcagcctcccaaggccacgctgccggcgaggggccaggcctgtccttcccgagtgcagcaccacttctgggacacacacgtggttctcagtgctaggggccggagcagcccccgccggcctggccaggactgagtgcaggaaggggctgccccaggcagtgtgctgggagggacctggggccctcacggctcgcagctgccaccagagctgcccccatttttttttcttttaatgcttaaagaatgcagctttattcatgtccattggggcagctcaaaacgtagttgataaatctattcaaatttattttcctagtagaagccctgaaggggttgtttgctgtttgttgaaatgaaatccacg

SEQ ID NO: 121803 - DNA, 412 bp, Homo sapiens
taggtaaagctgcaacaaagtccagactcagctccactgcagattaaatggaatcagccctccacatcactggccttacagaggaaagggcatgccttagagaagaagtccccaacccccaggccatggacccccaggccatggaccagtactggttggtagcctattaggaatagggccatgcagcaggaggtgagcaacagccaagcgagcattaccacctgatctccacctcccgtcgtatcagcagcattagattctcataggagcgcaaatcctattgtgaactgcacatgcaagggatctaggttgtgtgctccttctgagaatctaaagccttatgatctgaggtgaacagtttcatcccaaaaccatgccccacatcccccacctcagtctgtgaaaaaattgc

SEQ ID NO: 121804 - DNA, 469 bp, Homo sapiens
acagatgactcccagctctgttacacaattctaaatttcagtttttcaactctacaaatgaaagtgtctcagtccagaaaacaacgactgtgccagtggcaacttcctcatttgctgaagtcttggctctcctggaccattctaacttaataactgcttgctgcgtggagaaagaggacatcctagactggaaaacagacgagtggtttagtgatgaaggtgacattctggaatgttcaggaaatccccccatgagcaaaacacagaaggcatgtctgacactcatgcttctaggccagacgctgagaattttccccgggtcctcattacattcccacaggagcccggggagtgcacctgcccatggagctatcgtggagtttgcatcttccacccttcacctccagactgtcctccttattcattaggaagttagtgtcagctgcaaattcagggacctgcttctgaa

SEQ ID NO: 121805 - DNA, 471 bp, Homo sapiens
acattgcttgttttctgatttaatatatatattttttgtttttggagggtatccttgagtaattctttgagaatgttttgagtccttggatatctgaaaataactttatttatttattttaaaattttattttagagatgggttttcactgtattgcccaggctggagtgcagtgactactcacaggcactttcatagaacactacaggctttaacgcctagcctcaagtggtcctcccacctcagtctcccaagtagctgggaataccagtgcatgctaccacacctggcaaatggctttatttttgctttcatgtcagtaaatatctttttacttgggaacattgactacatggctccattatttttttccatctaatgttatatgtaagaattctgatgctaatcccaattcttgtattttgcagttctctactacttctgctacttctctttgatagaagattgtac

SEQ ID NO: 121806 - DNA, 277 bp, Homo sapiens
  misc_feature (46)..(46): n is a, c, g, or t
ctggtgtgtacgagcagttgggattgacagcagcaggaggatcttnagcccaaggaagaggttctgccatctggcagaaccctcttgtgccagatggggagctctatccttgagggaacctatgccctcccccagcccccactcccatgacaatcctggcgtgtaccttccttttgtgctgccctgcctgcttctcaaggtgagggttgggacacaggaccttgagtactaaggtcctgagtcactctcaatccttgtgccagggtggtggtgtacg

SEQ ID NO: 121807 - DNA, 310 bp, Homo sapiens
tgtggagctgacctcccctatccaggccacctagccctcttaggcgcacgtgaagggaggaggccggatgggctagaggttggagtaagatgcaacgaggcactattcttggctccaccacttgatatcagcctcagtttcttacatgtaaagtggatacaaccgtaccccctccaccgtaggtttgccgtgagattgaaatgagagagcgttcgaaccgtttggcacagcacctgcacgtaaagatgcttgatcaatgttgtcatgattacagttgagctgactgggcccttgggacccggactggagt

SEQ ID NO: 121808 - DNA, 234 bp, Homo sapiens
gattagaggatccatagtcacggtttggtacgatatacgatgaggaagatgacagctcaagccaaccgtggacactagtccaggtgggctgctactacaggaccttccgagtattgatttctttcgaggttgctgtttagttaatggaatacgcagttagtgatgaggaagaggaaaaggtctcagaactcacattcttggtgtagggaaatctctgcagatgcatcatacatt

SEQ ID NO: 121809 - DNA, 427 bp, Homo sapiens
ggacaggaatgttcgtaatgttcaatgcccctcatttttgccacatgtgggaagtgaggtatagagaaaggcggagtgacttgtcctagtggcagttagcctcgtgagtagccaggatcaagatgggaacccgggtcttcatgaactctccgaatgccttctttcagcagttactttggaattagaaccgattaaagtgtttgctgccttgatgtggggtgtgagttgtgttccacagacacagagctcggtggattaatggtgtgctggaacgtgtttaactgtgggctctctgaggggaaaaagcgtgattatccataagtacgtaagtttattatacattttgctgttatgaaagatgtggaacatgcaatttataataacgataaaatatataacactctttgttataaattccatagaacca

SEQ ID NO: 121810 - DNA, 201 bp, Homo sapiens
gtgaaaggtggtggggggtaagcaggtgtttcggaaggagtagaggagggcccggaatggggccacgtaggaaagggtcacatccattcaccctggagtcagcccgagggcccaggcagggtggggtcctagtgatgcctgtcggtgggtgacatcaggccatccacagcaccgggagccagcagaaagggctgggccagg

SEQ ID NO: 121811 - DNA, 243 bp, Homo sapiens
agtttgggatatggttgtcatacggtgatcagaaatgcctttctggagcttgaaagagggtcagagagggagctacgggtgtatagtttaacagctagagatggttgttgaggtagaggaagtgtacactgtcaccaaggggaagagtacaggcagaagagtggagtgtcgcgggcgaccttgggaaatatctcctctttagaggcaggaaaaagaaaatatgctagtgatggaagaaggtgc

SEQ ID NO: 121812 - DNA, 463 bp, Homo sapiens
aggtgtgagccactgtgtgcagccaagaatgaccttttcttgggaatctaatcattgcagagccaaacattactcactgaggcatgactcttccctcacctttataggtcctttcttctacttttgtccttttgagcttattctctaccaaaggggccaaaactttctgtgcaacggaatgctgtggaatgcatcctgagactgctggcattcacatctccaagagctctggctactaaaaccatctatcatgagcagttgacagtagctgcaggctaagatccaaagggctgtccctcctgaagtgtttcaaagttgagtcgtgtttcccagcagcaagagagccgcatatgtatcgcggaagcaaatctctctagaccacacttggcgagaccgactttgatttttcttgataaatgtttctttactatctttgttgaaactcagccagcccagatggtac

SEQ ID NO: 121813 - DNA, 265 bp, Homo sapiens
gatgatgggggtgatgaggatgaggatgagggggctgatgaggatgaggggggtgatgaggatgaggggggtgataaggatgagggtgatgaggatgagggtgaagagggtgatgaggatgagggatgatggggtgatgaggatgaggatgatgagggtgatgaggatgaggatgatgggggtgatgaggatgaggatgatgggggtgaggaggatgaggatgatgagggtgatgaggatgatgagggtgatgggcgtgatgagg

SEQ ID NO: 121814 - DNA, 444 bp, Homo sapiens
taaatggaattaaccattatgctttagtagaagtccatattagaaccttattggaattcaagggcttaaatcccaggcagcgtgttctcattgcctttatgctttcctagtcctgcttggtcatttaagagaggaggggaaaaggactgctaacgtgggaaagcatctaacatagagagacagaggaagaacgtctagaacaagcttgtccaacctccggcccacgggccgcatgtggcccaagacagctttgaatgcatcccaacagaaattcacgaagtttcttaaaacgttacaaaatttttctctctctctctctctgtgtgtgtgtgtgtgtgtgtgtgtgtttcctagctcatcagctattgttagtgttagtgtattttatgtgtggcccaagaagtcttcttccaacgtggcccagggaagccaaaagattggaca

SEQ ID NO: 121815 - DNA, 337 bp, Homo sapiens
gcaggaaacagcgtatacggggcagacgggatcacggaggaaaagagcaactgaccggcagccgccagacacgcgagaaggcaaagaaagaaaggaaggaggtggcctgcagccaggagatcctcactttcaagaaggcaataaacaatgatgctcaaaaagcacaagatttccatttctctaatagtgagcaagaagaaaagtctagttcctttcatgctggaaggttaaggatagaaggaggccatgtgtggtattatagagagatattgaaatgggagtcaggagactcagctctgcttctatttagctgtgtgactttgggcaaatcacttca

SEQ ID NO: 121816 - DNA, 1068 bp, Homo sapiens
tgctaaacttacgaaacaaggcagtaaaattttaatcactactgatgaaacttgattttatataagagttttaatattctgcttaaaatgtaaaatgcaagaagactttgatggtttcgttttttgttagaaagaataacatctaaaataccatatcaaacttcactgttagtacttgagaaaaaaatggtttcagtgagagaaatatttacattaaacaggttttatatagacagcacccttgtaatgcttggtaaacaatctagaattccaaccaatattttagaaaaatttctaggtattttattatggtgttgtataagtcaccacattcaattttccgtggatgaggtatcaatatacagataagtaaatctcttaattgttttctaaataaactttatatttaccacacacatgaaatcatcaaagagaattacagtacatctgaagaactggaattgaaataacaaaaataggatcctcagtgggtattctctggtgatagagcttcaatttttaatttcaattaaaataaataggcttgatataattttcaaactgttttatatcaagcttgcgtattttaattgaaattctgaaattgaaatagttgaacatttagaaaatgagcatttttgagtggcttggcttcagtacacaatattccaacaccattgtcaatacttagcgttataaaaaggtttcagttactaacatgaactgagagatacagcaaatattaaagatgattgaacatatgaaactgaaaaactataaaaaggtagaagctattgtaaaaatgaagaaaactgaaaaactgaaaagataagaagttactgtaaaaagaaaacggttataccatttgaagcagaacaaaatgttccaataaactttttttacttaataatagaaatattgaaaatgcaaaactctgaaggtattacaagggctagacaaattttgaattgtttggcataagaagggagaggatttattgaatattattaatatgaagacaaaatctgcttattgagatatctcacctattatcattttaatagagaa

SEQ ID NO: 121817 - DNA, 272 bp, Homo sapiens
caaatgccactttctaatgagcagagatgttgaagtgttctgctttactgacttgaacatcttgtttactacacaatgtatttgtagtaaataaaagcaggcttttaacaaggtaaagattaatattctagatttgttactacaaagaataacaacttaaaattgaaattagtcagaaattataacaaactatctctcagaccacagtgcaatcaaactagaactcaggattaagaatctcactcaaagccgctcaactactcgggaaagtg

SEQ ID NO: 121818 - DNA, 354 bp, Homo sapiens
tctcctattccattgatctgtgtctttcatttctctatcacctcactgttgattactgtcaccttagagtaagttttaaaatcaggtagtgtgagttatcttattatttttcagaattgttttttgggtattttagttgcattgccttttgtgcatattttagattacaggcgtgagctacagcgctgggcgtgatttctttttgttactttgctgaactatctaggaccctcagtgtaatgtgtaataggagttttacaagtggacatcctttcctttttcctgatgttagaggggaaaacactgagtgtttgaccattaatatgatggtagccataggtgtttgtttttgta

SEQ ID NO: 121819 - DNA, 557 bp, Homo sapiens
actgctcttttcttcctggaggctctctctaagcaagggtgggcaaaccatttgctttaagagattgattgtaaatcttttaggctttgccagccatatggtctctgtcccaactactcaactctgccatcgtagcataaaatcaaccatagacaatacgtaaaagaatgagcctggcggtgttccaataaaactttatggacacaaaaatttgaatttcgtgtcattttcacgtgtccagaaacattttttgatgttttcccaaccatttgaaagtgtaagatccattcctagttcctatcactctaagcacattccattataacatctccatgggccgggcatggtggctcatgcctgtaatcccagcactttgggaggttgaggcaggtggatcagaaggtcaggagttcaagaccagcctgacaacatgatgaaaccccatctctactaaaaatacaaaaattagccgggtgtggtggcacacgcctgtaatcccagctactcgggaggctgaggcaggagaattgcttgaacccaggaggcggaggttgcag

SEQ ID NO: 121820 - DNA, 700 bp, Homo sapiens
agcagtggcaacccacttatgtttcctggctttgtttttttgctctttgtaataagtcttgctgctgctgctcatctttgggtcctggccgcctttatgggccgtatcaccgtgaaggtctgcagcttcactcctgaggccagcaagaccgtgagcccaccagaaggagcgaacaactcgagacgcaccgcttttaagagctgtaacactcaccacaaaggtctgtagcatcactcctgaagtcagcgggaccacgaacctaccagaaagaagaaactccatacagatctgaaaatctgaaggaacaaactccggacacaccatctttaagaactgtaacactcactgcgagggtccacggcttcatttttgaagtcagccagaccaagaacccaccaattccgcacacacttctgctgtttcgttctattctcaaggaaaaactgtgatgggtccatttttaatcacatgcaaattcatgggcaaatctttgctatggttatgtattttgatttagtagagttgtatcacatgttcactcatgtgcccacaatagcagggtataccaataggctgcttcaaaacaatcatgaaaagtaggaggtggtgtttccaaaggtagtggtcttgccagaaaaaatggaaatactgtgaagataaaaataaacatctattaacacaaaaatagaaaaataatata

SEQ ID NO: 121821 - DNA, 185 bp, Homo sapiens
ggatggagggggctgggaaggggtccagcgctaggatggagtggagggggctgggaaggcgtccagcgctagtatggagtgaagggggctgggaaggcatccagcgctaggatggacggagggggctgggaaggcgtccagcactaggagaagagctctgagaagctgaactgggccgaaggcca

SEQ ID NO: 121822 - DNA, 540 bp, Homo sapiens
taatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaagg

SEQ ID NO: 121823 - DNA, 515 bp, Homo sapiens
ggacatttcacataaaattatataatatatggcttttgtgtttggcttatttcatttagtaaaatgtttccaaggttcatccatattatggcatataacagtatttcattccatttgacagctgaataccttaattccatttgtatagatacttcatatcttatttatccatgtacggacacaggttgtttcactttttggcagtgaataatgctcctatgaacatccttgtacaaagttttgtgggtatatatcttcatttctcttgggtatacacctagaagtggaatggctcgctagaactcatatggtaactctatgtttaacttttcttttttttccccaagacagagtctcgctctgtcacccaggctggagtgcagtggcgtgatctcggctcactgcaagctccacctcctgggttcaagggatcctcccacttctgtctcttgagtagctggggctgcagatgtgcaccacaatgcccagctaatttttaaaatttattttttgtt

SEQ ID NO: 121824 - DNA, 517 bp, Homo sapiens
tgtcactttgatatggcgtcacaataatacacacattttgctcacttgtgcaggtatagataaaaaataagttgcctggatcagaaaactgaactttgttaaaaaacaaataaatacatttttaaaaagaaaagtgcatttaaaaagaaaaaataagttgctaaggaagcaacttctggaattaagaatatgaacatttacagttttaacaagcaagactaaactaccctacacatgtacaaagtcagtatacactcacacctcagtgtatgagactgtctgcttccctaaacccttgccaacacaggtattatgaatctttttaatctctgccaatctgatgtctgaaaaattatatctcgttgttgctttgatttgcatttctttgatcatcagtgaggctggacatcttttctcatgtttgactctataaaaggctattttcttcttctgtggatagcatgttcatatattttgccggctttttactggcttgttcatttaaaaaaaacttttt

SEQ ID NO: 121825 - DNA, 324 bp, Homo sapiens
gaaactaaatcctggtggagaagagctgcaccatgccaaacagtcgatttccttttcagcagagtcatacatcactgacccacccttccctcctgacagaatgacatatgtcatttatcatatgggccccagccagactacggggaggggagggaagcccaggtccatgtgaggctgtctcttcctcctcttggtactgtaccctgtggcttgcaggagggagctctgctgatttggcaagagggaaagggaggaaagaggctgggcaggggagaagggggtagagcctgcttctggatggctgggtgcgtggcgtggcgggtg

SEQ ID NO: 121826 - DNA, 263 bp, Homo sapiens
agtgagaggaaagtggcttgaactgaggtcagagccactggccggagtgagatcatgagggccttacagcactaatactggaggccctggattttgttttagggcagtcactactaatttagtgactttggtcaataaatatcctgactgagccttggcttcttttctttatagagtgtcactctgtcgcccaggctggagtgcagtggcgccatcttggctcactgctagctctgcctcccgggttcacgccattctcctgc

SEQ ID NO: 121827 - DNA, 679 bp, Homo sapiens
caggccggctgcggtggctcacacctgtaatcccagcactttgggaggctgaggcgggtagatcatgaggtcaggagatcaagaccatcctggccaacatggtgaaactctctctactaaaaatacaaaaattagctgggcgtggtggcgtgtgcatgtagtcccagctactcaggaaaatgaggcaggagaatcgcttgaaccaggaagttggaggttgcagtgagccgagatcgcaccactgcactccagcctggcaacagagtgagactccgtctcgaaaataaaaagaaaaatcagtaattccatcactaagagatggccactaattaacgttttggcccatattcttccgactgtttctaggcatatatcaataaatattttaaacagaaatggcctcattcagttctataacctaatttttaattttatttttattttatgactatttaaaacttatctgtattgatcttttgcttaacgcatgtatctatggagtcatttttgatggttgcatttttaaaagatatcatgttattaaccaacttctagttttgatcatttattttcagtttctggggtatttttcgggggtggttactgctgcaaaaaaatttcttaatgagtgactttgtcttatctgggggcagttatttccttaagattcattcctaga

SEQ ID NO: 121828 - DNA, 202 bp, Homo sapiens
cacagaggtggtaggtgggagacaggtccatccaatatacaccttgccttccaatagaagccaaagccctattgcctaatctcttcactttaagaacatgaagaatagtgttgagttcccctttgagatctgactgtggttaaagcttcacaaatttcagaaaaacagaataactcactaaaataaaaatttaaagctaccc

SEQ ID NO: 121829 - DNA, 360 bp, Homo sapiens
aaaaaatgctgctgtcaggaatctgattttatttcagaaaaatgaagcctcttttttggtaactttttgggaatttcttagaaaatggcacgtgttcattgataaggggcagtggagtgtagactgggtgactggcaaaatgaaaagactcagttgcctatgacttctcttcccctgggaaaccttgttaatgctttggtgcaccacctccttctggaacattttatattacttttccaatgtttccaaacattttccaatagctgtgaatggctaaacttggtcaaatgaatgtcctttaatttcatatttagataatttctaactatttttcctataataaacaatgaactgtaaaac

SEQ ID NO: 121830 - DNA, 1585 bp, Homo sapiens
ttactggtaatgaaagaaaacagtactatgatagctcatggagctaagatagcatatgaaagttagtcttacaaaaggactactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaaaaaaatct

SEQ ID NO: 121831 - DNA, 1609 bp, Homo sapiens
ggcgtgagccacagtgcccggcctgtatttggtgatattttaaaaaattctactttgaccttaagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcatttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacattttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaaaaaaatct

SEQ ID NO: 121832 - DNA, 316 bp, Homo sapiens
catgccgggggctgctggagaaatgggattcccatttaactgcccgtcatctcatttctccagcacagtgaccatctgagagaaatagtattgttccatttcacaggtgggtaaactgaggccattaagtgacagaactgggagttcttctaaattcaaatacggtgactgtccttcaaattggcagaaccaaagacctctgggaattgaaggttaggggcctccataaatgggcctccccctcccctgtggctgtttatgctgccccagagtgggtatttcttctactctgtctccacacacagacgcgcacacc

SEQ ID NO: 121833 - DNA, 523 bp, Homo sapiens
tcaccattgcactccagccccggcgacagagtgagactctatctcaaaagaataaaacaaaaacaaaagatgaagaaaaagtcttaacgtagttggacttatctcttactttttgatttggagagtgagagagagagagagagagagagagagagagtgtgtgtgtgtgtgtgtgtgtgcgcgtgtgtgtgtgagaaagagaaagatttaagaaattgttttctactttagactcataaaaatattctatattgtcttctagagatatttttcattgttcttttgaatccgtctttaaaccatgtggaattgatttttggtgtgtataggatatggggagagatccaattctgttttccccacatgcagataatcacctgttcagcaccatttattgtccattccctttttttctcagtgctctttagtgaccttgctgttgtaaaacagatttcaacatctgtttctggtctttccgttctattccatgggccagtttgtctctaccctggtgccattccat

SEQ ID NO: 121834 - DNA, 1160 bp, Homo sapiens
cggggctacgaccttgcccgtggaagcccgtgcctccgacccccttgggttgtcccaacgcgtcgggtcccgcggcgcttttttattgggggaaacccaccgccatgttcgcggcccgggggttctcttgggcccccgtttgccccgaggtcgctgtaaccacatggggccccggcgccccacacgaggggtttgaaaaccttttctctgggccccaggcggcccccacaaatttttttttttttttttttttttttttttaagtagagacggggtttcaccatgttagccaggatggtctcgatctcctgacctcgtgatctgcccgcctcggcctcccaaagtgctgggattacaggcgtgagccaccgcgcctggcctaacctgcattttaatgatgggcacgcatgctcaccgtggtgggtggcctaacctgtcttaatatcaaatgatcagccagtgcattctctgggcagggaagtgacacagatgtgtcaccccaccgccctcttggtgactgcaaaagtctaaaaagaaagacaacggcaatgattctaattgtcatcaaggacaccagtgtcaccaattgcgactggttttgcaggcccagtaaacagactacatttccagtgtgttttacagtctgtcactggccacaagtgcttgaccagggagctgaaggccaaaaaaaactaaagccaagatcagatctaacagcacagatgctactttgagccccaaagtggccaaggaacacacatcccagcctgccccgtccagaccatggggcaggcctttggtccaagtgctgccccctcccacagcagacaagccactcatggtacaaggggaggtggggaagagaagagcaagacacaagagctgcctgaacgccacacaccactaacggggacaacttgccagatatccacctaggctgtgttgaagtctgcccaatccatggaccacggaagccacagcccagtctcctcccaggtgaagtaaggaaatggagacggtgagccacatcggcaatggcaagtccttctttccaagacctctgcgctttccttcatgacatggtcttccaaaaaaatagctgcataaatcagatcctgtcttgattacctctctaccagagatcagcatagtacctggca

SEQ ID NO: 121835 - DNA, 812 bp, Homo sapiens
tggaagacttcatgctgcccagtaagactttagaggcactgagagcacatcataaattcatatgcatcaggtaacatagccccagagaatataaaggaaaactgatagaactaaaaggcgaaataggcatatttggagattttaacacgcttctctcattaacgaatagaaaaagcaaatgaaatttagtagagctatagaagatgtaagtaatgctattaactactttgtcctgactgagctataaaacactgcaccagacaatagtggattgcacattccttctaattggccacagtatattcatcagaattggccacatgcactgtcaaaagatttcaatgaattaaagtccttcagagtaagttatcaaaatggaggggaaaatgtgatctaatcaaagtagatgaacaaaagcatttgataaaatttaactcctgtttattagtttcaaaaaaaaaaaagccccacagaacaaatttctaacaaactgggaataaagggacttttaaaaagatgataaagggcatctacaaaaaatatttatagtggacattaagcttaatggtgacttattgaaagctttcttcccagagatgaggaaagagacaagaccctgctctcatcacttctattcagttttgtatgtaaagctctattgggaggctgaggcaggaggatcccctgaggccaagagtttgagacttggcctgggcaacatagtgagacccccgtccctacaaaaaattaaaaaataaagttctagtcagtgcagtaaggcagaaagagagataagaggtataaaattggaa

SEQ ID NO: 121836 - DNA, 735 bp, Homo sapiens
ggtcccccctgatatttctggctgccgttgagccaagaggtagatagatcccttccctttcaaaaaaaaaaacccgaaagcccccacctacacaaatataaacctggaccaaagtgtcaccaattaccattttagggctaatcaaccaaaggccaaccaccaactaagaagtatttttggccagacccagtggattgcacattccttctaattggccacagtatattcatcagaattggccacatgcactgtcaaaagatttcaatgaattaaagtccttcagagtaagttatcaaaatggaggggaaaatgtgatctaatcaaagtagatgaacaaaagcatttgataaaatttaactcctgtttattagtttcaaaaaaaaaaaagccccacagaacaaatttctaacaaactgggaataaagggacttttaaaaagatgataaagggcatctacaaaaaatatttatagtggacattaagcttaatggtgacttattgaaagctttcttcccagagatgaggaaagagacaagaccctgctctcatcacttctattcagttttgtatgtaaagctctattgggaggctgaggcaggaggatcccctgaggccaagagtttgagacttggcctgggcaacatagtgagacccccgtccctacaaaaaattaaaaaataaagttctagtcagtgcagtaaggcagaaagagagataagaggtataaaattggaa

SEQ ID NO: 121837 - DNA, 696 bp, Homo sapiens
tgcccctttcacctaaaacgtgtcctgattttccaaaagtatatttgagaaaattatggattttccttgaaacaagtgaaatcgtatgcttcaaaaatcagatcatcagttgattcctataaccaggacttaccttatttatctcattcaatcatttttttgatttattagtttcgataaattggcacactatgagaaacaatagtgattgtcaaacatccaatattatgtagtaagtagcatttattgaattcttactatgccctagttgcaatgttaattttgtgatatttcctaatcaatgtaatactcaaaacaaactatcagatattattattgtactggtgagaaaacagaggtgcagaaatcaataaatcatgtctttaaattgaattcacgtgtctacaagaaagataagagcagtcctgttagcttggagcaggagcccagttaggtcttgtcgttatgctgaatgcaaacaatttgagaaagaatcaacatcagacaaggccattgtgggactgtagtaaataagacaaaaacaaggccacttcatattcatgtctaaacacagacaaaacttgacaattgtctaagccacaaaatagcaaacatttctctacatcggctaatataagtgtctgctgtttccttcccaaataaacctggagcttcaaccttgtcatctctccttct

SEQ ID NO: 121838 - DNA, 435 bp, Homo sapiens
agagttggatcttgttggatgaggagaagtttgccagggaataaaggacattctagacatttacccaaaaacatcctgaaaaaggactcagtcctgagatagaaaagggccaaaaaatttgttagaccaaagccctgccctagaagggctcctagcctggcaagagaatggggtgggtgtggtgggagacagacttggacacaggaaaagacatcgcttactctgttcctcccacccaccatcccctaaaggcaagtaatggcaagaggcctctgggcccagaggataatgaggagcaaaggggacgcctcacactgccactgtggctgtggcttcagatccaggggctcagtgaacaggagaaggaacatagtcctcaggcctcccgtgtcctgggcactggctgggcagagggtatatacactaattgtgctg

SEQ ID NO: 121839 - DNA, 170 bp, Homo sapiens
ttcttctcttcaggtgttttttgcacaccgactttatgccccttatggttcagactccagatatagccatgaacaggacccaggacccttcttgctaggagctcacagtctagtggaggaaacagaggtagtcaccaggtattcctcagtgctgggtgaaggggaagcag

SEQ ID NO: 121840 - DNA, 462 bp, Homo sapiens
ttgctaagaaaaactaaagaagatataaataaatggaacaatattctgaattcttggaatgaaagaatcaatattgttagttgtctccaaattgatgtataaattcaaagcattcccagtgaaaatcccagaaggctttttttttcttttatctttttttttttttttggtagaagttgataagatgattctaaaatttatatagaaatgcaaaggacttagaatagccaagataattttgaaaaacaacaaagttgggggactcatactacctaattttgagacataaaactattgtaatcaaggtagtgtggtaatggtatcaagatggacaatatataagtagatataatggaaacatacatctcatgtatctggtgaattgacttttataaaggtttaaaggcacttcaacagagaaagcatagtcttcttaacaattgatcatccattcataaaaac

SEQ ID NO: 121841 - DNA, 525 bp, Homo sapiens
atgatgtaattggctggcggtgtagtctttcttattccattagcgctctaacacataaaccagttatttaaacatttttctaatggttccaaaatctgtcatgtctgagtctgattctgtgattgcttgtcttctcaaactgtttttataattgcccttggtatacctcaaaattttttgttgaaagccagacatttgtatagaagggcccagcaaacttgctctgtggaggatcagatagtaaatattttaggctttgaggtccacatacatgcagtcggttgcatttcttgttcttttcttccttcctctttctcctcctccttcttcaacccttaaaaatgatggaccctcaaggctgctgaacaggttcagactaattgtactgactcagcctcaggaagtcaggaaagcttcgtggaagaggtggctttgagagtttcgaaggaatacccggcatttcctgaggagtaggtggaagaaactgctggtgccaagtgccaagatatgttagaaccaagcatg

SEQ ID NO: 121842 - DNA, 715 bp, Homo sapiens
gagacacagatggtcactgtatcctcagatgtgtttaactccatttcagtggggccacctttgttgtttataacttctaggtatagattcttgtgggagttccaagatttgttttaagcagtttttcctttcttaacaaaaatagtaagcaccatataatgcttgcttcgtttcagtgatattttttcattcttcactctctcttgcacatttatttgatgctcaagtgatgatatacaaatcactgagaatattatttcctagttttctggaatattagaaggacaatattacatagaattttactttcacatatataattatttcaataatgttgccagaagaattgagtatctcttctgaacaaatgccgtgtctaagaacaagaaggatagaattaaatcaatgaggggatggaaagtaaaaaatgggtcagacgcagtggctcacacctgtaatcccagcactttgggaggccaagacaggcggatcacctgaagttgggagttcaagaccagcctgaccaacatagagaaaccccatctctactaaaaatacaaaactagctgggggtggtggcgcatgcctgtaatcccagctacttgggaggctgaggcaaaagaatcacttgaacccaggaggcagaggttgccatgagccgagactgcgccattgcactccaacctggacaacaagagcaaaactctgtctcaaa

SEQ ID NO: 121843 - DNA, 471 bp, Homo sapiens
gtttctgtgatttcgactaccttaaatacttcatatgaagggaaagtatttgtccttttgtgattggcttatttcacttagcataatgttcttgagattgatccatgttctagcatgtgacatgatttccttctttccgtaggctgcttagtcttccattgtatgtatataccatattttatcctttcattcaccaatggatatttggattgcatctcttggctactgtgaataatgctgtaatagggattgtatggaatttgtaaattgttttaggtaatatggacattttaacaatattaagtcttcaaatccacatgcatggagatgtcttttcatttatttatatactctttggtttcttgtagcattgttgttttgtaatttttagtgtccaagttgtttgcctccttggttaagtttatttctaagtattttgttctttttcatgctattataaataaaattgtg

SEQ ID NO: 121844 - DNA, 348 bp, Homo sapiens
tgacattgttgcaggacttttccttagttcagctaacgatggggtccttgttcgtcccatggccacaaaaatttaggctttcagacagtttgaagggtgagtgaagcacagttttactgggggaaaagggggaaaacagggcctctcgcaaagccagagtccctggtacagtgcttcctgcccggcagttcaaatcccaggttccacacaggaagaggaagggccaggctcctccctgctgcaaaggcggtgaacttcccgaggctccacctcagtgggcaggcagggtgcgggaataccaaggggggggtaccggagctcgaaattccgtacatcaatggtcaatag

SEQ ID NO: 121845 - DNA, 149 bp, Homo sapiens
atacgaaaaactagccgggcttgggggctgacacctgtagtctcagctccttgggaggctgaggtgggaggatggcttgagccagtaagtatgaaattagctgctgtgtaaaaaaattttgggccaggcacggtggctcacgcctgttt

SEQ ID NO: 121846 - DNA, 753 bp, Homo sapiens
cctgcctcggaagaaaagaaaaagaactacctgagattggtaatttataaagaaaaggggtttaactgactaacagtttctcatgactggggaggcttcatgaaacttatggtagaaggtgaagagaaaaaaagcaccttcacaaggcaggagagagagagtgagcaggggaagtgccacgcttttaaactatcagatctcctgagaactcactcagtatctcaagaacagcataggggaaaccgcccccatgatccggtcacttcccaccgggtccctcccttgacacatggggattacagttggcaatgagatttgggtggggacacagagccaaaccatataactgggcaaagtagcaagaccctatctcttaccaaaaaaaaagaatttttgttatttttattgttcatatattgagggcaaactgtccctctcactcctgaactcacacaccgcagttttggtttttcatcctttgtcaagtcaatttttaatgtgggtggtctctttcttttttttttgagatggggtcttggtacgttactcaggctggtgtcaaactcctgagttcaagtgatctgcccgccttggcctcccaaagtgctgggactgcaggcttgatgagcctccgcacctggccataatgtgggtggttttaattcatataaataaaaaatatttgaatgcgtgatattaattggaatcagttgcaaatctttccagttttttctaaaaaaaaaaaaaagcagc

SEQ ID NO: 121847 - DNA, 445 bp, Homo sapiens
gcagccgcctactactactaagttcgcggccgctcgacctgggcaaagtagcaagaccctatctcttaccaaaaaaaaagaatttttgttatttttattgttcatatattgagggcaaactgtccctctcactcctgaactcacacaccgcagttttggtttttcatcctttgtcaagtcaatttttaatgtgggtggtctctttcttttttttttgagatggggtcttggtacgttactcaggctggtgtcaaactcctgagttcaagtgatctgcccgccttggcctcccaaagtgctgggactgcaggcttgatgagcctccgcacctggccataatgtgggtggttttaattcatataaataaaaaatatttgaatgcgtgatattaattggaatcagttgcaaatctttccagttttttctaaaaaaaaaaaaaagcagc

SEQ ID NO: 121848 - DNA, 214 bp, Homo sapiens
  misc_feature (26)..(26): n is a, c, g, or t
tgtgtacgagatagctggcttctaangtgtaatttaaccaggtatcgtgagccaccatgcctggttcctatctctattataataaaaatgaattttttttaaaaaagaattagacaaaagcttttatgtgatttccccatgtcatgctagttactgtttcatagaacagcttcttgaattcactagtcatttttatacccatttatattacatt

SEQ ID NO: 121849 - DNA, 460 bp, Homo sapiens
tgcctttaaacaattttccctgggcaagagttcagcatgtaagaggttattaaagttccatactcctgtctctctaggcctgataaatactgcaaacttcatgtagctcagactgctctgagctatttttcttttctcagaacaagtggtagtgttttcaaaaaatgttactggaaaaattgtgcatccatattaaaaaaatagaaatcttaacctatacctcacaccatttataaaaattaactcaaagtagaccctatatctaattgtaaaacctaaaactctaatcaaacttttatcaaaaatcatagaagacattttttgattgtaggctaagcaaagtttttttaaagataggacacaaaaaacataaaccataaaagaaaacataaataaattagacttcgttgaaattaaaatgttctactctttgaaagtccctgttaaaataagacaagtc

SEQ ID NO: 121850 - DNA, 484 bp, Homo sapiens
tgggtctgctaaaagcaacatttgtcctaagacattctgtatacaaatagggcgcgtgactatggttttgtgagactatgtacaccaaaacaagtctaaaatcttaaatggaaagcaaaagaagaatgtcccagaatattagcaatgccttccatttcttggacatatgctaataatattcttttgattgttactaatgaatggtacagcagtcttaagatattatacaaacagatgataactactttctataacagaacttatttgaaaggaaggaacttaacacctcatcagtgaatagagataaaagccaacatttttaacccatttcacagtgggaaaattgatcagttaattatccaatgaaatcttagtttcctacattcccaaataagttgcgctccaatttattttaatggggcaaaaatatttctttggatgactcatctgacttatatttgtcttcacccctagaaactccttt

SEQ ID NO: 121851 - DNA, 423 bp, Homo sapiens
gtatttgggactgctttccttgcaagagttaaggaagacttacttggctactacaggaaatatctttccttcataccaccaatgctagataattttcaaaaacaagaatgaatcaactctttaaaataataattcaaaattatgttcactgatgagatttgaagtctattacatcatgaatgtgatggaaattgtacacctttcatcagagacaataaataatatagcttttaacagctttattttttttaatttataatagagatagggtcttgctacgttgcccaggcttttatcaaaaccctaggctccagcaattctccctccttggctcccaaagtgctgggattaaaggcatgagccactgtacccatcctttttctacttttttcttacccaaagagcaaagaccccaaaaggggt

SEQ ID NO: 121852 - DNA, 139 bp, Homo sapiens
ggcattgagagagagaaagagggacagagacaaagaaaacaacaaaacagagagatagaaaaagacaaagacacagggagagacagaaatttcaggaggcgagggcagccttgggcagggatgagtgggctctgaaata

SEQ ID NO: 121853 - DNA, 689 bp, Homo sapiens
aagaaaggtctgggctcaatggctcatgcctgtaatcccagcactttgggaggctaaggtgggtgtatcacttgtgtccaggagttcgagaccaccctgggcatgtggtgaaacccttctttattttaacaaaaaaattttgaagaagcaaaaagaaatttatactagggccgggcgtggtggcttacacctgaaatctcagcactgagggaggctgaggctggtgaatcacttgaggtcaggaatttaagaccagcctggataacatagcaagaccctgtgtctaaaaaaatattagccaggtgtggcacatgcctgtagtcccagctactggggaggctgagggaggagcatcacttgagcctagcaggtcgaggctgaagtgagctgtgatgacgccactgcactccaatgtgggcgacagagtgagaccctgtttcaaaaaaataaaaataaaatccatatataaaaactgcatggttaagttttcagagcatacattgtattgaatgtattttttctgcagttgatgtggtaggtgaaagtaatgagattggtaatgaattataagtggcatggtgtttttaataagtgctgttgggtgatatttgagaagtatactgtagtaactacaattcaagaacctgaatggagttttgagaaatcaaaaattgagaataataattaca

SEQ ID NO: 121854 - DNA, 305 bp, Homo sapiens
ttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatt

SEQ ID NO: 121855 - DNA, 220 bp, Homo sapiens
gttctgagagactggctgtttttaatgggttttatttttaaaaataagagaatatatttatgggtgtaagtaactgaaaagagagcctaagtagaatcagaaaaaatacaaactttggggtgtggcttatatgacaaagcacacccccttagtggcaggtcccaaaatcagatggttcattttacaaaggtgaaataatttcttttctttttttttttgg

SEQ ID NO: 121856 - DNA, 306 bp, Homo sapiens
tggctaacatggtgaaaccccatctctactgaaaatacagaaaattagccaggcatggtggtgcatgcctgtagtcccagctacttgggaggctgaggcaggagaatcgcttgaacctgggaggcggaggttgcagtgagccaagattgcgccattgcactccagcctgggcaacaagagcgaaactcggtctcaacaaacaaataaataaaaaccagaaacacgggccaatttcatctcgcagaaatctttccctttgttttcacaggtaaagaaggcacagacaccctcacctcctgcactcta

SEQ ID NO: 121857 - DNA, 572 bp, Homo sapiens
atgctgcttagttggctatttagagtttccactttgctaacagggcagctgggccctgatttaagtgatctaaatatgtaaacctggcaaattaactgatgaagatccacactttgagaagatatcactgcaatcagagttttagcttataaaagtctgagccccagttttcaggagtagagctattacataacatgaggtgctagaagaagagacatgaactgataaaaacaaacatcctattggtatttttttttttttgagatggagttttgctctcattgcccaggctagagtgcaatggcatgatctcggctcactgcaaactctgcctcctgggttcaagcagttctcctgcgtcagcctcctgagtagctgggattacaggcgcctgtcaccatgcccagctaatttttgtatttttagtagagacggggtttcaccatgttggccaggctggtctcaaactcctgacctcaggtgatccacccgcctcagcctcccaaagtgctgggattacaggcatgagccacagcgcctggcctcccattggtatttctaagtagtccctg

SEQ ID NO: 121858 - DNA, 640 bp, Homo sapiens
gtcatgccactgcactccagtctggcaacagagcgagactccgtctcaaaaaataaaaacaaaaaaataaaataaaaaaataaagttgtaatctaacacaatcccaagtacaaaatctcatactatgtaattaagtcctttgattgctagcagccagagtttttggatatggctactcagccagcaataaatcagcaactgtggatccacccaagtatcttactatttactttagttcatccgattcctgaagatatcatgggagacttaaatgacttgttggaactaaaatcagttgtgattatatgttttttccattaattactgttagaatggttttataattctgtctaaaaggaaagtaagtgattttaacctggatctcataaactatccttattttctaagcacttataaactagcacatgctaatattaaatcttatgatgttccaatgtttatatttcctgacttctctataaaattagcagttcatcataggaaaaagtcacttatacttccacatgtgttttataagttaatacagtagcagacttagccaataattattgattatttcagtaccccaataaaaaatatgataaagtaatataaacaaaataataaagcaaaatctctg

SEQ ID NO: 121859 - DNA, 171 bp, Homo sapiens
aaaaagttaaggaaaaataggacaagcagaggcactgacacatcccaaaaggggcatagaaaacacgattcacacaaggcttgtaaaaggcaggccaggagcatgagggccttataagaatcacggttctcctcaggaaatctctgcctgtcaccttcctcctgcccaaat

SEQ ID NO: 121860 - DNA, 478 bp, Homo sapiens
cctgaacacaactcaaatttttttttttctttttttgagacagggtctcactctgctgcccaggctggagtgccatggcacaatgacacctaacagcaatgtggacctcctgggctcaagcgatcttcccacctcagcccctaccccagtagctgggactacaggcactggctaatttttttgtaaagatggggtttcagcatattgcccaggttagtctcaaactcctgagctcaagcaatcttctgcctcagcctcttaagtagctgggactacagttgtgcaacaccatgtctggctgattttgtttattttttgtagagatgaggtctccctattgctcaggctggtctcaaattccttgactcaagcgatctgccctcctcggcctcccaaagtgttgggattataggtgtgagccactgtgtggccaactccaggtaatttcttacagtagcttcatttatcttgaccttca

SEQ ID NO: 121861 - DNA, 455 bp, Homo sapiens
agggggctaggtagaggagaaacgctgaaaccggaccgaaacctcgccctaggcttagcgatggctaaaaaccggctgggataagagggaggcaagcaacattccgactcgctgctttctggctgtctggagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagcctagtcccccacacccttgcgtcttgtactg

SEQ ID NO: 121862 - DNA, 378 bp, Homo sapiens
cttacatttattgttttttgtggagcaatgcccatgttatattgtgcagaaaaaaaccatttctgatcatcaaagatggtatgatgctatctatctgtctaatcatctatgcacacacactcatacatgcatgcatctgttatgtgtgtatctgtgtttggcgtgtgcttgtacatacttgtatgcataaaaagatatctggaagaatttctgccaaattttggtaacttttatttccagccatttgtcctctgtgtgaccagaactccctgcatatactaaaatgtctattgatggtctttgagggcagagactgcctagttcatcttaatgtccccagtgctttactcggtacttggcataaagttctacctcaat

SEQ ID NO: 121863 - DNA, 828 bp, Homo sapiens
cgtgcagtagcgtcacgcggaggcggagcgaggactcggggacagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaa

SEQ ID NO: 121864 - DNA, 253 bp, Homo sapiens
agtctgtagtcgatgtaggtcccgaggcaggaccacaggatgaggcgtgctagcaggatcaccaccagcagggccaggagcgggtcagggccaaagctgccacctggccaggaggtcatgcctgaagtcagccccaaagggcagcagcagcctctgccctggaaccgagatgcagtggggccctgccaccctagcccggcactgccaagtggctgctgtgcagacccaggacaggaagctccgtccagcctgg

SEQ ID NO: 121865 - DNA, 791 bp, Homo sapiens
gagtaacctcagggcttcctggtgagtcttctccaatcagacccaggacagggacctccgtgagattccctgactggaacagtctttatggatcctggtcacagacaatagagaggctgaaccagggtcagcgtcatgtagaacctcacagatttcacgtctgatccttctcctgacacgaaagtatgcaaatcagtatcagcaccgatctggtgcttcttttgttcctaatccatttactttcttttttcgtcgtttttctcctttttccatttgtttttcctgctttttgcaaaaggaagatgttttccctgtgagatgcaggggatgacaattttgggagatggctggaacatccaatatcctcagggccggccatcagtaagtgcaggctggaagtctcagaaagagctgaagctgcttaatcaccgtggagttttaccttctccagttctgctctgatggaatcagggccaagcaggttatcaatgataatctacctaacatagagtcaaccgattccagtttcaataacgtctgttaaaaattcacaccaccacctggattagtgttttgtcaaatcaatacacagtattgtccagctaagtagacccaaagacggaccgttgcccatggagaaaaacattaacctgagttctaggttcttacagtgttaaaggtgtaaaactgattattaaaaatgaggctatttttctttttgctgttgagttgtagaagtttcttttccatttggacattaaaactttttgagatatatggcatattatcca

SEQ ID NO: 121866 - DNA, 431 bp, Homo sapiens
cagggcagctccagatggctccagagagcagaagccccagggaagcaagtttcaggcaacccaaggaaagctgtctatgatgggtttgtcttagtcagtttctgctgctataacaaaataccacagactaaggctgggcacagtggctcacgcctgtaatcccagcactttgggagactgaggtgggcagatcacctgaggtcgggagttcaagaccagcctggccaacaaggcaaaaccccatctctactaaaaatacaaaaattagcccagcatgatggcaagcgcctgtcatcccagctactcaggcggctgaggcaggagaatcgcttgaacccgggaggcagaggttgcagtgagctgagatcgtgccactgcactccaccctgggcaacagagtgagactctgtctaaaaaaccaacaaacaaaa

SEQ ID NO: 121867 - DNA, 482 bp, Homo sapiens
ggacccacagcagcccaggagcaccatgcatcctggcttccagaacatgccaccacacacaggagctgctggggcagtggctggttccaggactgggacaaggaagacaagatgagcaaagagcaggatggggctataggaacagggactcgtcgggccttggggttctggccaaagcaggggcagcgagggcatcggagcaaatcacgtggtcatggaaggaaaagccggggaacaacatagcaacctgactcccagaggatagaaacacatgctctgaaagtctgaggacaggttcctgggagcggctgacaggcacaccccgggacagagctgctgccacgttcctgccaacggccaggagacctagaccaaggcatgggtgctccacacacgctgtgcagaaagtgccgactgcacagtcaaagccgacgacctactccaggtggaagggacttgagacaggggaccaggggatgctt

SEQ ID NO: 121868 - DNA, 168 bp, Homo sapiens
acctttgagaaggggagagggagcctctctgagggagtgacatctgaatgaagacctgaaggatgggaaagggacagccacattaacacatttaacattagtttttaaagacttttttttttttttttggaaaccaagtttaattttttcacccaggttggattgcgg

SEQ ID NO: 121869 - DNA, 516 bp, Homo sapiens
tgccacacactttcaaatcgccagatctcatatgaactcagagtgaaagctcacttatcaccaaggggatggcccaagctattcataagggatctgaccctgtgatccaatcacctcccagcaggccccacctctaacattagagattatatttcagcattagatttgggtggagatgaatatccaaattatagtgacattaatatgttttgttgctgtgaagacctggactatgtctgctgtcttcccaccataacaactagaagagttacttataccaaacagatattcaataagcatttgtttactggctaatttaatgtgttatggcttcctctaataattgtctgcttaattttactcatagagacctctttgttccaaaatgggataagaattcctgctttctattcatctctcagttttctaatgcaatgactagtatttctatgtgggagctccaataataacaggaatcaggttgagccagatactagaatggaaaagatagagatt

SEQ ID NO: 121870 - DNA, 657 bp, Homo sapiens
aatgttactgcaagctccttagcaactacttatgtaaacagtgtgaaggtttttatacttctgccagaggacaacgtaatatgaaacaccgagttttatttgtctctacagagagtagtagtgtctttcaggctgggggaagggagatttcttatactttattccctaaggatagttatttgaatataaatacttaaaatcttttcatttctgactttgccactatgtgacctcagcaaagcccttgattttacataatttccacatcaaagtcagggataataccctttgcttcttatcttaaaatattattttaagtattaaataagaaaagtacatatcaaagtagttagaattactattttaaaaagatttgcattagtgaatatttggtagacaattcagctaaccgttatttagagtctaatgtggtgaggtaaaaaactacacttgatactcagctgtttatagaacagaactatcctgatgattaattataaaacatatccccaatgacagtgtgctagcattatattcccacagcagaaagtttttgtatgcttgggattttagtttttgcaataaatctggggcgtatttggaataataatgatatgtatttgagcatttgatagcatgtttagaaatcagtttttg

SEQ ID NO: 121871 - DNA, 270 bp, Homo sapiens
ccgtgtcacgggctggtgaagattaaatgactctctggaaagctcttagaacaacacctgcttcacagtaagcattcaataaatgtttgttgcagttcttgacattacttcatgctttaaattctcctgtataaaagttatggtaaaaaaggttgtaaacgcttgcctgccatcatctgtcagtcaccagactaaccataatgacacgactcataaattttcggaatgaataaaggagtactggagtgttatcttggtggctcagcatgg

SEQ ID NO: 121872 - DNA, 392 bp, Homo sapiens
ttctgtctgttttgtctactgctagattcctagcatctagagcagttcctcattcattgtagaagttcaataaatatttgttgaatgaatgaatgaatatatgtgtccaaaaaggacaagttaattgtttacaatcactagaaaacatgaggacttcacttgttctcccacctgcccccttctcactattttaggttcattatttgtgttgttaattaaaaaaaaaaaacaagagagatctgctcacctcatagcaagctgagatctggtcacctcatagcaagctgagatgtggttacctcatagcaggctccaattttttttttttttttttgggaaagggatgtctcgctcgtggtcccccaaggggggatgtgcaaggggggtggatc

SEQ ID NO: 121873 - DNA, 352 bp, Homo sapiens
agccaactttcctactctttattgttggacttggtaaatatatcaacttctgaatataaaatctcccttcaggttttcattaaatattcggtttcctctgactagaatactccctagccatctgctctggataatacttaactagtccttaacttttaggtctctttttaatcattacttttttaaaaaaatctattttttttcttttgctgttacttctttcttgaagtcttccatgtttaatggtaggatcaggtgctctttgtatgtgccccacgcaccatcaaacctacagacttacttgcatcgcacccctactatccttattacctcctcttggaataaaagatct

SEQ ID NO: 121874 - DNA, 691 bp, Homo sapiens
ggatattattgtcttacagtttagatctgcttatcaggaaacatctgagaatccctagagggtcagggaagaggaggatgagtttacattaaaaccagactttgttagtgcctgttagagtcccgtatttttgagcagctatatgggctgtggaacataacactcatccatgtttttcaaacccatagttttaattacttgttctttttgctaccagtgtctagatgttgttcaataattataacatctggactgctgtagacacaaagaaatccgttttcttgtatttttcttttagttttgctgccttgaccttctagtcagctgtgatagttctgtgggatagtgagccagtattaaagtgaaaagaatgaaaattgttgaagtatgcagctgtgtttggatttatttagtgatttgaagggtgtaagaagaaagtatctcaatgtcaatattttcatttaaagtcaaatggttaataagtcaagactaaaaatctaaactagaaaaagaaagacattcaataaatttattataaccctacttaatacttttattattattttactagctggttattttaagtaaggattttgctttgattaaagatgttgaaaacagttatgaaaatcttttgggttgaattttatttttttaatttagttggagtctcgctttgtcactcaggctg

SEQ ID NO: 121875 - DNA, 551 bp, Homo sapiens
tagagatgtgacatttcagactgacttttgtgcagttagatgtaagcattttacctctcaacccacaccagttcctttggccccaggccacacatttcaccttaatagctcaacaccatacatgcatttattttctgactatacagtagccgcaaccaaggcttgaaaacttgttaaaaggccagggccctattcatgagacgcctgacggtgccttttacccttagaaaagcaggttgacttttcccccactctagttaaagagaatgttgcacacaaaagaaaaagggtggaaaatctcaaacacttggcaacaggcaaacaaatttgatcatctcctttcctcctcctcttggtaaaatacagtatttatattttccagcctcagagaagatagcagaacatgatctttcacaagagaattatagacctgcttattataaaacagatgtgctcccatggcaaagtgccttctccctccgcccccagctccctgtcactgtagcttacttttgccttcgctgtaattaatgtatccgtgattccaactg

SEQ ID NO: 121876 - DNA, 369 bp, Homo sapiens
atctcatcttgaattatagctcccataattcccatatgtcatgggagggacctggtgggagataactgaatcacaaggcagtgtcctccatactgttttcatggtagtgaataaatctcaagagatctgacagttttataaggggtttttcctttcacttggctctcattctctcgtacctgccaccatgtaagacatgcctttcaccttctgccatgattgtgaggcctccccagccaaatggaactgtgagtccattaaacctctttttctttataaattacccagtcttgggtatgtctttatcagcagtgtaaaaacagactaataagatctccgaagttcttttctccaaaacttaaaatagca

SEQ ID NO: 121877 - DNA, 939 bp, Homo sapiens
agccggcggccgggggccccctctctcccagctctcagtgtctcatctccctatctgctcatcctctggtcgcacataatcgatgtttgggcgtcccaagccagatgtggaccccatttccgcactctacactggaggttttctaagggtggtgcccggaccagcagcttcagcctcatctgggaacttgagaaaatgcagattctccgtcccacccagcctattcggtttttcctgcactaaaaccatgaaggtggggcccagcagtccacattctcgcaagcccgtcaagtgattctgaggcgccctccagtttgagagctatgctcacggcctcacctccgccccgcaaggagcccggtcttgcctgtggcgctagccgcacacggacacctcatcctgcggggcccgcccccccgctgcaccctcaccgcccaacgcctcctccgggatgcagcggaggcgcctggaagtcggcaaggtcaacatccccctcagcatcttccctaccctcacggctcctcctccaggggtgcctcatggccaggggttagaaagagccactgtgtttcttgacatggaagtggcctaagaccttaatgaaaactgcaggagtggaatgacagaacctttggtcatacttgagggcgtgaagctcaaatgaggaggaaggaaaggatccagggagaataaccaaccctggcaagttgtggcgcccaggtagaggggcgagcctaggctagcggttctcgaccagggccggtgttgcccctcctcgccgccccgcgtacatttggggaggtctggagacatttttggttgtcatgatgcgggagttgctactgttgcctaagtgggtagacacgagggtgctcctcaacatcctacctgaaggacaggactgccccacaaggaagaatgatccggccccaaataaga

SEQ ID NO: 121878 - DNA, 291 bp, Homo sapiens
tcttaagctttgtttcaggaagcagttacttggaaacagtttgatcctttcaggtctcgctgttaagacttattaggtaagatcagagtagtgtttagtctagagttcattccccactattgagacaaggcccttctgaactctacccagcatcctgtgaattatgaggttttccatagatcagagtagtgtttagtctagagctcattattccttactattatgaggttttccatagatcagagtagtgtttagtctagggctcattatttcccactattgagacaaggc

SEQ ID NO: 121879 - DNA, 577 bp, Homo sapiens
gctagaaacctcactgagggcaagcatcacaggagccccatctttgatagcctgaggacatgttgccatatcttgaatgcagtatgtgctccataaatatttggcacattgaaccaaactgcattaatctcatatgaaatcgaaaaccaggtgaattctgtgcctcccccaccctgtaacctcttgttcccaaccctgactcccacctatcaaaacctactcccagatctttcaaacacataaaagactgtgtgattgatagaaacttaaaatgttactcatcacagtaggtaataaacttgaatctaaatggatgtggctctaatttctggtatagcccgaaagtcttggaatgatctgggaatgtcagggccttttcagcagaccagaaatcacatttagaacccactggcccttgagcctataccaaaatcgcaggcatccacagtcacccacctcacttctcatctatgagttgaaaagtatgagtcataaactgttggaagtatttttaactcacgaattatgtggatagtaaaatgtaatgcttcaaccctaactggatacgaagcccaat

SEQ ID NO: 121880 - DNA, 778 bp, Homo sapiens
gaaggattcgatttcttctttgggatcagaataatagactttgagtaagaagaaatttagaaatcatctgatactccaagtccctcatttttaagtgaagagattaagaatcagagagatgaaatgactcgccccaaaaatccagaaattatttacaaagctggatctcacagtcatatctcccgaacacttacttacttcgatgatcagtgattcttatgattcaaggttaacgaagaagcctttagtgggggtgattgggagttcaagcgctgaaaagttagggttgacttttttgattctgttattacaaattttacctcatctagtagtcacaatgtggttgtttgttgttgtttttgaaaagacatatagggtgccatactttgaggcttaatgtttaaattcctatgacaagtgagatgaaagtgaacttgcatacactctggcttttggaatatttgaatatctagtctcagcagactaacagataaggggggtaacagaaaagtattaagaggttcttcagaaacacttatttgtaacaaaataggttgtttgaagcagaagttgaaattttgtatttgaatattttctcctgcaaaggcttctaattttgaaaatacaaggactgctaaacaccttcagtgttaaagttcaaattggtattggtgagaagtctcgggaacatttatgtcaattaaaataccttaaaatatagcgcttgacaagattatgagggacgttaacatggaaaacttagatttgatcttgagaa

SEQ ID NO: 121881 - DNA, 567 bp, Homo sapiens
ggaagagagttttcaaaagtgtccattggtccaggtgcagtggtttgtgcctgtaatcccagcactttgggaggccaaggcagaagaatcgcatgagcccagaagttcaaggccaggcctgggcaacatagtgagactctgtctttagttaaaaaacaacgacaggccaggtgctgtgactcacgcctgtaatcgcagcacttgggaggctgaggcgggcggatcacgaggtcaggaggttgagaccatcctggctaacacggtgaaaccccgtctctactaaaaattcaaaaacaaaattagccaggcgtggtggtgagtgcctgtaatcccagctactcgggaggaggaaagaattggtcgaggcacaggatggttgcacagcgtggatatagcagtgagaagatagtagaattgagtacaggttctacatcagattcaagcttacactttagaagcagctaaccgggcaagaaatgccagatctggactgagggtggaagggaagagcctaaggggaggaaactgtggatgtaaattagaacgagaaaggccgggggaaagaga

SEQ ID NO: 121882 - DNA, 157 bp, Homo sapiens
tttaactccattccacaaattttctttttatttatttatgtatttacttatttatttttgaggtaaagtctcactctgccacctgggctggagtgtagtggtgtgatcatggctcactgcaacccaggtggcatcgataaacaccgggtaccgagct

SEQ ID NO: 121883 - DNA, 730 bp, Homo sapiens
aattcagatgccctcttagggtttgaaatgtgggggaaaaaaaaagagaatcactgcttatcttagtctgttcgggtagctgtaacaaaataccatacctgagtgacttacaagtaatagaaatgttatttctcacatttctggagtctgggaagcccaagatcaaggtgctagcagatttggtgtctggtatctactgacctggttatcgcttcttcctttaaggagtattagaacactgctggggatgggctgacaaacataccagggattttactttgtgtcagccaagaggctttccttacctccttgtcttcagtactcttgtgcacaagcatgcttctcagagaaggtggattctaccttggaaggaaatgagtcgtttcctcccatcaggacaactgccacagcatggtgtcaactcactcttgcctttcgtaaattgagtttgtcagtgctcagcgacacagctgagtgaaatgttgtgtgatgcgggctgtctcctgggagagagaaactggcataaaccacatcctaatgggatccagaaacaaagaagcgtgaatgaagtgttaattgcattcataaagacattaacaaaggaattaaaatggcagaagcttcagtcccccactcaagattcacagaaaaatatgttatccaaagaatgtttcaacaataatcatcaaagtttattgcttgcccattggggaaataactcttgatacat

SEQ ID NO: 121884 - DNA, 797 bp, Homo sapiens
cataaaatgtatgtaacataattatgctcatttttcttgagtaatttttaaaaaattagtttcataactaattgtttccttaatagccaactagactttatttaaaagttaatagaataaacagcattaattgaaattaagaaacaacatttatgagagaaggtaacagttctgcttctactcagtaagaatttattcacatccattcaccagccatatcctttttttccatttacatggtaatttacttttcatttaagtgcttaatgagaaagtaaggactgcaaggagctttctgagatgcatatatttttgcttgactttggttctgacttgtacttgaagtattcagctttgagtttcaccagtccccaggtggttgtagagccccagcaatgtaccagggactgtgagaggggctaagtgagatggttaggatcaactttctcttacccagtctgctttcaaaaagatgcttaaaataagtacatagaggaccacaatgcaggtgaaagtacataaaaggcctgaaaatgattcaagaaaaggactccctggttttggaggaaagaggtaaagcatttctttaaaaatcagttttttgtaataacttctgctatagttatttatacttcaaactttttttaattaaaaaaaataagataaatgatttggtaacgtgtagagagcagacattacgaacacactgtgctccattgtccttcatctttagtgttttagtatcttccatactagtggttctgctctttttatctaatctctactttttttttttt

SEQ ID NO: 121885 - DNA, 483 bp, Homo sapiens
aatgacttccccagtgacggccctggtgcgaccctctccacagggtctctcctttgtagttctggaaggtcggctgctccccgcgacagcgtgcaccatgcccagagtcctactctctgtgctgaatgaaccatagttcacacgacagactctcttcagggtgctcttccagaagttttctggaagagcagcagtcctgtccatatggaaatactagaaattttaagaatgcaacagtaaagagattctcttccctgaaggcctttctttccttaggttaacctcatgctgaggaaaagcatccacagctgcagccctttggctcttggcctttgctttcacaagcatgaaaatgtgtgctttcaatattttgctaaattccccaaatcctttaaacaaggagcaacagtgagggcagagtagtaaactacatcagacttgggtatcctccatgccagctccttctcattaaatgctctaggg

SEQ ID NO: 121886 - DNA, 253 bp, Homo sapiens
atccttcaaaggtatgttagcaaaaaaggaggggggcagggaacaaagctaaacacagatgagaatagctagtgatgcccttgattttgttgtgcgtgctctggatatctttctcctttgttcctcaaggggtgtctggcaccagctttgatctgctgccttcacagtggtatctggtcagtagaacaagtttcaaccatgtgttttgcttgactcctacttaatatggtattggcagcggtggttttgatac

SEQ ID NO: 121887 - DNA, 405 bp, Homo sapiens
aaaacaatgatcagccagtggcaactgctacatagcaatatattagtgagcagctccactggtttaaggatttctatgaggaggtgacgtttagtctgaaacctaaatgacatgaatgagcctcccagagaagagcaaagggagcacgttccaggtagaggaagtagctggtgcaaaggccctgaggcaggacaggttcggggtgtggaacagaaggatggccagtgtgcctaggagctagtggggagggagggctcaggtaggcaggagccagattggtaggaggttgtatgttggatttcagattcagaattttgatttattgttgttgctgctgtttttatagttattttttatagttattttggatgtagtgagaattcttttaggctcccaatggcaggg

SEQ ID NO: 121888 - DNA, 749 bp, Homo sapiens
tggtgagagacatgatgttctactggttgctgtcgattgttggaagacaaagagccagcccaggatggcagaactggtcctctgcaagaaacagcgcatcagctgccgaggcgcgttccatggccctgcccacccaggcacaggtggtcgtctgtggaggtggaatcacgggcacttctgtggcccatcaccaatccaaaatggggtggaaggatattgtccttttggagcagggcaggctggctgctggctctaccaggttctgtgctggcatcctgagcactgccaggcacttgaccattgagcagaagatggcagactactcaaacaaactctaccatcagttagagcaagaaacagggatccgaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcctgaggatgcagtggtgtcttccgctgacgtggctcttgccctggcaagtgctgcctcccaaaatggtgttcagatctatgaccggacatctgttcttcaagtaatgggcaaaaaaggtcaagttactggagtggagaccgataaaggacagattgagtgccagtattttgtcaactgtgctggccagctattgtca

SEQ ID NO: 121889 - DNA, 350 bp, Homo sapiens
caaaaatataaactccaatgttctaggtttctgtgaagtgccttaggtgactgcatggagggataggttactaggtcagcattctgtttccattgcagtgctgctgatttactaatattacttttatatattgtgcttgtagatgagattatgttttaaaaagggctttagctgctaagtaaatgatgttcgaatcaactgcttttttgaaaggtcgccagtcatctcctttaattaaaaaatcaagataattttcacccttttttactggatcatttagcattagtctatattctgttcactctttcttgaaatactttcttttatggcatctgtgacaccacatgctc

SEQ ID NO: 121890 - DNA, 586 bp, Homo sapiens
ggaacatggccacacatttatttatatatcttcttgtggctgttttctgctacagctgcagcgtcttatactaaacagactgtatggcccataaagcctcaaatatttactttatgggactcgatggaaactttactgacccctgatctcagtgtttcttttaagcattgcaaagatagtttgcaaaaatgctatgagagctctatgatggcattagatacctaaatgtagcagctgaaaaaaatttcctaaagtggtattaggcctaaaaaaaagtgattctagggctacttaaacaagaagtttttacagcaagagttacatcctctactcattttaatgtctaggtaagccagagctttaaatcctgtattaatttacctgtgaaaatatttcatattctcccttttgtgccgtgtgtgcgttggattccccagtgggtgtatagatgaatttataatttatgtggctggatggaagcctgggtaaatacaagcataaacaacatcaggcaatgccagtcgatagactgcgattccaggatgtgttctgtccaggcctgccgttcattccaaaggcctgcatt

SEQ ID NO: 121891 - DNA, 564 bp, Homo sapiens
ctttcttgtgatgacggaaaatgatgataaaatggcgaaatgaggttaatgacatgggcactgtgtaggcattcataagcggttaaagcttgtgagctgtttatttctagagttttttctttaatatttttggaccatggttgaccataggtaactgaaaccgtagacagtaaattgtggttaaggggagactactgtatagtgttggttaaaactcaccattctattttcttgactatcttcccgccatttctctgatgtatccttatccttattctccacttgaaattttacttttaaagatcaactcttaaacttctttcaggtttttcctttagaattaatagctgtcccttccgttttcccatggtatttggtactttgttatttgtagcagttaccatgctttattagaacattcttctgtgagggacaagttcctgaaaatctgcatggtaaatacgggaagtacggttgagtaacatatgtaataatcttatgtaaaagtagtcatgggaactgaagttctgagtgaaagccctcataactgtgcatttaattaaa

SEQ ID NO: 121892 - DNA, 374 bp, Homo sapiens
ctactaattcgcggccgcgtcgacctcaccattctattttcttgactatcttcccgccatttctctgatgtatccttatccttattctccacttgaaattttacttttaaagatcaactcttaaacttctttcaggtttttcctttagaattaatagctgtcccttccgttttcccatggtatttggtactttgttatttgtagcagttaccatgctttattagaacattcttctgtgagggacaagttcctgaaaatctgcatggtaaatacgggaagtacggttgagtaacatatgtaataatcttatgtaaaagtagtcatgggaactgaagttctgagtgaaagccctcataactgtgcatttaattaaa

SEQ ID NO: 121893 - DNA, 770 bp, Homo sapiens
ctgttatggtcagttctcatttgtcatgttaggattactgcaactcttacccagccgggtgtggtggctcatgcctgtaattccagcactttgggaggctgtgggcggatcacgagtctcctcacattgtgatccgcctgcctcggcctcccaaagtgctgggattacaggcgtgagccagcacgcctggccttccaaattccttttaacagcctagcaaaagaataataaggaaggtaaatctgcccctacaagaaaataatgcttcgacgatccggctttccttcctgctacccccagccataagaataaatgaccttgctcatcactgaaattttacctgacctttgaatttttaactgcgtcagccaaagaacttatattttgagtattcctaaggtgattgctattgtagttttgaaacacttggttggtatgtttgagggtttcatggtccaaagttactatagcagttaaaagagtggactatcaggtcagacctattgggctttaatcccagttctgccttctcttagaccttgggcctgttgttttcacttctctggttttcagtttctctgtccacaattgtggaaacgaggtccacttgtagagtaattgagaggatgaagcaagatgatgcatatcaagtactttgcatagtgccgggcagacaggtaacattcaagtgctaataattactattattactatttattttttgagacaggttctcactctgtcacctaggctggagtgcagcggtgaga

SEQ ID NO: 121894 - DNA, 238 bp, Homo sapiens
aatttggtcgggaagggaggggaagattattaaggttaacttctagaattctgctttatgcagctgtggatggtggtgccattcactaacaacgaaatactgagtaactaggattgggaggaaggtcatgaatctagttttggatctgtaggatttaagctgcctttgtcctcacatggtgatgtcggtaggcaattagatacagggatgtagaactcagaggagaggtctgggctag

SEQ ID NO: 121895 - DNA, 343 bp, Homo sapiens
ttaaaggaatgaggatcatcatttagcactgaaaaggggcagtaaaagaagtgagcagagccttaataatgatttttgagcccaaagttggttgagagagccactctaccaaaaagctgttctaccaaaaaactaccttctggtaactactagaaccttcaaatccctgtcttgctggtgtatagctgaaattcttgcataaaaaagggagcgaggccaggtgtcgtggctcatgcctataatcccagcagtttgggaggccgaggcaggcagaccacctgaggttaggagttggagaccagcctaacatggtgaaaacccgtctcaaaatgcaaaaattagc

SEQ ID NO: 121896 - DNA, 183 bp, Homo sapiens
gggaatatgagagaatataatatgatatagattttatcaccaagaaggtctgagtctcataagttcactataaagtagaaggtaataaattcaatgagaagtatacagataaagtgccacacagtataaaggaaggagattactttgagctgggaggataaggatttggcactggcactagga

SEQ ID NO: 121897 - DNA, 345 bp, Homo sapiens
ctgtgatgcatcaatgaataaaactggccggtatctctagccttggggagcttataatctagcctattaatagctcatgttctaattatgaaagaaaataaaaaacatgcacaacaattaggtagtaattgcagttactaaacttcaaaagaataagcaagtatatggattaaaagctcaggtaatttaaataataaagaaataaatgactaattaaagtggggttcaattaattcagaagatgtcttaaaggaggtatatcttttatttttttttggagagtttattaaataatttttttttattatactttaagttctgggatacatgtgcagaacgtgcagg

SEQ ID NO: 121898 - DNA, 301 bp, Homo sapiens
agtaaggtagtggtctgtgttccagattgcggggcgggggggcggttctcttttaggtggttggagttctagtacctttctcagggttccagcatggacagtcagagaagctccaacatgttctctgagctagggtaaaattgagactattggtgatattaacaaaaagaaaagcactaagtaattacaatccagccttaggtttatgaagtagctgctctccagggatgaatgagataggatggatgcaaataaattaagcatagatcactatcaattggaataacaaaatgattagctt

SEQ ID NO: 121899 - DNA, 196 bp, Homo sapiens
gtggtgtccccccttatctcaaactacttccaaaccttctgcaatgtggacatgtgggaacacagggagacatggaaggtgcactctgcccgccttctgccttcacacagaggacacactgggcacacacaccctgaccagtgggcagttgcacagaaccggaccctggcttggaacagtagctccatctcttatt

SEQ ID NO: 121900 - DNA, 591 bp, Homo sapiens
ggattccattctaggtacccacgatggaataagcttagagctgaccatgaagacaagtcatttcattcgccatgagacagctcagtagctataccacaaccctcacagggaaaggtagagatgagcgacaaaccaacagcaacaataacaacaaccatttcttgatgtttttgtgttccttttaacctgtcctatctgttacggaagcatgtttttctagggccaataaagctgggttgggatgaaattcagtacacaattcagacgtgagcatcttctaattcctcatccatccttcacccattctcaggtctagatttctaacatgggcaggtcaatgccttgggaacacagtcaaacaggtaaactggcattgggaccagcaaagtgctaaacttaccactaagtcattgagagaccacctacatcaggcacagtcaattactgtggaactggtgaggtggcactcagaaaagataagatgagaaatcgaaggagaagagcctttttttccatattgcttcctaagcacagtggcccaagccagctaatacaatgaatggcaggtatacagccagtggagccttcagg

SEQ ID NO: 121901 - DNA, 253 bp, Homo sapiens
ttctactttgggaaagtgaaaggtgtcatcatccatggaagagacaagaatattctacttttgcagcctaagctgaagactgataatacagatttagaagccaaatcagtaaacactgtagcagaagcttagaaacttctagaagggaaataccaatctggaatagtcttctttgtactgcacataaaacaaattcaatctggtgtgttgtacatgttttttaataataatggtaattaatttgaattattgg

SEQ ID NO: 121902 - DNA, 553 bp, Homo sapiens
ttgcagatgagcaaactgagccccataacgtgggatgacttgcttggggtcagccagtggtgaggctagcctgggaacgtgggtaggtgtggtctccagctgtgctctgtctgggtatgggagtgggcttgcagttaatgggtaggaagcatccagaagacaccagcattatcttcatgattaagcaaataagtttgccactcttctgcctcagttgccctcttgctttaggagtttgaaatcattgaatcactggctccctaaatcactgaatcactggctccctaaagggccctgggaagtggagtgcagtgctctagcattctggggatgttcccagacttccttgggctgttggactctagcttcattataaactgtggccttctggccctctgagtcacttagagagtgggcaactcaagaggaatagcccgtggtgtgtaggaaagagactttctagatcaggggttgaaaactcctaggcctctgagggccagctgcttaaaaatcagactggtgagagattctagcaagccatgaggcctgtgtg

SEQ ID NO: 121903 - DNA, 434 bp, Homo sapiens
tgaaacaatgcccaagaaacagcatgagattgacaaaggaaaaggcaaaataaataaataggtaagtaggcaggaaatcaagggaaaaagatcagaaatgctattatagagcaaaggttgtcaggaataataataacagtagtagtagtaagacaccctagagaatctttttctgttcaataaattatgggatggagtggccagaattaaatggagaccagagaggataccgtgataatgacagggcctcatctataaaatctttggagagttttctattgctgactgagtcttgggtaggtaaaatgccagcagcaaacatcacatactaataacacttctaaggacttttcaaggcaaaccaacaaagttacagagcaatgcacagaatccattttttttttgtaaaaaccacaacaaaaatgctgtatgtt

SEQ ID NO: 121904 - DNA, 708 bp, Homo sapiens
cgtagtggcgcgcgtctgtaatcccagctactcaggaaactgaggcaggagaatcgcttgaacccgggaggaagaggttgcagtgagctgagatagtgcccctgtactccagcctgggcgacggagcaagtctccgtctctaaataaataaataaataaagtgtggccgggagagcacaagcatttccaagccgctgcctgaccttctccgtctctgttgaagacaggggccatcttgaaagaaaaaatctctgaggagttgtgtggtcactgggggagcgggggtgttgtgaaggaagctctaagactccaatgggcctgacaaaagtataacggggtcttcttcttagaaagtgtccccttcctccgggtgcagtggctcacataggaagtcaactagtggaaaaaagcgtaagtgtttaggaacctggaatctttcctggagggaaaagggtaggatttgtaggaagggaacgggggtagagggaggagataaagcatgaaagatacaccagtaagagtgtgtcctctggtggatgctgaggttaagaagaaaaaagagtgggaggactttgcctagaaaggagtttgggctttatctaggagatacggatcccatgaaggatctttactagaggagtattattgtctaaagtcttggttttcaaaggctaacactgagaggagaagactggaagaggctattaa

SEQ ID NO: 121905 - DNA, 492 bp, Homo sapiens
aattttttttgtagagatggggttttgccatgttgcccaagctgggtctcgaaatcctgggctcaagtgatccgcctgcctctggcttcccaaagcactaggaatacaggtgtgagccaacacatccggccatggatgcataggggtttaccagaagggaagggtcacataggaagtcaactagtggaaaaaagcgtaagtgtttaggaacctggaatctttcctggagggaaaagggtaggatttgtaggaagggaacgggggtagagggaggagataaagcatgaaagatacaccagtaagagtgtgtcctctggtggatgctgaggttaagaagaaaaaagagtgggaggactttgcctagaaaggagtttgggctttatctaggagatacggatcccatgaaggatctttactagaggagtattattgtctaaagtcttggttttcaaaggctaacactgagaggagaagactggaagaggctattaa

SEQ ID NO: 121906 - DNA, 329 bp, Homo sapiens
agggacccttcagaaatgcaaatcagattactgaactcctcaccttaaaagccttcaattactccccactgcactgaataaatctgaactgctacccaggtgaaagacattggcagtcatgacctacctactctctgacctcatccagcaacacccaacgccccatggaaaaactgtcttccacaaaactggtccctggtgccaaaaaggttggggactgctgatataaagcaccaattttataagcagactatttttaggccatagaatacacacatgaagtttactaatgctaacttgtaataattaccaagaacaatgacactacc

SEQ ID NO: 121907 - DNA, 391 bp, Homo sapiens
gactaaagtccacttcagcatcttacagatgtcccaaccaaacccagcatgtgtaaaaccagatttctcttctctccacaaacctgtttctgttaggttcttttgttactccagctaaaaagctggtgtcattctaagctgtttatcctcaatgaggtgtccccttctctaaccccatgatgcctctacccatgcacattgaattgtctgtaagttactggaaggcaagactggaagggtttttccttcccttttaaactacaaaccaggtttcccccatcttctgtaaaagcaccccccaatattgtgaatttcaagcatgcaggaaaagtgagagttttgcagtcgacacccatatacccactatctatattccaccgttaacatttca

SEQ ID NO: 121908 - DNA, 529 bp, Homo sapiens
aagccctttctttaaaatttctctcagtctcctattttaactttgggttccattgtcatactcaattgcagaatctcctcatttctgtattaactttctcgttctttcctttaggtttatctgcacctgcgtgtgaccacaccatttggcctgctcaggtgatccagtgaccattcattatgtggttaagccagttcaaacaccagttatgatatttataaggccctctgcagtatgtcttcattcattcatttactcattcattaagtcaacacttattccctaacacttgttataggccaagcactattccaggcactggggatatcatttttattgaaacactaattttattaatatagaaaggacctggttatgtcttcttggattattcccttgcctaattcagctggttttctcctttacaaaatgggaaaacatcttgcctgccttatttaggtcactggatttctggaaaacttaaacacgaggtagggcagtgaaaaatgtttataatctctaaaagaaa

SEQ ID NO: 121909 - DNA, 313 bp, Homo sapiens
atggggtcaaggatggctggggaagattactaagtctcctatggatagaaaggtgagccaagccttgaatgtggacagtctaattatggagcctgacacataaagaaatgcatcactttaataactgaggagggctattgggcaagtgattacggaatggtagaaacaatcctggattttgagtcaaagccatggatacaaaccctcaagtgttggcccgaacacaataaagctttgagatcttgagtcagtcactcagtatctatggaaatggacataaacaaactttattgcacacgactattgtgaggat

SEQ ID NO: 121910 - DNA, 204 bp, Homo sapiens
ggtgaaaccaagcatatataccttaaccaagtaatcaaacctatcaacaccaataacgactcaaactgaccttatgagcctcctgatgtgattcaatgggaaggacacaccactgcccacatagtattcttaccaaaaacatttcatacgactctaattggttgtgggacactgcagaaataactggcctggaccctttaaaaa

SEQ ID NO: 121911 - DNA, 174 bp, Homo sapiens
atatttcctggcaatcaagagaacccatttgaatttcaagagtgtaaacccacattcaattcagtgagcatggtttcatgactttatttcagcaataatgagcactgtgaaggtagaaacaggacatatgtctttggcagtactggcacagtgggatgttatggtatttaatta

SEQ ID NO: 121912 - DNA, 698 bp, Homo sapiens
tgagtctgcctagttcacttcctgcaggtctgttgcttgctgcccagtttttgtattcattgatctgcggggcagtgacatggttctcagaatgggggctctatttttgcacctgtgactctgggcagatggcaacttccttgatttcctgtgagagtgtttgtgtcatttatctaggtcaatttcaaggacataaagtcttttaattttttttgagacagagtctcactgtgttgtccaggctagagtgcagtggtacaatcacagctcactgaagcctccatctcccaggctcaagtgaacctcccacctcagcctcctaagtagctgggactacaggcacatgccaccacgcttgactaatatttgattttttgtagagacagggcctcactatgttgcctaggctggtcttgaactcctggacacaagtgatcctccaccttggcctcctgatgtgttgggattacaaagtcttttctagtcccatagtcagggagtcgagcctagccagccccctttcctcaatgggccttgagtcctcctcagtccccactgcaccctctggctgtggttccttagtacgattcaccccgacgcttttttcctttcttactctggtgataattttgtgatctttttttccagtgtgtctctatgcatggagtaagaaagaaaccatcctacaatagcaccaa

SEQ ID NO: 121913 - DNA, 634 bp, Homo sapiens
cgtgcccagcttacagaagagcaaactgaggatcagaagggatgaagggattgtccacaatctcacagcagggctgggattcaagggcaggcctgcccattgatggcctgagaccttttttaaaggcaacatgtctaggccagcccctaaaggggttctgtgcttgtcccttcctgttacccctaccaaggatcaaggggtcatcctccaaggctttaactgaccttggagcaggaacctttccctttcttattctccccacatgcccttcctcccagtatcttctcagcctagcacaaactcagccatccagttagagtaaatgtcactcccccgctcaaaaaccttcagtggctccccactgcccaccagatacagtcccagcccatgaacttggccttccagcctcactctactgggcctttctgtcttctaaacaagcccacctcagtgcccttcctcgcactgttcccttacctagaagccttccactctgcccatctacccatcctcattcaagccacacctcctccctgaagcaggaacaccctagctctcgcacgctcactcctctggcctcctctaccccagagcgtgcacagccagcatttggctcctcaccctgtctccccag

SEQ ID NO: 121914 - DNA, 325 bp, Homo sapiens
ggccactgggaatgtgaggagcaactgggaacagagcactgcacatccattgtgtgttgtaagacctttttaatatctggggactgctttttattatccctttttcttataaatggcatgtaaagagtgtaaagtaatctgtgctacaaattgccttatgattttagttggctttatgtctgtttcaggtttaattttgtttggaggttttcagactagagaaaacaacatgtcctaacatatttagactctggctctccatgagaactacagccatatgataagataatacaaagttagctggggagagggatgcttccaacgt

SEQ ID NO: 121915 - DNA, 880 bp, Homo sapiens
cttttgatattgaatcctcttccccaatatttcattggaagccaggcagcttccccatgaccgtcttcatcttatgactgtaagttggaatgagtatccatatacccgtcagaatcgcctagtgcagtaaaacccacaatgaaatgctcttccctattgcacgttcattatacagtatgaaaaatcgcatcccccaaggacacagtcccagttggcatttctctctcccgctgtaatctacaatgcctgggatacaggtgtgctcctcatctgtgtctccagtgttgggatgggagaatgaacagccagattcaaaccccatgcccctgttgtctctgagggaagcaccagcagtctgaatgacgccttctctcatgtctccagggctgtactccctttgagatcccctgctttctgaccagcacaacatgtcagcaggaactaaatgatgacctcagcagcagtccaagattattttggttacattactctctgtgattatccaaaagggaaaacaaaaagtcatttaaacatgcagctcgtgctcttccagcacaacaaaggatctcctggaaatctttcattttttaaatgacattataatgttatgctttgttttcatcacttttatcatcatttcttagcagaggcccaagtggctcagctagggtaaaagggaaaaaattataatgattcatttgtatacatttgtcctagtgggaatttgacgtgatggaaacataagaatattaaattagaggcactcactcccttattctctgttctatttgaaccagacacaagatacaaacgttatatggggcccaagaatgcgacagtaattcagtgatgcataagcccccaccagaacacttggtta

SEQ ID NO: 121916 - DNA, 852 bp, Homo sapiens
ataaaagagtgatattatgactttaaaaaaggctcttaggcattgaaattctgatagtaaaaaccaaaagcttcgtagaattatcagagactaatgtgctgaaagaaactctgaaaaaatagagcaaaaggacaaaaataagaaacgaaggaggagtgttaagaaaaatcacaggatcagtccaggaatttcagtattcaaataatagttgtcaaaagaaacaccagagaaaatggaaaagaaatcatcaagatgattcaagataattttcttaactgaagagcataaagtttcctgattgaaaaggctcactttgtgcttagtacaatggatgaaaatagatccaaactaaggcacattgtggtgaaatttgaaatcactggagccaaacagatcgttcatgcttctggggggtgggagggaatgagttggctttgcacttctcagtcgtagcattggaaactgaaaaataaagcagcatcttcagtattctgaaggaaaataattttcaatctctgaattccatatgcattgatactattattcaaatataagaatagaattagatgtatacattttcaaaaacaatctgcctgtcttatacactttctaaggaatctgttggaggatgtgatccatcaaatgaaaaagtcagccaaatgaaagaaatgaattacaagagacaggaaagtcaataaagcagaaagatccttcagaatgacaataaaaagaaggggatagagggctagcagttcagattggagtgggttagaagcctccagaagagtggtcttcaggaaaatgagattggtagaaacctgatgcaattaattgtctttagaaaagttttag

SEQ ID NO: 121917 - DNA, 445 bp, Homo sapiens
gagagaggtctaaaaacagatacaaaacacaagaaaactgaaagaaaacccctaaaggactggcttaattgataacattcatgcattcatgaactttggaaaagtgaaatgcttactgcttatgagtttgatgacagtggttgttttgagattttcagtggccacagattgactagcagccatttaaaatatgtccttatgggaagagaagctaatgccgcaaatcagctaacaagtagtgggtagttggggtccttcttgacctatggatttgtttagcactcagatctctcgatagagcacttggccatgacagggctcaggtttccagctccatttggaggaaaagtgagcatgctaggctcaggaagacaccacacaggctccagccgccccatcccactcagccaggttttcatccctgccttccttcatcgtttatgtc

SEQ ID NO: 121918 - DNA, 144 bp, Homo sapiens
agcacatcatctccccgtttacttaccgtattttgttgttgttgttgttgagacggagtctcattctgtcactccgtcagactggagtgcagtggtgcaatcttggctcactgcaacctctgcctcctgggttcaagcgattct

SEQ ID NO: 121919 - DNA, 691 bp, Homo sapiens
cgagaaagggcactggggtgtgcgtttgagaagctgcaaagatggttcggggactgaggtcgcctgtggtcacaggacccgataggtaggcacagaggcgacttcgtgggcgtgtctaccgcagatatctgtagatcctctgaacgtcgctgttagagccttaggttctctagagggacagagtgaataggataaatgtatatatgaaagggagtttattaagaattgcctcacaggatcacaaggtaaagtctcacattaggccgtctgcaagttgaggagcaaggaggccagtggtggatcagtccaaggcccaaaacctcaaaagtagggaagccggcagtgcagccttcagtctgtggccaaagccccgagagcccttggcaaaccactggtgtaagtccaagagtccaaaagctgaagaacttggagtctgatgttcgagggcaggaagcatccagcatgagagaaagacgaaggccggaagacttcagcaagtcagcttcttccacctacttttacttttatttatttatttatttatttatttatttatttatttatttatttgagacggagtctcgctctgttgcccagactggagtgcagtggcacgatctcagctcactgcaaccttggcctcccaggttcaagcgatcctcctgcctcaccacccccgccccgcccccct

SEQ ID NO: 121920 - DNA, 413 bp, Homo sapiens
aaataaaatccaaattacttggcattcagtaacattccacagtctaattccaaaccaccttttcagcctcatcttccactactaatctgataagactctgctatttaactcaatacggtctacccactccttcctgaacacagcttatgatgctacattcctgcttccatggctctactcacactgactcctttccttattcttttcttatattcaaattatctctcttcttcacggctcagtatacattctccttaactacccagagtagtaggttttgactatgacccacagtattttatatcataatccagtatacacaggtttcacaattccatatttcactttacttcatgcagtgtactttggtattttcttcaatttctttttcaaaatgattcactaaatgatca

SEQ ID NO: 121921 - DNA, 728 bp, Homo sapiens
acgagtttgtggtttggccattctgatagataagagaaaatagtttctttttactaagaaatcttctagacctatacagttctaatttatgaactgtcacagtataggacaaagagtggggtttaagataataatgaaaagtataaacaagtcatggggggtttataaatcttgtaaagagaattttgtgtgtaattgggttggctgggattagaagggaattgcttgtaagtttttctaagaactgggcattaatgtcaggagtgtgctgatacaggaccagaatctgattctctgtgtttgaagcaacaaggttttcctagaatgttgatcaactcttagtaaaaaaaaaattgcaagaggtttggattttaattctcaaatccatttctttaaattttcaaccatcttgtgacctacagcttttccatgttttacagcttctacctaatttcaagttagaagtgctgttttcacttaaaatgataattacattttttgagtagacttttcctcttaaagcctttcagattcatatgcctagggtttggctttttactgcatctcactacgtgtgatttgcaggtcatgcatcattgctttctgcttttcttccttagctccttgaaaataggatacatattttgcttaactagagtggttactttattccttaaccttttcatccatttctgtagcctttttccaggtttgactctgctattgtg

SEQ ID NO: 121922 - DNA, 940 bp, Homo sapiens
acatcaaagagaaccagatacccatccgctccctctagcacggcagtaaccatatgatcttgccaaatttgcttttataatttgaattgacttgtgatttctctcttctcaattgaaaattctagtggttgcccaaatgacgtgttgaattaaatctgcatatcctaactgaaagtaagaaaacttttggctgaggaaaagggagcatttttcttacaatgtcattttctctccttgctcattcatgtctctgctgttcaggtattctgtttctctttagaatgtgggatttccttgttttctctcctacccagtggccaaaaacctactcatttcctgaaactcattgcaaattctttttagtaacgcctaccctgaacacattttctttcttccctatctcccccgcctcacatgcctaaagtgtggctataacagccctgcatacactggaattgttttcatacctctcttcccagttgagctgtgacatccccaaatgcagagctggcttagatttacttttacagctttctttagcactagcagtagattgaataaatgaatggctttccataaaatagttcttgtttgtactggtgaaagactgaataatgagctcaatagaatggtactatgattgaatatgaaatttatgatcttaaggagtctaagtttttagtgcaaatcagaacatagatacctttgaaataaaaggctgtctctttttgcatcagtgatgtatacacataaatagaacatacacacaggcagtgttcagagccccttaacaggtaagcactgtctaaatgcacagtcatgtcttatgaacacagcatataatttggaggaaattaactttaatgtagccatgaggatgattttatgttggtgtattattatggagacgggcataattgtgttagccatgtgaatggca

SEQ ID NO: 121923 - DNA, 498 bp, Homo sapiens
ttctggcggtggctggcaatcctttgtgtggcttgtagttgcatccctttagtctctgtctccattgtaacgtgacgttttccctgcctgtgtgtcttctccccttcttataaggagaccagtcatactggtttagggcctacccaaataacttcatcttaacttgattacatctacaaaggctctaattccaagtaagatcacattccccggtatggggggttaggacttcaacatatctttctaaggaacacaattcgattcaaaacacttatagaattttgtgaaattaaagagaaactaaaacaaattcaaggttaaccttatgcagatttcactcttaattgcttcctgataatcttgattagcgaaaagaatggagtggagtcatatgctgctgacactggaaaagccaggactctgagtgagttttgggagtgtcttgaatgtgaatgtcactattatcgtataggtcccccaaaatgaaaggttttcctc

SEQ ID NO: 121924 - DNA, 123 bp, Homo sapiens
gacactccactgacagttctaaagcagaaaattagggaaggaatagtcaggggcttatcagctatgcagtagcttctagaagtcaacagctggctctgggagggaaaagattgagaaaaacaa

SEQ ID NO: 121925 - DNA, 672 bp, Homo sapiens
gaatgaattcattatgttcatcatttcatcagtctattaaagtatgtcattatgtcaatatcaagtacatgtgtttgggaaattaggattcctaaaaaacaaatcaacatataatgtcagatactgaggaatgttttgaagaaaacacgatgtcagggaaggagagagtttaatggttatgggaatgctattttataaaggctatactggcttttttgctattgcttgaatgtagcaaatatattcctattttagggcctttgcacttattatggcttctggctggagttctttccttcagatatttgcatcagttgttttctcagtttattcaggagtctgaccaccctgtctaaagtagcaccttccaccattcaattctttctccttactctacaccgtctgaccttggggaccaaagagattcaaataaattctttgataaatcctttgctgtctgaactcttcatacttgctatctgaaatttggtaattgaagagattttctaaaatatttattcttatttgatctggatatctaaatcagggaccaaataattttgtatagtaaggcaggggttcccaacccttagcccacagaccagtaccagaccatggtctgttaggaactgactgcacagcaagaggtgaacaatgggttagtgaatgaag

SEQ ID NO: 121926 - DNA, 356 bp, Homo sapiens
ctggttaacagtagcctatctcagaaaagaaagattcctgctgtggaagatgggccagcagtcttttcacttctttatttcccaaagttcgttctttgatggggagtgctagctggtctgtccttgtaggctgccgtcccactggcccccagcaccacccagtacacagctgaggggacaggctctggacgtgggggcactgggctgcgaacccaagtctgattgcaaacctgggctctttctagaaccaggtgctttgtccttgagctgcgtgtgtctttgagtaaaatgagggccctgtccccaaggctggcccactgcccacgaatggacccaggggatttcagcttcatcac

SEQ ID NO: 121927 - DNA, 194 bp, Homo sapiens
gcccagctaatttttatttttatttttttttagagatggggtctcagtatgttgcccaagcatgtcccaaactcctcaagtgatcctcttgtgatcatcttgctttggccttccacagtgctaggattacaggtgtgagccgccatgcccagccaatttcgtcataatttttttgatccttgatagcaaaggaa

SEQ ID NO: 121928 - DNA, 118 bp, Homo sapiens
atcctgcctcagcctccaagtagctggtattacagatgcacgtgcccccattcccagaggttcttaaatttatgacaaaaacccagaagcttggctgaagcagcttgttggggcccac

SEQ ID NO: 121929 - DNA, 766 bp, Homo sapiens
tatgcacactggggatttattttagttatttatttaccatataaagctttgaatatttctttgcaacaggggtaagtagtctagaaattaaaataccctttaacagagagacttacatatccataacttccaaatgtgaaagagatagtatagttacagaatttattatttttttggatgtacttgtattttggggggatgcaaatgatgaatgggctgttttctgcctttgtttctcatccatttagaatctactgttatatattaatttatcacttttccccctataaaaatggttgcctacacaaatgagatttcagtgaggttttatggataatgcttctctagtgtagaatcgtttagttaatttatataagtatatgaataaaaactgattgagaaatatagttaccatctctgcttgacaatggtgagaagagctaagttggtatgtttttaaaatgcagaatgactcttgatttctcagtcttttccactacagagcaaatttagtaggaagaagagattaggataccatctataggtgattttatatcagcgtaaaatatgcaaggcaatttagactagtggttctcaaatttttcaatcttaggaccccttcatacttaaaatgtttttgaagacctctacaagcttttgtttttgtgaaataattaacagtatttaacatattagaagtcaaaattcaaacatttaagtatatatatatatttaaaataaactcattacattaacgcaaatgcca

SEQ ID NO: 121930 - DNA, 162 bp, Homo sapiens
agagcacatactgtgtgattccatttctgtaacatcctagaaaatgcaatctaatctatagtgacggaaagtagatcactggtttcctagagaagaggatggaggggagggatggatcacaaaggaacataaggaaattttaggggtgatggaaatgtttgc

SEQ ID NO: 121931 - DNA, 636 bp, Homo sapiens
agcgagctgcctttcagatgtcgagtaccagaactcagagactaactccagctttgcatccaaagtacaaaatggcattcaaaacgatgtatcacagagaacacagtttccttctacggagaacattgttgtactgtctttatctttgttaatcatacccttcgtacctgccacgaacctgtttttctatgtccgctttgtaattgcagagcgacgtattatatattcctagatatgggcttctgcctactgtattacagctggcgtgctaaagcccttgatgtcaaagtccaaaagcggttcctcaagagcttgattttttatgctacatgctacactaactcgtcttctatggactcaagactgcgatcaggaatggagactgacagaatgaggaacactgctttataccgatcaggcatacaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctacc

SEQ ID NO: 121932 - DNA, 799 bp, Homo sapiens
agtgagattaatgtacagacttcagggctctacaacccaaaagaagagtctccagtaataacagtagtttaaatttgctgactgccttctaggtgctaggtacaaccccagttgctatgtatggattgtatctgttcatttttacaagattgctgtatttgtcacagtttcacagatgaggagactgaagaggatagttgaactgacacagaaactgagtgatagggtggggctttgagtcctggaagtgtggttgctaatcctatactcttaccctcagcacacagagcccctcactcagtgtccccagacatttgagaagagatgtgatgaggccggccatggttctcttgtggtcagctcttgttctaatccttagcgcccatttggaaaccagttatggggaaagcacaatgtaggactcttgggactctgcacctgactggctggctttccaagatcactgagatggctcttcctccagcatagaaattgatggctggttatccagacagcaacctcttttgcccatgtgcttggtgctctgtcatggcgggaaaagtaactatgcacagatcatgattatggtattagattgggtacacatgaaattgctagtatgcacctattttgatgtatgaaaatatcattttcatgagattcatcctaatttatgctatgtatggggcctgattgccctaacagctcatcattgattggtagcatgttgtaataatgaaagagagatggatatctagctaccctacccaccccccatcagcataaggaagccgagaag

SEQ ID NO: 121933 - DNA, 339 bp, Homo sapiens
tggacgtcgaggccccgagagcaaagctggatggtgcacggctggagggtgacctgtccctggccgacaaggatgtgactgccaaagacagcaagttcaaaatgcccaagttcaagatgccgtcgttcggggtgtctgccccaggcaagtccattgaggtctcggtggatgtgtctgcgccgaaggtggaggccgaagtgagcctcccctccatgcagggggacctgaagaccactgacatcagcattgagcccccctctgcccaactggaggtccaggctggccaggtggacctgaagctcccagagggccacgttcccgagggagctggcctcaaag

SEQ ID NO: 121934 - DNA, 160 bp, Homo sapiens
attttatccgtccagtcttaatctctaaaatacatcttatactccagttatgttcctcaggagtttgtgacctttcatctttttcactaaagtggaatctaaaactgcaaaggaaatattagttggctgggcacggtggctcatgcctgtaatcccagca

SEQ ID NO: 121935 - DNA, 326 bp, Homo sapiens
gcgcattgggaggctgagactccagtggggacctgctgaccttcagctcaggggcctccacctgctctgctgtaaaacagggggctgagtgaggtggcagctaacagtcccccagcttggacagcctgtgtgtagataatcctggcgccacgctgtactgttagcacagaccgtccccagggaaatatgactcgcccgggtcaccggtagggccacggccgaacccaggtgccagctgactctcctgacagcgtccagcccactttccaccacagcccagctccccggccactcccggaatgctcctgacacgtttaggaatcatg

SEQ ID NO: 121936 - DNA, 590 bp, Homo sapiens
ggtagttcctcaccccatgaaggcgagagaaggcaaaatggcaccggcgcatttgatttaaactaattaaaagcagagggttgtgcaattcaatatattgattttaccagtgggacttaaatcttttataataagtgtacacagctgcagtgctctcccaccactacgctgtaaaggctaatccgcacattccttctgacaataacatgacaggtcccacacatccctgcctgtgccctaaccccggtgacagtgccagagtgcattaaggcgaagccttgcagtggcttgccaagaaaccagtgtgccaacagcccccccgctaagactgaagagtgagcgtgaaagaattaatgtggccagaagcatggtgcaaagggctccccattcaaaatattcaggctgttacacggatgggcagatggggaagggtggagacgggggagacttagggcacgctgattcttgcaatgggccaaatatgaccttaccaaatgagggagagatattaaagtgataggagtgatcaatcaacttagatgggactctccctggaatgaagtcaccagttgtctctgagttcagcggac

SEQ ID NO: 121937 - DNA, 175 bp, Homo sapiens
tcacacactgacagagatggttatggagcttgctcaaggctgctgttgtctttgtatgtgtcagaagccccacaggtccttggagggtgggtttctcagtaccaacagtggatgaactgttggagactactgcaggacatttctttttcttttctttttctttttcttttttttt

SEQ ID NO: 121938 - DNA, 199 bp, Homo sapiens
tgtgtatacatgtgtgtaaaattcgtaaggacagccacacctaggctgttgttaaaaatagcaccttaacagctaacacaatcttaaggtcacttcacatgagaatttttctctttttccaaataaagccaggcatacttattcttattatgcaaaatagtgctctcgattaaaaatatattgtaaaatactgtaaatc

SEQ ID NO: 121939 - DNA, 373 bp, Homo sapiens
tactgggaattagggcgttaatgtatcttcttaggcgacataaattaacccgacacagccaggatccctagttgtattatcagatccgaacttttctcacctttccaagaacatcactgtaactattcttccctctcttccagcatcattagctctcctctccctctacaagtccttcttaatcagggtacaacatgtggggatgtttttgcatattgaaacaaaacgaacacacacacaaaactctcttgacctctgaaaggtattagggttctcaagagaagcagaattgataggacgtagatagatttgagagagagagagagagagagagagagagagagagagagatctatagatggagattaattgc

SEQ ID NO: 121940 - DNA, 815 bp, Homo sapiens
agtcacaaggtgtgggctatcagcattttcccagcccgtaaacgcccttcacctggatggcgaggaaaggcgcattcatcttatgattcattcagtgtggatgtataacatttatcacaataaaaaatcatgtttcagcagtgataactacgtaccctcacttcctttaggagatataaatagagatattctgaagcctgttgagacttccaggatgaacctgtcagactgaccacatgcatttattatcccacttcttctgaagcccattaaaataacagtaagggggctgggtgcggtggctcacgcctgtaatcccagcactttgggagactgaggcaggcagatcacctgaggtcaggagttcgagaccagcctggccaacatggagaaaccacgtctctactaaaaataaaaaataaaaaaaactagccgggctagtagctggtggcgggtgcctgcaatcccagctagttgggaggccgaggcaggagaatcacttgaacccgggaggcagaggttgcagtgagccgagatcacgccacgtacactccagcctgtgcaacaagagcaaaactccatctcaaaaaaaaagaaaaaagaaaagagaaaaagaaatatgatgaaaagactaagttgaggaaatctcccaaaaagtagaacaaaaacataaagatacagaaaacaaaagagggaagagaaaaaagatcaaatagccgaccaagaaagttcccagaaagagaaaggggaggggagctggcagctggtatccaaagctggcatctcttggtgctgatggctttgtgtgctcccct

SEQ ID NO: 121941 - DNA, 426 bp, Homo sapiens
acagcagtctccagtgagctttgtcaggaggaatcaatagaaggaagtttggtgggataggatgagatgagtagtatagtgggcccctgaagctagtccctggaacaatgccagttcatgacatattaaaaatgataaagacaacagagtacatttttcataaagctaaatttattttctattatgagattatgcccttctcaaatttttaatactaaaatatccttccttatatgaaattatagtaatagtagatgatgttctttttattgttctcacttggcaaaatataaagttggtaagcctatgttctcaagtctcaaaatatttttcaaattgtaaatcacaaattctagaaactattgggctgataggtaatggataataagtgttccacaaagaagtaacagagtgacttccagatat

SEQ ID NO: 121942 - DNA, 301 bp, Homo sapiens
gctgggaggggagacgcactgggaggggcagaagtgatctttctgatgacaaatgtttcttttctttttttttgagacacagtcttgcactgttgcccaggctggagtgcagcagcatgatctcagctcactgcaacctccgcctcccaggctcaagtgattctcctgcctcagtctcccgagtagctgggattacaggcatccgccaccatgcccagctaatttttgtatttttagtagacggggtttcaccatgttggccaggctggtctcgaactcctgacctcaggtgatctgcccg

SEQ ID NO: 121943 - DNA, 385 bp, Homo sapiens
tctcctgccccagcctcctgagtagctgggactataggcgcccaccatcacgtctggctaattttttgtatttttagtagaaatagggtttcaccatattggccaggctggtctcgaactcctgacctcaagtgatctgcccaccttggcccccaaaagtgctggaattacagacatgagccactgagcctggccagacttttctttagcctgcattctgttgattgacaaagctcatctgctctggacctccgctttcacctcagtaggaataactcccaagccatttgctgtagtcctgaccttccctcaacttttaggcatttccagacatttctagatgtttgcaggacagcttctctttactgtgcttttgatacttcca

SEQ ID NO: 121944 - DNA, 246 bp, Homo sapiens
ctcctcttcccgccactcttcctccccctcctcctgctcctcttcccgccacatttctccacccgtccgtttcctactgtctcccaccatccctccctttacctcccttacgcacaccccacttctggagacaggagcaggaaaaactggggtcggcttgctcagcctgactggggctgaaacagaagtttgccacaaggttccaatgtttgaactgacctttggaggacagacagtttgccagag

SEQ ID NO: 121945 - DNA, 361 bp, Homo sapiens
ttcccttttggggtctttgctacactaatcaaaacagtatggtactggcataaaaatatacagataggccaatggaacagagcagagagcccacgaataaatctatgtatctatggtcaactgatcttaaacaataacacacaaggatcgactctttattagatggtgttgggaaaactggatattcacatgtaggagaatggaattggacccttacctcaccccatgtgataaagtcaactaaaacagattaaatattcaaacataagatctaaaactgtaaaattactagaagcaaagataggaagaaagcttcttgaccttgttctgagcaatgattttttgaatatgaccccaaaag

SEQ ID NO: 121946 - DNA, 655 bp, Homo sapiens
catttggtgaaataatctaaagatgtccattaggtcaagctaactgatagtgttagtcttctatatcctttatggtttttatactagtttttctattaattactgagagtaaattattgaaatcttcaccagttgttattgagttgtcagttttccttttcttaattctttatgtattgttttcagtattttgaagccctgttgttaggtgaagatacactaatattgttatttcttcttgacatattgaacctttctttcattatgaaatattcctgttattctcacatagcagttcttgccttaaagtatctttggtctaatattaatatatctacttgagttgtcttatggttactgcttgcatagtatatatatttttatttctactttgggtttatttatgctttgaatctaatatatgctctcctataggtagtgataaccgaatcttcttctttacccagtctgtctgacagtctctgacttttcatttgggttttcattataacatttaatgcaattattgatatagttttacttaaatttaccattttgctatttgttttctatatttctcctgtcttttttgatgttgttattttctgcatccttaactggcttcctttgtgttaaataaatattttccaatgta

SEQ ID NO: 121947 - DNA, 688 bp, Homo sapiens
taaattgtgcattcccacccaaaacattctggacactcttattttcatgtccttagactcccgaagagaaatacatgggtctagttgcaactaacacacacctaccaccatcatcaaaaaacacaaaaccaaaaccgatcattataccaaacttcttttgaaactccaactcagaataagtaggaagaagagacagccttttcaggtttgctttaagtctgcttcccagacaatattttgttccctgcctgcctgcctttcttgggtatccgctgcatgccaagcaatgtgttggcattgggaattcaacagtgaatttaaaaaaaagctcacagttcttagagtctcagttcttttcagtgggcacctctaattctaacgtgcaaaatctgacacagatttggattgaatggtgggagaatgagaaggagtaagggacacatagcaatttcaactgcttggtaaacaataactaaatgttaacttggaaaaaagcctgagaagaagctgatttgatgtgagtgaatgtaaatcatgaaaatatccagtttcatccgggtgtggtggctcatgcctgtaaactcagcactttggaatgctgaagtggtacggtcacttgaagccagaagttcaagactagcataggcaacatagcaagacccccatctctacaaaaatttaaaaacta

SEQ ID NO: 121948 - DNA, 255 bp, Homo sapiens
ttgatatttgcgtaagggacaaatttaactctaaatctcctggcagacctgccttccccatataatcagagcccatccacgtgtgacccttgtctaaagcttcaggaagatgctgccccttcccttttgccgctgctctctgatctgactttcatgcttaatctgatctaatcctgccagcattatcttcatctgtgcaatgaaacctggaggattctttctcatatttggtgaggaaaggcatttactaaatta

SEQ ID NO: 121949 - DNA, 191 bp, Homo sapiens
atgtagcaaaggggtcaaaggagggagagcttctttaggtctgagatctccattatctccagttagtcaaaggagccgagctttcctacctcacagaaatacacatctcaaaaaagaagtccgggccaggcactgtggctcacacccgtaatcccagcattctgggagcccgagacaggcagatcacctga

SEQ ID NO: 121950 - DNA, 238 bp, Homo sapiens
ctcggccagtactgggaaaagcacacacacgtggtatcagaagtgttctgtaggtagaaacagggtttaagacttgggcatctttattttcaacaattttcccattttccaccatagttcctaagaaaatggacaaggtacagtacgtcaaggtacaacgtgctgagtaccatgagagaaatgagatctgggacttggagagaatgggatgcccttaagacctggggccttgagttgg

SEQ ID NO: 121951 - DNA, 303 bp, Homo sapiens
ggcacaggctctggaacgcagagctacctgggttcaggttctagccttttcacttagtgggatgatcctggacaagtcgcttaacccctgtttgagcctcagttcttctttcctaacaggaggatagttgtgtctctttcttggcactgcatgagagctgttttaacccaggtggagccttgtcatagtgctggcaatggcactcctacccatttatgctagcttcattaatattctacttgtatgtggcactttttaaacaaaaatggtactttctgcgtatatcttgtaaacgttttgtgt

SEQ ID NO: 121952 - DNA, 230 bp, Homo sapiens
ctattccattatttgtatgtgtcatattttatttaaccatcctgctattagtgaccattgagttggcttcctgtgttttgccgttacatggttgcaacaaacatgtttgcatgtgtctgccctcatgtgcatgatacatgattgatttgatagattttaggaattacatcattcattcatacactcagcaaatatttaatgagtgcctactctctgataggtgctgttgg

SEQ ID NO: 121953 - DNA, 513 bp, Homo sapiens
cctcccaggttcacgccagtctcctgcctcagcctcccgagtagctgggactacaggcgcccgctaccaagcctggctaattttctgtattttcagtagagacggggtttcaccttgttagccaggatggtctcgatctcctgacctcgtgatccgcccgcctcggcctcccaaagtgctgggattacaggcgtgagccaccgcgcccggcctgttgcagtttctagaagcctgcttgcttctagaggaaggtgagataaagggaaactcagacctattagtagcacaaagtgcacacttcagcttggggtttagtaggttgtagaggagcctgtgagcgtgtgagttcagtggtgccaagatgtcctctgcccacagaggaagcaagaaagggggtgcctgtaccccttcagactcccaacctgaggttctcagattttctccatctcctactcttctagtgactcctgtgagggagctgaaaatcatttaagttagtgaatgaaaatacct

SEQ ID NO: 121954 - DNA, 412 bp, Homo sapiens
acactacagagatatgcagaaggtcagcagagtgaagaactccccatcccacatacgttgctgtgggttctctcattgtttctgtccagaggagaaaacaatctgaaatgtctgagaacagtgaacttaataataatacaacagataaggactaaagttgttgaattgcaaataaagttttaacgaaaagtaattaggtaattagtatgatacttaaaatactatttaaattcacgaaagaataacgataggaaaataacaagattttgagtgactatagtagattagaagtcaacaaaaacataaatgtaaaaagcatagtgctgagattagagttcaaataggtgagataaaatgtaaggactcattaatagtaattaccaaaaaaattaggtgagatagtttaaaatct

SEQ ID NO: 121955 - DNA, 826 bp, Homo sapiens
ggccaacctggggctgcaagggcagcaggaaaataaaatcacctctgggtgcctgacacatctcagcactgcctgagcaaaggatccacacatcttcccttgtggtgctggactgagggcccagttctcagagccccctcccaggaaatctgtttctgctaccttggtggggaccactccccagttccaaaatatcttacttggaacttcagagcactctggtcacaatttttcacagcttttctgatttcagaaaggtctcttggttgcctggtgaagaggaaagggagattgtagtatttaaccaagcaacatttaggggcactttccctgtgcaacctgctgtgctggcctctgtgcccagggtccagggcccttgtaagaacccagcatctacataaacatctggaacacaggtggtgcagtcagtccaggtgggggacatacagaagctacagtgagtccaggcatcgacagcaacaatgaaatccagccgacagaatcagagggagggcagactggggctgggctctgaaagaaaattaggactttgagagggcagttccatctctaaggtaatgttcttgcaccttcagatacccctgggctgtgagctggtagggagtaggacggagagttcctatgtggtaaactgggggaggggaggagtctcttcttaaggaagacttgggagctaaggagaagtgggtaggatggccagccacggagtcgaaagggacttgtgatgggtccagggtccgtggttaccacatgaggttgccactggacgcaaagcatcaaagaagttgcttgccaacttttacaa

SEQ ID NO: 121956 - DNA, 353 bp, Homo sapiens
ggcagccacccccgcggcaggatgccggggtaagaaccagcaggaagcgctcccctaacgtctttcccgctcactgtagctgccacccattctttttaatccccagagagcatacagatgagccccagtgggccatctcagccacataggggacaggccggggagaggatctagagctggcccaggaaaggaggcccttttcattttgagggaggcctcccatcagagaagggtccagtcctgccccgaccctgtccttcccatgatacccacaatcccagggtgacctgtctccagggcagaagtgacagacgagggctaggagactggctgaggcctaagtcctctgcaat

SEQ ID NO: 121957 - DNA, 542 bp, Homo sapiens
gctgggactacaggcgcctgccactacgcccggctaattttttgtatttttagtagagacggggtttcaccgttttagccgggatggtctcgatctcctgacctcgtgatccgcccgccttggcctcccaagacaatacattcttaaactttgctactcaaagtatggtttgtggaccagcaacactggcatcattgggggcctttgagacatgcatactctcagccctcaccccagacctgctgaatcagaatctgcaggttagcaaaatcctcaggtggtttgtatgtacattgtggttggagaagcaccatgacagttttggaggccagaagtccaaactcatggtgtcggtagggctgtgctccatccagaagttctaggggagaatgcttccgtgcgtctcccagcttctgatggctcctggtgttccttggcttgtggctgcctcactccaatctctgcctccatcttcacagggccatctcctgtgtgtctgtgtcttataaggacacttgtgaagggatttagggcttacctgg

SEQ ID NO: 121958 - DNA, 271 bp, Homo sapiens
ccagggagacccacacacccacagacaaactagagagggccagaattttctaaaaatgctgaccagcaggggattaactgctctttttgggcagaacttctggccgccacggctggtatccagaggcggcctcaaagttaccacagacagaagttctacagatgcttctccatggtcagttgctttgctgtttttatggccctccacggagtgtgcacacttactatctcagctgccatgtgacttcaatttctcgtcaggtcttagggtg

SEQ ID NO: 121959 - DNA, 153 bp, Homo sapiens
ttttttgagacagggagtttcgccatgttgcccaagctgagtattaaatatatttcaaggaaataagttttttcttacatattcaagggaggtattctagaaaaatgtaagatctaaaaatatgagtcaaaagaatttctctgcaagatatat

SEQ ID NO: 121960 - DNA, 545 bp, Homo sapiens
aattgttggtcctcagatacttaggagtttagctgaggaagctgttttttttatatccttaataagcagttaacggcccacaacagaagatggaaaatctcccatcagtctaatactgtatgggattttcccttattgctctactgtgtagtttttttaagtgtgttaattgagttccctacttctctatagggaatcttaagatataaacacatacataaacagacaaacaaacaaaaactagactgaatctgccagtgtttcctttagtccctagtaggccttattattttatgtttgaattgatttctgtggttatttactccctagttaattattaaatagaacaaacaaatctatattccccatttatgccaacaacagtaaaatatcatcacgtaggtattatttttttctctcaactctttgggaagaaaaggtttgcatgaacatatttatgcctattgcatcttctaaacatcttgacctcttttcttgtaaaataactaattgaaattaatcaaattaattatgtatttttctct

SEQ ID NO: 121961 - DNA, 235 bp, Homo sapiens
gatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaa

SEQ ID NO: 121962 - DNA, 136 bp, Homo sapiens
gcttcacatcacatgatttaaggagaccttgacttcaatggctgcttttctctggagaagaacctagagatttggtggtccttcctatccattcctcctccctctcgtctaactcccatcccctagtgtgacaatt

SEQ ID NO: 121963 - DNA, 353 bp, Homo sapiens
ctttattcagtatggtggtgtgtgtgtgtgtgtgtgtgtgtgtgtgtgtgtgtgtgtgaatctcaattattaaccaaaaatgtgtgtgtgaatctcaattattactcaaaaatgtgagatagtgtcatacttttactaaatttcaaataaattcttagtaagaacacatgtagcagcttctaatttgtgaaactgcaaactagaattattcaactttcactatataattactacctctgagaatagagaagaagaaaaactaacatattcatgtctctaatgaatattaaatattatgctctgatggtgtaacaagaatcctctcataacagactttgtttacatcactggca

SEQ ID NO: 121964 - DNA, 676 bp, Homo sapiens
cataggagaagagctgctgcttgagagatgggttcctggaataaccaatgatcaagctgccaaacgctattccaatgctagcccctgaaccaaccacaccaactgtgtctgcctcagcaccaataaacttggctgcggtgtcaatgtcccaggagacaacctggtctagaactcctgtctggccacacctaaagtggggagctgctgtaggaaggctgtttagatgaatgctctgggctattcaagaaggaggcagacacaggccggattagacccctagtacaacagcggatcagagctggagaaataagtaatgccccggtgggctgcattttctcagtctcccaactttagcccttggtctctccctgctcttcttaaagggagcccatggaagggtctgatcgttcaggtcttttatgtccaagcactgcccaggccttttcttctctttgctcctattaacacctggcctcctgtctctgctccagagatgactgatttcctgaaggaaaattaattcacgctaagttgtaaaagactgacagtaatgttgtataacctattgacatatacctcccatgggatatttgcctgttaactaaatctctttggggagaaatttcaaacttcatatcaagcctgcaaggataatactccagtaaacttgcatctg

SEQ ID NO: 121965 - DNA, 211 bp, Homo sapiens
atcacttcagccaggggttaagccagcctgggcaatataatagtgagactccatgtctaaaaagagaaagaaccagcaaaggagactgaaaattgagtagtgaaatagaaagaaaaacgagagatgttctgggattggcccagtggctcactgctgtaatcccagcactttggaaggccaaggtgggcagatcgcttgagcctaagaattt

SEQ ID NO: 121966 - DNA, 113 bp, Homo sapiens
caaggctgcctcgggaggtgcactgtgggaggtgtgcgaggtactgcgtaaggtactacaggagcaggaaaaggctggaggggctttctccccctctgtggctgtcccaccct

SEQ ID NO: 121967 - DNA, 508 bp, Homo sapiens
attactagaatctagtggtctggagggaggccttggatatgtcgatattgaatatcaatgcaaatcctcaagatatatatattttttagttggatgaccctgttgatggggattttgaattacttttctttggtttccaatctttgaagtaggaagtgttgtattttaaagagcataaaacaaattcacaaaaggttaagtgatttgctcaatgtcacatagctaataagagacctagacaggatgtgaacccagctagactgactccagaggctaagacattagcaactaaactatgctgactaatggttgtttatttttatgtcaccaaagtccaaacaggacagagtaagatgaggatggacaagccacagtgcaaatgcagaaggacctaaatgttggaaattaatccagatagcaaatgatacctaggtcaaagagtcttggcaatctctggtaaatatttttcccagaaggtttcaaacataattcaagtttatttaaaagt

SEQ ID NO: 121968 - DNA, 942 bp, Homo sapiens
agctgactcacatgatccaactctctgtgtaagttttacaaattcaatatactgtggaagtaccaaatacttttcaagttttgaggcaacaaaatacagattccaggtagggtaagaagtttattaatcaaaggtaaactgtatgaacaatattgctggcaggattcctgtaaacttaaaaatatttatgaatgaaataatgtgatgtctgattttgcttctaaataatcagggagcataggggtgggtagaggtataaaatttgctgtaagaattaataaatgttgaagctggatatgtttacacatggggtcttgacaattcactctaattaatgtgtatatgtatagtatttttataaccaagagtttaaaaagattcctctactggagcagagcctattgcattggttaggaagttataattagcatcttcttatgtggtaaatctgcagagactgagataagaacttggcctctgataatttccctctaattggataaaatgccccttcactgaaagaaagtaaacctgaagagtagctttctctaaactagcaaggattctttaccatatgtaattaaaattcagatacaacaagctctccccactgctgcccatctgcctgccagcgcatcatatatggggctatgcaatgcagcacttgcgggtatttggaggaaaccagaacagtctgctccctctctccaatcccactgctcagagagaacacacacctaagccaaaggaagagggcagcaagtacattccagagaggctcatgttccctcgggtactggaacaaaatgaaagcttttcaagtggaagccggagtgcttccctcccacaggcaacacattatctcatcttaagccctggagttctaagagctacactcagggcacctggaagacaagatgggaaaaacaagcccagagaata

SEQ ID NO: 121969 - DNA, 242 bp, Homo sapiens
ccacagcctcaaggaattcatctgtgtaaagggtctgtcatggatgatcagacccatcccagtctgagcatttctggggtcccaggcaggtgacccttggggagtcagggtgaggagaagctggtctgagcctgcgcagcagcccagaagctgggagtagaaggaagctgccctcccccacatgcccggcctggcctggaatcgttctcggatttgatgagtgattcataacctgacgctgc

SEQ ID NO: 121970 - DNA, 684 bp, Homo sapiens
taggcgtgagccaccacgcccacccacaaatgtatgatcattaatttctatttttttcctttttatcagcttagataatagtatgttctctcatcttttccctgtcatataccttatttccttctgatgtacatgatgaattgaaaggatattaaaactcaggttgaggaagtttgactctaaactcatgatgtgatttagatacctttgaaatgtctgaggaagcagatacaagacttcataaacgtgtttaactagtcagcttaacttcaagaattggcatatattataaattagtttgtgctccataaaatttaatatttcctttagaaatactagatggttataaaatcaaaatggagtttattatagtcactacttgtattgatattttcctaacccaaataaatcggtatgtatgtgtgtatatacatacacacacacacacacacacatatataattaatagcatgaggcttgtgtcctgtttaaggtttcttttgtattcaattatctttattatcactaactttgtagcttaatctctaatgagtaactgaagtaataaacttttatttcctgaaagtaatgttgagttgctttgcaaaccattttatgaaattacagactgatatcttttgtgttgtaataaaatattactacaatgcattattaaaatcccat

SEQ ID NO: 121971 - DNA, 197 bp, Homo sapiens
gcattaaaattatcagacaccaattataagacagctgtatttattatttgaagaaattaaaatgagcttgaaaataatctgcagggattatagaagatttgaaaagatccaaatgaacaatatgattatcaatatgaaaattcagtggacaaattttgtagcagtttgaacacagcaaattagtaaaattagtaaac

SEQ ID NO: 121972 - DNA, 717 bp, Homo sapiens
ggaagaggggaggggctgctccccttcctctttttaggtctttgtgtgaggggaggggaacagatgtactattatgtggattagggtcctagggatgttatctctgtgtcactttgcctattgaatttatgaaggaaggattgatagcttcattttgcctcctatcctgctctctctggtttgctgtcttcctgagacacttccttatttattagaggccatagtaaccatgtccattgttatcctggggccttatccacaaacaactttcatattgtttttaaattaaattccagcctgggcaacaagagtgaaagtccgtctcaaaaaaaaaaaaagaaacggggccatagggccttggaggcaaagggattaacaccctgggctaagaccttaaagttaaggggtaagggcattaacgtttaaaggacccttcccacaagtatacacagtgagagatgataaatcaagccttgattggccataatgatgttgacaagggaattttaaaaattcacggcaataagttagtacatagtttacacaagcgaatttcaaaggaagttttaccacaaaggggcaacccgcgactgtgcaaaggcttggaacatgtggacaggctacacacccctgtgctaacttcccacgacaaatgtgaggcacatgcttcccaccacgccgaacgcacatgcgttagacccccagagacattgggaa

SEQ ID NO: 121973 - DNA, 124 bp, Homo sapiens
tctgttactccacttccttttctactcaaagacctttttataaaagaaaccagggagcacttaaaatttgttctctaagtttagagctggactcaaaccattactggcaaaatcaatctggtcc

SEQ ID NO: 121974 - DNA, 371 bp, Homo sapiens
agaggctttggataagtttcctagcctccctgagcttcagtttcctcatctctaaaatgataattggaaaaacctttctgaaaatgactgagctaatatttgtaaaggctgcatatgacttttgtaagccctaggcactttcgttttgtaggtgccttcctctattaaaaaaaaaaagaataactaaataaaaatgaggctttacaactgtatcagtataaagatggacataagacagattcattattgagaatcacttgaacccaggaggcggaggttgcagtgagccaagattgctccactgcactccagcctggcgacagagcaagactctgtctcaaaaaaaaaaaaaaaaaagatagattcattat

SEQ ID NO: 121975 - DNA, 480 bp, Homo sapiens
gtaagtgccttaaacttagtttttattattagttttattaaggactgagcagatgagaatagattcaatatgaaaacttagggaaccactgaagttccttgaagtgggaaatgagaatggaatgcagtgtttgggaagaatcacttggcagaagtattcaggctgggtcagaaggcaatggtgtagccccaaagggtgaagaagggctgaccagggactagaagcaacccctcctgaaaatgagaaagcctgtccacttgctggtacatggcatgcacaggcactcagtaactctactgaatgaaagtctgcaccaattgaacaatataattgtggagctcccaggctcaatcgcaaatactatcagaattctccctcagtcaagtatagagaggtttaaagcactggagaagttcactgagacttggcctctggttcatttcaatttctcccccgagtagctgggactacaggtgcaca

SEQ ID NO: 121976 - DNA, 105 bp, Homo sapiens
ggggccaaattaaggggtagtaaaaaagtaaaagagataacccttaaaagggagctcttggaagagagttttctttcatggagttagggatgaaggagaacgctt

SEQ ID NO: 121977 - DNA, 659 bp, Homo sapiens
cgcgcggtggctcacgcctgtaatcccagcactttgggaggccgaggcgggtggatcacttgaagtcaggagttcaagaccagtctggccaacatggcaaaaccccgtctctactaaaaatacaaaaattagccgggcatagtggcacacgcctgtaatcccagctacttgggaggctaaggcaggagaatcgcttgaacccgggaggcagaggttgcagtgaacccagatcacaccactgcactccagcctgagtgacagagtgagactctgtctctaaataaataaataaaagagcagatgactcctgtgggcaaaagaggtccacttgggaagtagctgggcacttcctgctggcccaaatttacccctatgcccaagtcctcattcactgtcttttcgtggctgtgtcccccattataggaaaagaaaaggtcatttaatgctctgcgtttgcaacctgcattctccgtggaaccccaggacttctgggaagtacttcaaagggctactgggaatagaagactagtggtcagggctgtagtccacactaccacttcaactggaacaacatttttctacctaaaattttgggcttccacttacaagatttgttgaacggctcagcagattaaaagtaaaggccagatctacttctg

SEQ ID NO: 121978 - DNA, 583 bp, Homo sapiens
gtgcacagttgctaggaacagtgaatgattgtagttcagcatcacactgagtcctgacaaagatttcacatgcgattttcaccgatgttgacaactgagtaaattctttaaatctcgcttttgacgctggcgtacacctctcccattcgcgtgaccatctttgccttactgttttgttttttagttttgcttcacgtcattctccagtgaaaatatatacgcatatacttgtgttttccttcagacttctcttaggttcctggtattgtgttttcaatccagcattcctgccttcctgcgactgaaacgtatccaaatgtgatatactattaaggatttttcagggacctatcttaggggatacttacatactcgcatcaccttgtcctgtttttttctccgaatccgtgtgtgttttggaagtatatttcagaatcacagactaaacactaatatattcaatggatcataagtgtctgccgccttcttgcaaaatggggttcccaagagtgtaacagatttaatagtagttttcctctcaacttattttgctagatgttaatgagaatgagttaaattgctt

SEQ ID NO: 121979 - DNA, 275 bp, Homo sapiens
aggaatgttgcattggcaactcagatgtctccagcagggttgtcagtggtgatgtcatcttttgaaatgatgagcaactgttggcaaagttctgagcaaaacaaagtataatcttccctcaatatacgtgatggttttgtttctggaaaatttattatgtcataagatgattttaagaacaccttgttcttccttgcaaaatggagttgggttctagactcagctaaataattagtttttttttttttttttttttgctttgtttttaaatatac

SEQ ID NO: 121980 - DNA, 418 bp, Homo sapiens
tataatgtttcctgactatcaaattaggtctgttctggttttactaagaagctgtcacttcagaagtgtccccataagccctggcaattatagaaaaatagaggagaatttgagggccctctcagatttgcatagctatgagagaagagcattcaagatggagaactagactgcaggaggtagccaataaacctctgcgtggccatgccctgtccttggcttgtaaggaggcttggctgctgcagaggtttgtaatggctagtaatcaaacatctctagagaatgtctcccaaatgagttcagggagaacaagatcaacccttcactgttgtatttcagtccatggcattggcaggttttcttctgggcacttacctgtaaaatcgcaagaaaatgataaatttccttgcaagaaaaa

SEQ ID NO: 121981 - DNA, 645 bp, Homo sapiens
atgtcactccaagtgagattccctaaatatatgatatacagacagatatatgggtttgaaactctggagatgaatacaaatttaggagtccctggaacacaggtcatgacttaagtaatgggagtcaaagattactcagagaaagcacagaatgagaagagaagaagtaggacaaggaagaagagatcggaggagaccaagaaagggtgataagatcaaaacaggagaaaagaatccgacagaagtctcatttgattatcatgtcccttcccagaggacagggacatgtcttttttgtcttttatacccaattatcacaggtcctggtgcagcagacacacagtttttttttttttaattgtgttgtactattcacagtttcctgtattcaccaggggagaaaaaagtaagtataaagaagcacagacacagatgtttttacactgtgtactaaaggggtcagattatacacaatattttatgccttacttttttacttaatatatcttagaagtttgcacgtgctcttatggaaagactggctgcattttttggtccacaacagaacaacagaatattctattataaaacggtacactataatttttatttaaccaactctttattggtggacattaagaatgg

SEQ ID NO: 121982 - DNA, 406 bp, Homo sapiens
taaacacgttctcttccttgctttcctgcactaatatacagcaggtgctcaagacatgcacggtcactgtctttacatgtaaggtctcgcaaattgcataatcctgttctgtgtgtgtagttggtgtcttataagtgcatgttctctccccttgtgcagcagcagctctgggtgcgcagccccttctcctgtatacagtgtgtgcatcctaagtgcacatcctctcccctggattggcagcacctccataagtgcaccggccttcccctgcatacagcagacgcctattaagtgtctgctctcctctcctctgtacacacaagatgttcaccatgcgctcattccctgccttcctgtcaggaggtaccaacagagctcagacagatggggctcctgaagggtcccg

SEQ ID NO: 121983 - DNA, 454 bp, Homo sapiens
cattggagctttgctcaagaagtgaatttgttcttccacccagcatgaagcacatttagcttctgttaccaaatatgagctttattcttgaccatcaggatgggtttctgcagctgaaacaagagacgtgtggtttgggctatgtattcctttgctggggccaccataacaagctaccacaaaccaggtggcttcaaccacagaaattaatattctcacagttctggaggctggaagtctgaaatcaaggtgaggttggtttattctgaggactgcgagggagaatctgtcccatgaccgtctcctagcttctggtagccctgagtttcctttacctgtagatgacattctccctgtgtctacacattgccttccctctacctacatctctgcgttcacattccttctttttataaggacacagacatactgggttaaggtccaccctaatgac

SEQ ID NO: 121984 - DNA, 487 bp, Homo sapiens
tcgaggaaatgcaattaaatccatggagttaccactatacacacattaaaatgactaatatttaaaagactgacaataccaagtaggtgaaaatgtggagaaatagcaaatcttatatttagctgataagaatgcaaaatgacgcagccacttggcaaaacagtttgatactttcatataaagttaagcttacacttaaatacaatcctgcaatctcatttttagatatataccaagataaataacatatgtcaacacaaaaacttctaagtgaatgttcatagttgttttatttgcaattagccaaattacagacagtaaaaaagtccatatacctgtgaatggataaaacattattatatatttatgtcaaggactatttttcaacaataaaaaggaacgagcattgtggtaaatgaatgaaaccaggtacaaaatattacatgccatgaaattgtagaacagacgaactattctctagtgaaaa

SEQ ID NO: 121985 - DNA, 298 bp, Homo sapiens
aagtgttgccggtgactagaggatcccgtctacccacaggttaggacaggtgcgggggctcattttatttttaatactagtaaaattaatttatctcaggggttttgtccccttcactccaacccccacacttccaaaggcaactttaaatattggttatctgtaccaccaggaagatgctgactattacttcatcactaagccatttgttggtattggcctttcggggaccagcttcttgcaggtagcctatggcccccaaggttcatcgaggtcagaatgggccgggggttaagag

SEQ ID NO: 121986 - DNA, 351 bp, Homo sapiens
gtagttttgcattcctgggataagccttacagggtcatgttgttgttgtagtagttgtttaaataataggttcagttcatcaatatttttctgaggattttatgtctgtattcatcacgatcccactacttactggggttgtggccttgggtaaattacttaatttctcttagtttctcatctataagaagggaataatagtgagagatcttgcctcccagcattatggtgaggtatataacccttagaacagtctgtgagacatggtaaacactcagtaaatgttctcattgttgttattgtaactgacacgggtctcctctttcctgggtgtgtgtatgtgtctctgtg

SEQ ID NO: 121987 - DNA, 408 bp, Homo sapiens
agggaagagtcctgaacaattttgggttctaattctggctcaaccgcaaaatcgctatgtaacattagactggtcacttaagctctctaagcctccgtttatttattttcccaaattgggataataataccagtccctttattgagaaggtcaaatgaaagagtcaatgagaatgtgaagttacaggcacatgaatagggaggttcatggggcagggccctaggatccctgaccataaaatagccagtcaggacacccaagaagtcatgatctgggctgtaaggggcgcgatcataaggctgcgctgccaggctgagccagtgagtggtggtgggagagggagaaagacagctttaaacacagacttgaacagtcttctgagaaacacccaccaccctggtcctcaca

SEQ ID NO: 121988 - DNA, 253 bp, Homo sapiens
agaggaggtatgttatgtgaccagcatcaccctgtgggtctttggggacatccacagaaccttcccaggcaggctgaggagagccggcctcaaactaaaggagatacaaggggtattgtgggaaactccagatgaccttggggccactttgtggcctttcaggtccttgcatataattacagagccatgtcaagctcaagtgtcatagctgttcattttcagagtaactcagaggaggaaagacaagagcagg

SEQ ID NO: 121989 - DNA, 339 bp, Homo sapiens
acggataataactcaaccaattaccaatcagaatatgtttaaatctacctatgacctggaagcgtccccactctttgatttgtcctgcccttccagatcaaaccaatgcaaatcttacatgtattgactgatatattattgttacagtaggtagctatagccaggcatgaggtgggcaggaaagggtttcccacctacccacccaccaggagtgtcaggtgaccgtcaggtgatggtttggcagttatcccactgcctctctaaaaatgataatcggcagttggcgccagggagaagcagtttcctgatggtccccggttgtcacactaaagtgataat

SEQ ID NO: 121990 - DNA, 1379 bp, Homo sapiens
tgcttattttaccagtctgtcttatcctgagaatatctttgacattcaactctgcatgcagacccttccttacacgttctagagagaggacctgtcttcaccctgtgtttattacccacatacttgaacagctgtttcctccaggcatcattatgcaaaaggaatgaaacccggtgtgtgcagcttttttagaggacgtaaaaggagtcagctcttgcctctcatcaatagtattgtttatcagtcatttctcttttgaggcattggttgaataaatgggaaaattcctgctttcaaggaacttagcagacttgttgacagataagaccataagaagaaagccagtgaagtacccagtgatgtgaacgccatggtatgagcaagtacataatagagaccacaagtgctttttagaagttagagatagtcattctctggggcttcctcaggaaaatcctcgctgaatctgggatctaaactgggccttatgattcttggatataaggtttgttgtataggttgatacaagttacttattaatagttgtttgcccccctccctttcactatctttaggtgatgatgtccacacctttccacatctcctcaggagctggtgattcccagatactatttgttaacctgcatcaccactcccatgcacacgaacacaggacaaacaaatccagctgcttcctggcatctctacttgaacaacttaaaggcaattcagatcccacagggtgaaaagctgaattcatctatcagagtgttttctaaaatcccaagtagattatgtcccattcctgcttaaaatgatctcctgattctcattgccttttggataaaatccaatcctgagtatcaacaagggtcttgtgatttggtccttttctgtgtcattctttagaatttctggaagcagcctatcatcgctccgtctgccctccatacacagcgtttgtgtgtgttatgccaaactgcttggtgttttccaaccgtggaccatgatatctcacttccttaaccttaccttcatatgcttttcctttgtgtcttcttctgaaatgcttcttccttttgtccaggctgactcctgtttgtctgagacatgtgtctcaggaagcctttccgttcccctccagtcattcatacctctgtcataacacatagactgtatttttaatttgatttccaatctgtctcttttaggttgtcaccttttttgagggcaagacctttttgtttcatggctttagtttgctgtgtttgttacagtgcctggcatttggtaggggttgagtaaatgtatacagaataaatgaagcctgggagaaggagttccagttaagagttctaataaataactgttttttcaaa

SEQ ID NO: 121991 - DNA, 394 bp, Homo sapiens
tagaggctagggatgctgctaacgtcctgcaatacacaggacagccccaccctaagaattacctggccccaagtgtcaatagtggagaactctcgctctgcaggtttcgcctagttcctatgcatggggatgtttgtgtttccgagagcgtctgtacattgtcatcagaccctaaatcatgctggccccaggtgtcagttacttgacctgtatttgcttaggacacagtatgtgcaagacactcctgggtgctctgtgggttacacagccttactctacccctcaccaccatgtttagtgagtaaatgatttacccaaagaaccacagttaggaagtggcagagcctaggtctgaatccttcactaactccagagaccatgctttttttttttt

SEQ ID NO: 121992 - DNA, 172 bp, Homo sapiens
aatggggggcaaaggtctcactgagttagaaatgagtgggaggtgagggaataaaggacatttcatccaagatgccccactgcggaaggaatagggacgcgggcagtactggaggaggatgtggggatcaagggaggtgtgttttctaggatcaactagacttgagctagtg

SEQ ID NO: 121993 - DNA, 451 bp, Homo sapiens
ggttataaagtgatacagtaaaatctcaaagccaagatacaagtgttgtgggttctattttggggttatctattctcatgagaaattgagagctgacaatttgagagtagcacagttatcccaggccagaaaggaagaccacactaagtactcagttcccatttttcacagtcttcattccaaatccttgattatagaggactgatagaaatctttacagaagctcttgggaatgacttagaaaggtggcagagagagtgagctatgttcccacgaatttcaggactatccagggtcccaaagagtatatacattttatcactggctaccttgagaaatgacagtaccttggacaaaaacactacttgcaattcctttctaagagcaggagctagcaaacaagtgcttaaggacagggttcaagggtactaagtaacatggaaatattcga

SEQ ID NO: 121994 - DNA, 438 bp, Homo sapiens
ctcctccctttgaccaggtgatactgttaaaagcctagttatttcattgctagtcatgcaaatggtaattagtgtacattagagcaataatgcattcccaggttcagtgtaaagagcatggtgtttccatgctctggttctctctccttgtcacagataataaatcacaagccatgtttaaaatacattctctgcagtctttgatactgtgtagtgcaagcaacagattcatagtttctttttaagaatctgaacttttacagaatatgtatatctccatatacttttaaaaacatattaacataatatgtggctgggcatggtggctcatgcttgtaatcctagcactttgggcggccaaggcaggaggattgcttgagtccagcagtttgagaccagcctgggcaacatagtgagactctgactctaaaaaaaaaa

SEQ ID NO: 121995 - DNA, 768 bp, Homo sapiens
ggacactgatattcaagaagccatttcaagctgaaagtcattattctgctccttgtatgtttagtggttcggtaatcatttattcattccatatgttgaatgtctttgtacgaagtctatgaatgagtcctcttaaggagctgacatccagtggaggaattcaacatgtaaataaataattttactatagcatcagtataaattagagatattaacaaaatacaatagtttccaaaatattttaattccaacttcatttgttttttgtttttttgttttttatttttgagacagagtctcactctgttgcccagcctggagtgcagtggtgattttggctcactgcaacctctgcctcccaggttcaagccattctcatgcctcagcctcctgagtagctgggattacaggcacccactgtgcctggcctaattccaatgttaaaatcttgaacatttattcgcaaacatactactcatttcaaaaacacctacacattttttcttctaatcctatattctttattttatctgagtttaaaacttagaatttaaactgtagatttaaaagtagcaaggtgagattgatcagtatatttaactatgtgctgaggttgataagtatatttaacccacggcatcctgagcacagtattgtgttttcacataaatgcccaagacttagttcgtaatgatctttcgctaaaatgtgtatccttgatccaggtggagctgagagaatatacatgaattaaatttaattaattaa

SEQ ID NO: 121996 - DNA, 486 bp, Homo sapiens
ggacactgatattcaagaagccatttcaagctgaaagtcattattctgctccttgtatgtttagtggttcggtaatcatttattcattccatatgttgaatgtctttgtacgaagtctatgaatgagtcctcttaaggagctgacatccagtggaggaattcaacatgtaaataaataattttactatagcatcagtataaattagagatattaacaaaatacaatagtttccaaaatattttaattccaacttcatttgttttttgtttttttgttttttatttttgagacagagtctcactctgttgcccagcctggagtgcagtggtgattttggctcactgcaacctctgcctcccaggttcaagccattctcatgcttgtaatcctagcactttgggcggccaaggcaggaggattgcttgagtccagcagtttgagaccagcctgggcaacatagtgagactctgactctaaaaaaaaaa

SEQ ID NO: 121997 - DNA, 241 bp, Homo sapiens
catacctacctctgcccacaagataatgtactacaaataaatatcacaccctattccatggctatatccacactttctcctctccctgaaaacattgtttatttttcaagaaacccagaatatggccgggcgtggtggctcacgcctgtaatcccagcactttgggagactgaggcaggtggatcacaaggtcatgagttcgagaccagcctggccaacacagtgaaaccccatctctact

SEQ ID NO: 121998 - DNA, 256 bp, Homo sapiens
gcacagtgcaacatagttcatatttggaatgttggtgctttcaaagtactgaatgtttttagtgtctccacacctctggaaaaaactggacagttcccaatatatgacttgtctcttcaaggttaaataaatgctcaaacagtgaataaggcaagggaccgaccagaaggagcttgagttcgtcatgcatcaggaaccttcattgctccctttggactgtgctggccaagactgctaaagcatttccattgactat

SEQ ID NO: 121999 - DNA, 372 bp, Homo sapiens
aaattatcaaaatttgcataatgaaaatgaagaaaatcacccatgataatgccactttgaactgttgatgttccttaacttacgatggagttacatcttaaaagtcaaaactaaaaatcatccaggtgtggtggctcatgcctgtaatcccagcactttgggaggccatggcaggagttcaagaccagcctggccaacatggtgaaaccccgtctctactaaaaatacaaaaaaaaattagctgggcctgatggcgcatgccatcaggaggctgaggcataagaatcgcttgaactcagaaagcagaggttgtagtgagccaagattgtaccactgcactcccgcctgggtgatggagtgagactctgtctc

SEQ ID NO: 122000 - DNA, 243 bp, Homo sapiens
ttcttgcctcagcctcccaggtggctgggactgcaggcgtgcaccaccatgcccaggtaatttttttatttttagtagagacagggtcttgctaaactgcccagactggtctcgaactcctgggctcaagcgatcctcctgcctctgcctcccaaagtgttgggattccaggcatgaaccaccatgtccagctctgatttttcttcttattactgctttttagcagtttgattatgctgtgca

SEQ ID NO: 122001 - DNA, 276 bp, Homo sapiens
caaagtgctgggattacaggcatgagccactgcacctggctgattttatctctaattactaatattttaggtcctaaacaggtcctcgattactgatattctagaatttaaaccaaatgtgtaagtaaattttgtcttttgtcttttcttgaggtatatttttttaaaggaagagtaaatagttctttgtgaactattcttgaagtgtattgtttttgaagtgtattaaatttttgaagtgtattgttaaagaacttgggttataagatgaaaatt

SEQ ID NO: 122002 - DNA, 354 bp, Homo sapiens
aggggtgcatagcagatacatatatttatgggttacatgagatattttgacacaggcatacaatgcataatagtctctttttcatttaatacataataattgtctttctgtttcagaaataataaaagtatcaaaattttaatggctgcatagtattccattatatggatataccgtgatttccaaatttccgctgttttgaacagtagtgtagtgaactttcctttacacatgtctttgagtataggacagattatctccttggaataaatatctaaggatggaattactgggtcaagggcaatgtatattttacattttgctacgtaacaatacagcagtcatctgagatac

SEQ ID NO: 122003 - DNA, 303 bp, Homo sapiens
gtaaaatggaaacatttcaaagaaatatataagaatatctttatgaggtagtgagttcttaagggtcaacaaatacaaaccatgaagaaaaagactgataaatctgactatgtgaaaatttaagatttatgtacatgaatacatcggaagcatgtgaaaagggaagtcatgactgtgcagtgcacgtaggtgacaaaggttagtatccaggataaagaaaaactacgcatacggaagaaaaagacaagtaaatacaggtagggaacacataaaagatgaaacctaagtaaccagttaatatat

SEQ ID NO: 122004 - DNA, 816 bp, Homo sapiens
atttccagctagagaagtccagcttccagagggttcatgatgcctttgattaagatatgaaagatgggaaccactgaaaacagctagatctaagagtgcatatagagagaaaattataccgcaatgtactatgaataaccacgtaaaagataaattgctggacctcttatttagctgctaagttaattggagttgtaactctcattagttgacaagaaaggaaatacatttttggatctcttgataaacaaaacatttaatgagtgttaaaagttacaaaatcattctagtgaacaggagagctgtgtgcgtgacagtgctaaaatgataacaataattacatggaaaataaaggcagaagtgagcgattttgaaaaggaattacatttatcttacgctagatttaattcttgtcagatatttatagagcatctacaacaggcttccttaattgtcgttagcattttttttaccttgtactccttttctacgtcctattttctttctgacatgtcaccgctcacccatatcagtgacctcttaatttctgactttaaaaagaaatctcttcctgtagagccttccctgtttcaacccattccctaacttttgtgactcttggcattcttacagcactcataaatggcattctttttgaactattaattgtaagttatttttgtttcctgtgctaggaacacctggctgtttatagtccttatggcacaataactgtataataattatgtactttatgattaacacttatttaattattaaacaaggtgaggctgttgaaaatatataaggaatgtg

SEQ ID NO: 122005 - DNA, 609 bp, Homo sapiens
ggcaacagaacaagaccctgtctccaaaacaacaacaataacaaaatactaaatttgtctgtaaactctacttttctaatattaagtcctcacagtgaactgaagcagaacttcctcttgttataagttaaattcctttgacctcttaggttgactctgcatatgctccatgaacagtaaaatacctgttcagtttcactttctaataggttcaagtcaattacttaaaggttgtttttcccctctcatgatttcaactctaaaataattaactaacataaaaatagctgcttacacaaagtttaagaaaacttacttcaacattttaagaaagtttaagaaaacttacttcaacattttaagaaaatgttttgttcccaaaagtttgccaaaaataattttaactcaatgtggaaatgaaaataatgggaatgctacctatccagatgcaccaaaagttcattgttattagaaataaaaaatacttggccaggtgcagtggcttatcctgtaatcccaatgctttgagaggccaaggtgggtggatcacttgagttcaagctggagttcaagaccaacctaggcaatgtggtaaaatcctgtttctac

SEQ ID NO: 122006 - DNA, 402 bp, Homo sapiens
cagaggcccagctgggtggtttaccaacatgctgtccttgaatctctgtagccagctattttgcaaaggagaaaaaccagctctggggagaaggtacttggtgaagggaacaaaactagggcatccaggtctggctcctaatcacctgggaagaggggtaaaaacagaatcctagggcccaccccagacccacagagtcatggtttcctactggcggcttatccgtgaacacagcagtcatgctaggtagggagtggccttcccagcattcagtgtgccctgtgggagctcagtggtggcaggagtaggttggatgagagaggggttcgtggaggagcatttcaggccgcaggatgtgtggaggggagcaggctgggttccacaggctacaccagccacatc

SEQ ID NO: 122007 - DNA, 436 bp, Homo sapiens
ttctccaacttcattgtgccagtgaatctattgaaaagctgttaatatttccgtgtcctggaacacatttctcatgagttttgttcaaatattctgggataaggtagcaagatcttgtttttaaacaatctcttgaaggcaattccaattttgagaatcactatcttcaaattacctctcttaaatagggttgggaatgaggacatagaatcatgttctccctttggcactctgtttcctttcctcaaactcaaagactcccatttatttaaagttttacctgaacactccttgttcaggacaggctcagtcctgcctcacactagcatttcaagtccagtattcctgctaaatggtccttggacttttagctgttaaatggtatctcattttttaaaacacatttcacatttaaagtcatacatgcttaagctaa

SEQ ID NO: 122008 - DNA, 486 bp, Homo sapiens
caagacaaagatattccctgtcatcatgatcattcagtattattctggaagctactgcccatctaagaaacagaaagcagagaaaaggaggagaaagatagccatgatttgtatgttatatttctgtttacctagaaacttaaaagaatcaacacaaagtaataaataaaaatttgataataaaaatctgtatacaaaataaaactaaaatcaatagctttcccgtgtatgggcaataagtagttataacatgtaatgggaaatgtcccatttacaagagtataaaatattcagtaataaatctatatttggaaaactaaaatactgagcaaaataaaagaaaatttgaataaatactatgttcctagatgagaaaactaaatatttgcaagacacaattctttctatattattgttcagcttaaatacatttttaacaaggtaacaattttagatgatgattttaaaaatatcaggaaggataaa

SEQ ID NO: 122009 - DNA, 201 bp, Homo sapiens
ggcctccgggggaacagccctgcccacaccttgactttggactcctggcctccagaactgtgagaggatgaagaaactgaggtttagagaagccacttgcccagtgtagacagcgagaaggacaggtccaggtctgcttgatgatgaagcctgtgtcttctttgctgtgtgatcctcatcacgttaggggattcctgagga

SEQ ID NO: 122010 - DNA, 677 bp, Homo sapiens
gttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccagg

SEQ ID NO: 122011 - DNA, 220 bp, Homo sapiens
cttcctgactgtgcaggtgacctctccatgtgctaccggctggtctctgaaaataacccctgtctggcccagaatgagggcagggtcacacctgttctctaacctatcaacagaactcctgagtcctgtgtgtgttcagtttcctcctgcccacccaccagcctggggagagcaatattcccaggctcctgaatctcctcttctcatagctccctggtgt

SEQ ID NO: 122012 - DNA, 306 bp, Homo sapiens
ttttgaaagtcactcttcagtggcaatccttggagttgtgatgggcagataggggatgctctgagaccactggggccttcttgggcctctcacacagtttccattgcagccccacctggaaggtttggagctgcaggtgggtcttggctctggagtccaggaaagctatgggttcttcagggatcttttggaaaattatgttttggaagactgcaattttattcctgaggatattaaaacataaataaaggcatattatgaaattcatgcagtgaatgaagattttaaaagttagaaagtaaaggc

SEQ ID NO: 122013 - DNA, 214 bp, Homo sapiens
tgctgcgatacaccaggcaagcgaaggagatctaaagatactatgttgctggctttgaaaatacagtaaggtggggtggggtggggggtgataaggagcagaggaacgtaggcagctttcagaagatggaaaaggcaaaggagattctcccctagagcctctgcagggaatgcaaccttcatcttctttttttgagacagtctcgctctgtctc

SEQ ID NO: 122014 - DNA, 760 bp, Homo sapiens
gttcatgtcatcttcatgatctcaggatagctctatcattccaaacatcgtatccatatctgtggtacaaactggaagaaggaaaaaggaggaagggcaaaaaaccacaggcttctgtcagctgaatttgtaccttcttttatcagaagaacaacagttttcttggaagccccacccagtaatgtttacctacatctccttggccagaactgtgtttaatggctacccgaagctgcagagaggactttggaaaatagagtttttagcccagcacattgcttccaggaaaaccagtgttctgttagcaagtagcactcgatgtatcccaaaaccatcattgaattagtcctttttaaacagaggtccatgttttggtcttcactgaatctagattcagattaacgctgcagatatttactgagtgctttcagtcataaaccaagcacagtaattgcatggaggaatgtgtatggcaaattacaccgtctgccttcaaggtaatcacaatctaaatagaaaagcagagaaatagctacacaaataactccaataaagtttaataagtattatatatatgatcttagaactgattattggactaataagtaaaataatatttgaaatccatcctatgcaatacagataatatgtacatcatatccactcctaaggaaagaaatctaatggtcagagtttcaggggaaacggtgcaggttaggtgaaggtgcagaaaagaaaaaaaaaaaagttggattataac

SEQ ID NO: 122015 - DNA, 717 bp, Homo sapiens
tctttaattagttatttttaaaattaaagtaagttttgatttgaattgttaactaattatcattaattcagtatttacagctttttaatattaaaacttcatgacaaagaccttagttttgacattgaagtaaaacttaattaaggcaggcattagaataatttgccaaatcttccagcccctaaaaagatactattttaatgtaattaaaaaacaaaagcaggtaaccctcctgcattttttgtaaggtgtactttaacttaaaaaaattagttctctagttgcaaagggtgggaggaggagaattctaaccctggttttagaactattttaatttttataataaatgatctgtatcaattttttaaagtattacgttaataaatgtaatactttgctgagcttctatgtgcttatgcctcttctgtattttaaaaaagttatttcattagagtatcagaattgaaaagattgggttaaaatacattactacatatgtaggtcgttactctttctgagagagtgtatccatttatactccctgtcatgctgttgtggaactataagtttcatcccactttatgattttttttctcatatgttgggttggataaataggaaaaacaatacacattcatgcccagttaacagcaaacaaacacaaaacaataaaaaaacacaaactgaaggcccactgccactaaaaaacataaacaa

SEQ ID NO: 122016 - DNA, 578 bp, Homo sapiens
aaccatcaaataaatgacaagagtaagtcctcatttatcaataatagtcctaaatgtaaatggattaaataccccatttaaaatataaagattggctgaatgtagaacaaaaacaacaccttactatatgctgcctacaagaaacttacctgacctgtaaatcctttcacatagaattaaagtgaaggataaaaagtattccatgcaaatggaaacattaagctagtaagaatagctatacttccagccaacaaaacagatttcaagtcaaaagctgtaaaaagaaactatgaagaacattatataataatacaggtattaatttagtaaaagaatgtaacaactctaaatgtatgtacaaccaacaccagaaaacccagacatataagggaaatattattagatttaaagggaaaaatgaactccaatacaataaaagttggaaacatcaacaccatactttcagcattggacacatcatctagacagaaaatcaacaaggaaacattgggtttaaactgaaccatagacaaaatggacctaacacattgacagaacatttcacccaacagctgcag

SEQ ID NO: 122017 - DNA, 863 bp, Homo sapiens
agtcgaaggggcccgaggccccgagaagggcaggatgcgatgctgggtgtgtgacctcagccatggaagggccacctgccaccggggggctgggccgtcgggcctttggttgtggagggaaaagagtggccacttgctggagctgggaacgtgcagtgatgagcactaggacaagaggaccgtgacaaacagacatagaagatctggagactggggaagtccaagatcaaggctccagcagattcagtatctggaaacctggttggggcttcaacaggaacacctgcaaggaccagctgacttcctgcccagacacccttgcattctcagcctctgcctgggaggaggaagaggcacttccacatttcttgtgacaggacagcattgagttcattgcctcaaaattgctgcgctctccttctgccagtgcccagagatgctccccacaccacactgcactgctgggggatgttagaggtgattcaagacagtttttcctacctcttcagtgcctctttcagcaatatgaagttaaaaccaggtactatgagaactcacctgatttttagttcttatgaaggtgctttccttgtgtaaatatttgttaaattgttttccttgccagaggaatgatcagtggagccttctattctgccacctttctctgcctctctccaatcctcttacctttttcacacagccttcgtggttatcacagagacttaagatggaatgttaaatacactcttttatattggaaataaaatgaaaaccagatataaacaaataaacaagccacggagaaaagaaaacaaactttgaataattaatttattgtaactcataagcccagcgttgtataa

SEQ ID NO: 122018 - DNA, 480 bp, Homo sapiens
ctctagcggatctgtgaggtaccaacaacagaatatagaacacgccaccaaacaacagaatatagaacactctacccaacaacagaatatagaacatgccacccaacaacagaatatatatgcttttaatgtctgtatagtatattctcaaagacagacaaatctcaacatacttaaagagactgaaatcaaggtacattctcttgacttcaacagaaattagaaatcaataataaaaagctatctagaaccccctactaaatatttaaaaattagcatacttctaaataattcacagcaagaaattacaaggggaaattgctccctctgtcgcccaggctggagtgcagtagcgcgacctcggatcactgcaacctcgcctccagggttcaagtcattctccggcctcagcctcccgagtatctgggattacaagcacaagccaccacacctgactaatttttgtatttttagtacaga

SEQ ID NO: 122019 - DNA, 499 bp, Homo sapiens
tagaacatgccacccaacaacagaatatagaacatgccacccaacaacagaatatagaacacgccaccaaacaacagaatatagaacactctacccaacaacagaatatagaacatgccacccaacaacagaatatatatgcttttaatgtctgtatagtatattctcaaagacagacaaatctcaacatacttaaagagactgaaatcaaggtacattctcttgacttcaacagaaattagaaatcaataataaaaagctatctagaaccccctactaaatatttaaaaattagcatacttctaaataattcacagcaagaaattacaaggggaaattgctccctctgtcgcccaggctggagtgcagtagcgcgacctcggatcactgcaacctcgcctccagggttcaagtcattctccggcctcagcctcccgagtatctgggattacaagcacaagccaccacacctgactaatttttgtatttttagtacaga

SEQ ID NO: 122020 - DNA, 396 bp, Homo sapiens
tggagcaagctgggattttgggggtttctgttaagaattagcttcattgaggtataattgagacaataaaattatctcccattttaagttctagttgatgagttttgagaaatgtatatagtgaagtcttgatcatcaaatcaacatatgaacatttttcatctcccaaaaatgtaggagctgtttttttatcttaggagaattttaatgaaatatacgtggaggagctaaatgtttcaagtttgcctcatattcatatctaatttattggtaactaatttaaaccactttcttacggctctcagtttctgttcctacaggatattaactcccacagatggcaacagatggcaggagtgagaccaaacagtttgcagtgttctccattcacaccct

SEQ ID NO: 122021 - DNA, 206 bp, Homo sapiens
ccaggaggaagcccctagttccacatgtgcagactgggaggcaggaacaaggaggaactgggccaaggtgtcagaggaaagccattctttcgtaggctctccagccagcccagcctactcatttctgaattccggaaacccctgccatttaggatataataaatcactaggaaaagttaggtgagttatttgcatcactgattgtg

SEQ ID NO: 122022 - DNA, 207 bp, Homo sapiens
tgggtaacagagtaagaccctgtctctaaaactgaaaagtaaatagaaacatgtagcggtgaattctgtgtccagctcaaaatcagcaatttcccttatctcacttttttacttatttcctctttatttacacacatagctcccttagctcataaacacttctgagggcagggaccatgccttttattcttattcccttttcagctt

SEQ ID NO: 122023 - DNA, 858 bp, Homo sapiens
agctctccctttcacagctgctccttgcgctgctgggggaggttgctgaggtatggggaagaggtacgctgtcgctaagcaacaagaggctgtgcacctggaggtcctaggaggagaccctggcaccatcggtatgggggaggcagggagacagtaaagggttgatcaagctcaaggctccctctcccatcctccccaagacagttacagaggagggatgtacccatcgctcaagaagcctgttgaattggctcacaatcctccagaaggctgcgattgtgcatgcaaacctgtgtgacattccatagactgagagttggagagggcaggggctagggcatgaaagacaagggtgagcatctttcacatcaatcttggaggaaggtcgaggacttgcctgtctgctaaaaggtaggaacttccatggaagtgtaaaggtctgagggcggaaacttagtagggaggcgacagaatgggaagggaagccggttggaccctggggcagcctcccagtcacagaggctaccaaggagcctacacagaagggaggtggcagggcagcaggggccccacacccatcagccatctgctggaattctcagtgtcctcaaagctgaagtgctgcactgtatgccgttatttttcttctcttttattattgttttttggtggactggagtttgaatgaggtaacgatcaagagggaaagactcgtcgattgaccctgtcacccgcctcactgcatctctaacaggcctgtagccctgtaaacgtgaggagcagctcagggttgacagagggccattgcctccctttttctgtcacttcctccattgcctcaacccctgtccagaagag

SEQ ID NO: 122024 - DNA, 324 bp, Homo sapiens
tgtcaggtatgaggttgggcagtgaatacacactggggaccaagacagaaagagtccctcccacaaacagcctgcagtttagtagaggacagaaacaaacaccagaaaaagtaaacatataaaatcattaaaccttgtgaaaggggtctggaggggcacaaataaaagtggggaagggtcagaagggacctgcatttcatgaagtggtcagggcaggcctctctgaggaagtggtgtttgagctgaggccatatgaagaggaaggacagtcagagagacaaaacactccaagcaggacagtgagtgcataggccctgagtctga

SEQ ID NO: 122025 - DNA, 383 bp, Homo sapiens
cattatactttgatgggagtataatggatccgccctcagaactgtaggctcagaagcttgaacctagaggtgatctgatgaatttgatggagcttagtccctgctcatgtaattaaaaaaaaataaaaagcagctgtatgcttctaaatgtttgcactcagaaagataactgctagaagggtaggatgcacttagaaaatctgcctggggagtaaattacaataaaaaagttagtgagctgagatagctagaggagaaggatgccttcagagtagcattatactttgatgggagtataatggatccgccctcagaactgtaggctcagaagcttgaacctagaggtgatctgatgaattggatggagcttagtccctgctcat

SEQ ID NO: 122026 - DNA, 226 bp, Homo sapiens
acagggtgtcattctgtcacccaggctggaatgcagtggcgccaccacagctcactgcagcctctacctgctggactcaggcaatcctcctgtcttagcctcctgagtagctgggatcacaagtgcacactgccaccaggcctatttttttatttttatgtagagacacactcttgttttgttgcccaagctagtcttgaactcttaggctcaagcaatcctctca

SEQ ID NO: 122027 - DNA, 391 bp, Homo sapiens
tcactgcctcaggctgaaatctgagctcctgggtacattgaaagctgccagcctttccccagactgccgggttccgggctgctgcacgggtccctccactgtctcaaaggccgtccctccactccagggatccctgctcaggctcctgcagatcctcagccacaacagtgcaggcgattttacacggcactgtctacgagtagccctgccactaaaccggactcctcctacgggaaaagcactgcgtggtttcatctctgtatccccaatgactggcacattgactggcacacagaaaggagctcaatgattcttattttgttttgttttgttttgtttttgagatgtaggttggctcttgtcgcccaggctggagtgcaatggcatgatc

SEQ ID NO: 122028 - DNA, 256 bp, Homo sapiens
cagcttcttggggctctcagactcacaccccatgtcccactcagagcaaaccaagccctcccccaccagtccaccagggagaacattcagccacatgcagacagtgactctggtggtctcgaggtgaacctcctgcctccctgttccctctggtcatgcctttggccactgtgcccaggcagtgtgaggtgactcctccgacaccacccactgacttttctgtggccccttcagagactccaagagcttccacggg

SEQ ID NO: 122029 - DNA, 268 bp, Homo sapiens
ctgacctgtgtgtgctttgcggggaaaaattgatgaaagccccggaagccccgttaaaaagacaagctgtatttctgtttttttaacaaaatgaggaagctgaaagccagccagtgttttacataatggtgtctctcccctcagctgatcagtgtgacatccagagttgctgttgctgctacctgtctagtctctaagacccttttcaacccttgtgacttaagactctgtgaacttttacaaagtatcttgtgatctggacagatga

SEQ ID NO: 122030 - DNA, 366 bp, Homo sapiens
taaaaatagaaacatataatagcagcactttataaagggaactgatttcaagtaagcaaggcctgggttaaaaaggaaaggagattggctcaaggcacaataattctacctgtgttaatagcatcatctacaaaatacctaagggaattcattctacccagcatccttttgcttcctctgccagggtggatgactaggctctgactaatagaaccaacacaactggtgagtatcaaaatgtacaactgtttcaccagactaagttggtcactatgttttcctcctaaataattagctttaaagacaatctaaaatactgcagagccccagcaacatttcagataacttgtaccttatatttcagat

SEQ ID NO: 122031 - DNA, 539 bp, Homo sapiens
ttattcaaaatacaacctcacacatcaatcttttcaggaaatctgtgagaccaacctccccaagcctgtttctgcatgctctcaaaagccctgtgcacgcgtctatcacagccctttcactaactctactaaatgccaggctgtcatccacactcataggccaggaaatacttgaggaaggaatgtctgtcttttacctctggatctctaaaacttatcaagttgcccagcaaagcgagtgctaaaagatctaatgatgagctgaataaacgaataaaaaatgtgcaactattatctaccaaacccatttaggaggctatctaaaagagttgaagcagccaggcacagtgagtagctcacgcctgtaatcccaggactttcagagcctgagatagggggattgccttacacccagaagttcaagaccaaccagcctgaggaacacagagagactctgtctttaaaaaaaataaaacaaacaactacttgggcatggtgccacatgactgtagttccagctactcaggaggctgaggcag

SEQ ID NO: 122032 - DNA, 257 bp, Homo sapiens
ctggaagtcggggctacatgtgggtgccacagcaggagtgcccagggccctagccctgcacaatggtcaaccctgcccccttctccatgccccgccaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatg

SEQ ID NO: 122033 - DNA, 528 bp, Homo sapiens
cttgaggaaatcctgtcagctctaccttcaaagcacaccaagaatatccaatctcacttctgttcaacactgtattagaagtcctagccagaggccgggtgcggtggctcatgcctgtaatcctagcactttgggaggctgaggcgggtggatctcaaggtcaggagtttgagaccagcctgatcaacatggtgaaacctcgtctctattaaaaatacaaaaattagccgggcgtggtggcggacacctgtaatcccagctacttgggaagctgaggtgggagaatggcgtgaacccaggaggcagagcttgcagttagccaagatcgcgccactgcactccagcctgggcgacagagcaagactccatctcaaaaaaaaaaaaaaaaaaatacaaaaatacaaatacaggtgtgagccaggcccagtggctcacacctgtaaccccagcactttgggaggccgaggcagatagatcacgaggtcaagagattgagaccatcctggccaacatggtgaaaccccatct

SEQ ID NO: 122034 - DNA, 165 bp, Homo sapiens
ataagagggcgcggggtggggaaggcagagttagaaacagaggagagaggccagaggagaaggaaacaccacgaggaagggaggaggagaatcagagaggaggcacagagttggggagaaaaagccccggagacagggaccaaagcaggggggtcagagagagag

SEQ ID NO: 122035 - DNA, 419 bp, Homo sapiens
cacatccacaaccacttccatgctggttattaccacataccccagtttttaaaaacttacacacactccaccaccatgacaaccaaccttgaatgtttaaccagtctgcccagtttgtggtcagacttcccctgaaggggctcttaaaccacctcctttctccactcatcaggcatgaggccatttcccagaacaggactggcaagttgacttcacccatataccccctgtaaaaaaaggaaagggccaactacagcctgggaaaaatatttgtgaaacctctatctaataaatgatgagtattcagaatacgtaaaacatccctacaaatagcataaacaacacaatttaaaaataggcaaaagttcaagaccagcctgggcaacatggcaaaacactgtttctacaaaaattagcta

SEQ ID NO: 122036 - DNA, 403 bp, Homo sapiens
tgtcacctaggctgtatgtagtgcagtggtgcggtcatagctcatcgtagcctcaacctcctgggctcaaaagcgatcctcccacctcagcctccagagtagctaggcctacaggctcataccaggaccagctgcttacattaaaacaaatttttgtagaaactgggtgtctccgggcacagtggctcacacctgtaatcccagcactttgggaggccgaggggatcagagaaacactgagtgagccaacacagctagcatcctgaactcaccaacccatggtagccagggccacagcatgactgagaagtcatggccactggggaaggtgaatcctcagtcactgcaacaaggactttgcatgccaccaagacactttcaattcccaagtcaaggaccactg

SEQ ID NO: 122037 - DNA, 595 bp, Homo sapiens
atcctgaatcattaaaaccacactgtctagcaaactacaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaat

SEQ ID NO: 122038 - DNA, 351 bp, Homo sapiens
agcttgtgattagtatcatgacaaagacacaaagatggtaaaataaaaatgcaaggatggggctgggtgcagtggctcacgcctgtaatcccagcacttcaggaggccaaggcaggtggatgacaaggtcaagagatagagaccatcctggtcaacacggtgaaaccccgtttgtactaaaaatacaaaaattagctgggtgtggtggcgcatgcctgcattcccagctactcaggaggctgaagcagaagaattgtttgaacctgggaggcagaggttgcagtgagctgagatcatgacactgcattcagcctggggacagagcgagattctgtctcaaaaaaaaaaaaa

SEQ ID NO: 122039 - DNA, 446 bp, Homo sapiens
gattccataaaagttaactccagagcagagaatgatgccacagtcgggataacatccaatatttgcaatcagaagaaatatgagagtcttgctccatcacccaggctgcagtgcagtggcacgatcttggctcactgcaagctccacctcccgggttcacgccattctcctgcctcagcctcccaagtagctgggactacaggcgcccaccaccacgcccagctaaatttttttgtatttttagtagagatggggtttcactgtgttagccaggatggtctcgatttcctgacctcgtgatctgcctgcctcggcctcccaaagtgctgggattacaggcgtgagccactgtgcccggccgtaattattcttttcgtgttaagcaatggtaaaagaactgactgaaaataagaatattaaaaagtttctctgctaaaaacagaaaa

SEQ ID NO: 122040 - DNA, 347 bp, Homo sapiens
tgaaattccactgaacaactgctgttatccaacttctctctgattctctcccacctactactcccactgttctgctggctttgtctcctctcccagcagccacccccacaacagaggtttgggataaattagggatatcaaagaatggtgccctcatcagactcagtccttcttggtttcgcttcctcaccatggccctgcccttggtccctcatccaactgagagccactgggacctgggggcctaactgtgctgcgctctccattgtgggaaaacatggggcctcctactatttctgcatccctggacttcactcctggcaggctcaagagtgactcattcttcc

SEQ ID NO: 122041 - DNA, 388 bp, Homo sapiens
cctaaaagctttaagatcatggaatagttgataaaacagtcagtattctgtgctgatgacttatccttttctcccttaagaaagagtaaatgtttttgcttggattgagtttagagacaccagatagaataagattggcaacactgttagccacctgctgaccacagctaaacaggcatatgtgcttctgcatggggaatgctatggcgttaacagtgccttccttaaaacctgtaagttcgttaggcttccgggtaccagggttgttagagtaggccacagtttacttcctttttcataagtgcttttctttcctggatctcagtataggaaggaaaatcagacagcatttctcagttgttggctcggtgggcattgtgaatgggta

SEQ ID NO: 122042 - DNA, 619 bp, Homo sapiens
aaaagattacttttggacatgttaaacttgaaatggcaaacaggtattttgactggtgctataaacctgtaagtcattggcatgtagatgatagtcaacatatgcctatgaaactggacaaaagtttcatggtaattaggtatcaataagcaggaaggtagcaaaaaactaactttacctatctcacaattttgccttgtcccaggattgcccatagcccaattcttttgattcaagcaccaaaaccaactcttagagttttttgtttgtttgtttggtttggtttttttgagacaggttcttgctctcttgcccaggctggagtgcagtggcatgaccatggcctactgtagccttgacctcccaggctcaagtgaaactcccaactcagacttccaagtagcttggactacaggtgcgcatcactacacctggctaattttttacttttatttttgtagacatgagtctcactgtgttaccagggctggtgttgaactcctgggcttaaccaatcctcctgccttggcctcacaaagtgctaagattacagccatgagatgctgcacccggcctcttctcaagagttttttggctaagcaattaatatatgtgaaga

SEQ ID NO: 122043 - DNA, 698 bp, Homo sapiens
taatggaggaagtaccttattctccaatatagataagttttctgcacaaacgcaggttttattcttctgtgggcagacaacacaaacaaagaaacaaatgatttccaaatataagtggcatttggaaaacaaaatagggtaatgtgaaggagaatcatggtggttatggaggtcatttagtggtgacatttgagctgaatcttgaatgacagaaaaatgacaaaaccatttaagacctggggtaagaaagagttttcaaatgcaacaatggtccttaggcagagcatgtttgctgcatttatgacagaagctggtgttccctgaatatagtgagaaggagagtggtaggaaataatgtcaaaaaggtagttatggacttgaaaatacaaagccttgtaaatcatggttagattcagattttattctacatgtattgggaagtatttgactacctaatttatattttagaaggatcactcttcgtgctctggggaatggctcatagggttggcatggggagagactagggcacaaagacagttagaatttgcaggggacccagtgagacctgatggaggtatagactaggtggtagaagtgggaatgaagaaacatggatgaattaacttatattttggaggtaaaaaatagatcttaatgatgatttgtatatggcagatggggaaaaaaagagagtc

SEQ ID NO: 122044 - DNA, 363 bp, Homo sapiens
agacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccggg

SEQ ID NO: 122045 - DNA, 231 bp, Homo sapiens
aaaaacaaaaaaaacagaacaacaacaacaacaaaaacaaaccactttccaatacttgcaccttagttccagcccttttccttgttagccatacctatgatgggacatcatctaagatgtaattgagggccagacaccttactggatttcatccccagacagaggtaattcctttcttctctgagcttgtgcaaccctttatctaggcctttcttaccacttactgcttag

SEQ ID NO: 122046 - DNA, 376 bp, Homo sapiens
caccatgctgtgctgttgacagagcaacagagattttaaaccaaccccagctaagccccagctaatagctgaaataaacagggctccagatggctgtggcttagagatggaacaggacagatcacagccttcactctgcaggctcaggagcctgaagacaaggttgcctccagttgccgtcagtgcagccctcactaaagaaaagcaaaaagagccgagggactgtaggaaggctgtttccaagccagagatccagacaaactgctcttgaagagagaaagcccttccagattcccccatgtcccaaaagaccagccgggattctggacctctgctaaaacatggacaagaagccaggaacgagacctgaaacaga

SEQ ID NO: 122047 - DNA, 154 bp, Homo sapiens
tgctggcattacaggcgtgaaccactacacccagccatctattaattctttagcaattacaaagtagtagcatttaaatctctgattctttcttcatttattagccagaaatttctgtaaagagaaacttccttttatgtactatttggttgcc

SEQ ID NO: 122048 - DNA, 468 bp, Homo sapiens
aaaagttgcccacaaaacatgacgcataatgatcacttagctcccagcatgctttgggagatgcagcattgcaaaaaacaaacaaaaacaaacaaacaaaaaaataaaaccccaacaaaatggggggaaaacagaagctcaatcaagaaaaaagttttttgcatattaaataaaattgaaaatatcttttttcaaaatatgaaaacacagcttcagataacaccacaaggccacctccggaaaagatcacccatacacaaagatacagtatacataatacagcagaacatgcactcccaaatgattctatcagacaatacagaagaagtaacggcatatcactcttggaatgcttttgtgcaaaattctgaaaggccatgacccaaatcacagactaaaagtacagagccatctatctaggttcgtgggtgtgcatccacaccagggtgtttaccttcccctaaagcc

SEQ ID NO: 122049 - DNA, 723 bp, Homo sapiens
gtccccctcctcatcttgtgcatagctcagctggttcctggactgtgggcctgacagcggctttacttcattgccaatagtgtcttcctccttgagaggttcatgtgttgcacagaacagtagccacacttattgagtattgtacttattctttgtttttgagatgagatcttgctatgttgcccaggctgctgtcgaactcctgggctcaagtgatcctcccaccttggcctctcaaattgctgggattacaggcctgagccatcatgcttggccccctacttattctgtgtcagggcctgccaaacattttatgttttcttatttaatctttcaacaatgctgcaagttgaagatgatgaagaaattgaagcttaatgaaattaaatagcctccccaaggaccacttttaatggtggaactgggatttgaagccagatctgcctcttctaaagcctgtgctctgaaatagaatggtaactggagtggggcagacctgggttcatatcctgggttcaaattctctcagcctctgttttctcattttaaaatgggagaaacacttatgtcatggaaagatgagacctattaagggccgggtgcagtggcttatggctgtaatcccagcactttgggaggctgaggcaggtggatcacttgaggtcaggagttcaagaccagccttgccaacatggtaaacacctgtctctactaaaaataaaa

SEQ ID NO: 122050 - DNA, 287 bp, Homo sapiens
ttgtcactaaattcctccagtgcttacaaataaaatagtatctatgactaagatacctaactgtacctgacacaaagtagatttgaaacaaactcccagcctatttttttcttctcctttccccaatgtcagtatcatgtgtccaacacagtttttaatcatttgatcagtttttcttcaacttgttacaatcaattcttatctatctttgtacctctttattcccaatggcacctaaaaaagagacataattgctcaggaaataccaactgactaacctaataaag

SEQ ID NO: 122051 - DNA, 374 bp, Homo sapiens
tgggaggcctcaggaaacttacaatcatggcggaacgggaagcaaacacatccttcttcacatggcagcagcaaggagaggtgctgagcaaaagggggaaaagtcctggataaaaccatcagatctcatgagaactcactcactatcatgagaatagcagcatgggctaaccgcccccatgattcaattacctcccactgggtaacatgtggggattatgggaactgcaattcaagatcagatttgggggggacacagccaaactataacacactctgtctgaattattaataaaatattttctaatctaaagtaatgttccaatgatattttagcatttgccaaatagagttccataaaagaaaagtctttag

SEQ ID NO: 122052 - DNA, 283 bp, Homo sapiens
agctcctccccaatggaacacactgtgttccttagtgactcgttttctttctcttccctcctagaatgtgagcatccctaggacatcactagggatttgagtccgtgttgctcactgctgtatccccaggtgcctggcatgcagcagactctcaaatagtagctgttgaattcatgaatgaattgagttgggggcgggggctaccctcccttactcaggttcctactccagagtcatctccacagagagctggtccctgacccactctcttccagcccccagc

SEQ ID NO: 122053 - DNA, 424 bp, Homo sapiens
ccattaccataatgaagatatagaacattttccatcacccaaagtgttcccttgtgccattttcctactcttgatctctggtcccaggcaaccacttctctgctttcatccctttagttttgtctgttctggaatatcatgtaatggggtttaaacagcatatattcttttgtttttgatagctttcatttggcatgcttttactgagattcatccatgttgtgttatgtacccagtagtcattcaggagcaggttgttcagtttccatgtagttgagcagttttgattgagtttcttaatcctgagttctagtttgattgcactgtggtctgagagagagtttgttataatttctgttcttttacatttgctgaggattgctttacttccaagtatgtggtcagttttggaagaagtggggtg

SEQ ID NO: 122054 - DNA, 404 bp, Homo sapiens
ttttgttttgagatggagtcttgctctgttgccaggctggagtgcagtggatctcagctcactgcaacttctgccttctgggttcaagtgattctcatgcctcagcctcccaagtagctgggattacaggcatgcgccaccacaccccactaattttttttgtatttttagtagagatggggtttcaccatgttggccaggatggtctcggtctcctgacctcgtgatccacccatctcggcctcccaaagtgctgggattacaggttgtgagccaccgtgcctggcctcaatcttttcttaataagttgaatgagacaagttgctgctaagttaaaaaaaaaaatgaataaaagatgtaattaatagtcattaaataaattttggaaaaggatttttggatat

SEQ ID NO: 122055 - DNA, 259 bp, Homo sapiens
ctttttagtaaaattttggcatttatgtttttccacaaagctttatattatgtccacatttccatatgttttaggatagaattgcacgagtggctcttatgataaaatgtcctcagtaactggtattgttttccgtttctttctctgattactgtaagtcctctccctcttcttacattttctaggccaaaatatgtcttttggttgatatttttaaagaggaaacaaactaatttttgtttgtcatttaaatattttg

SEQ ID NO: 122056 - DNA, 372 bp, Homo sapiens
  misc_feature (182)..(182): n is a, c, g, or t
aactcttgcaatacaggagaaattctctgcaaacagagggattaagaccccacctctgcgacccccgtgacctaacagaagtaaagccacttgatcatatttatctcagagtccatttcctttcttgtgtctgatgcattggttcttgaatgtggaaaacctctttcccttggggtagagancctaccaccatgtgggacttaaggaccaggacagctgaataacacgtgtggcattctagacacatggccttcctttcagtctctaaattacgtatattggtttaaagaagcctttgtttcttaaaataagggctcaacgagacacaaaaaaaacagctggaaacaaaggggaaggggcagaggtttcaga

SEQ ID NO: 122057 - DNA, 476 bp, Homo sapiens
gagttgctcctaaagccatgtttttataaccaacatataacttaatatcttaaaggtattcttataaatactttcctgagaatgacttattattataagacaaatctaaactttcatccatctataatgttaatattatttgtaactataatttttgagttgtagggcaaatgttaggttgattggttaagtacatgaaccctgtccagattctctgtggtgtaggggcaagaaattactttgaatgaatttgttagtataatagatgtaaagaatttgttacaagttgtttgaattcagagataaacataaggcaaggagatatgtcagataagagagggtatgctggaacttcgctttctctagcaagggcttggtgttagcacagtactgtctcaccaaaacagtttccaacttaaactgaaaggccattatcctccacactaaattataaacttaattcatgactagatatt

SEQ ID NO: 122058 - DNA, 575 bp, Homo sapiens
tcatccctccatatgaggaggggagtgggaattggttgtgggacttccgtggatatccaaatcagtggatgctaaagtcccttacataaaatggcatagtatttggttatcatcctccccatacatcatctctagattatttatagtacttaatacaatgtaatgctgtgtagtcatactgtattttttacttgtatttttgttgttttgtgggatttaaaaaatatttttattctgaggatagttgaatccacaggatactgagggccagctgtattcacaacccaaatcacatacaaagcgacaagttcatacacaataggcctattagaacaggactgttctctcttgtttatcattgcagcctttctagcacaaagcctgggacattctggacatttagtatgtgttaaatttctcttactacattatttccaacagtatttactgcaatctgcaattaccttccttttgttttgtaactgtgtcccccactagaatgtaagctctgtgcagatagtgtctcatttattgatgtatccctggcatctaataaaacactgacaacacaagca

SEQ ID NO: 122059 - DNA, 874 bp, Homo sapiens
cccggcctcccaaagtgctgggatttcaggcctgagccaccacgcccagctgcaaatattttttgattactgtcttccattataaaaataattattcagtctacctttatgggtaacagtccaagtttacatggctgaatcagtcagctattgcccagtaaaaatcacaacagagcaggttgtcccaagcagagtaaaaaagcattcatatggaagagcagttgactgcagtgtgtcagaaccagacagtggtgaggagagcatcttagaggcagcccagaatgtcagtctaccaagcagaggaggtcactggcatagagtcctcaagtcaagcagtgtgagagggcattccagtgaaggggtgccctggggtgatgatgtgtcagagagcctagcaggaagaggagggaatccatattggaattcaacaaggagagtcaaagcccaagcagtgtgaggaaggcttacatgtggggtaggaggcagcagtggaaaaaggacattggtcacatataggaaaactgattaaataaatgtgttaattataactggagccaggccttgcactgtagaagttagttacaaatatggaaaggagaaaattagaacaatccttatatagatattttttgagacaaggtctggttctattgcccaggctggaatgcagtggtgcaatcacagcttattgcagcctcaacctccccagggtacaggtgatcctcctacttcagcctcccgagtatctgagaccacaggtgagtgccaccacgtctggcaactttttgtgttttttgtagagatagagtttcaccatgttgcccagactggttttgaactgctaggctccagtgatctgcccgccttggcctcc

SEQ ID NO: 122060 - DNA, 858 bp, Homo sapiens
actcctagcctaagcaaactgcctcaagccatctgctcacctttacctcccaatgtgctgggattacaggcatgagccactgctctcagcctaagaaaaaatatttttaaagttgacaaatgtagaaatgagctaagatttgtcaaagggatcaataagtaatgaaatattctggttatcaaagtttatcatatatgaatgaacagtgaaaaaattggaaataacagaattaacaaattttaatttgtctttaatggttcagcagtcacttaaaaatttttacagtattaccatgatgctatagtctttatcatcacaaatcccaacgtaaagataaaaaaaaaccccacttaataaaatcattattcaagctttctggctcttcgacttgggctaaataagtgttctgtataatggtatgtccttaaagagaaattatctccacctactgaaaaaaaaaacaaaacagcgagggcctatcaatttgagagtttaaacaggcctgtggttcgcatttttatggaagcatcataatacaaccccaagacatcaaatgtcactagcacagaagacatctaggatccaaagttcttagaagaatattacttttaaaaacattagaaataatactttacgtgggactcaaccttgactcttctttcttcctctatatccaatcaattaccttgtcttgccaattttacctcctcgatatttgttgagttagtccccttctatccatacttaccattactactactacctggtaggctacctggatcatgcgatagatgcggttggagtgggtctggggatcctcaagggaaaagccagaagatagcagggcggtttcaaaca

SEQ ID NO: 122061 - DNA, 630 bp, Homo sapiens
gggatggtgggaatgggaagggactcaggctcagagggacccatgtccagtgtggctgtggtgcataggctgagggtgagatggaggcaaggggagctgcctcgagaagagactcatcatgggcatggcggggacaagggagggggtggtcatgaggcacaaagggtaggaaggttgtagccccagagaagtttatagtggggtcagtatcccagaggggagcaacgaacggtgtgggcttgggttcaaagtggaagagtagcatgacaaggccccaggacagcaattggatggaacagctagtgtccactggcgaggctgagcaggtgacaaagagtcagttgatcttttcagcaaatagttctgggggcagggggtgttaaaataaaattggacccttaatttgcactatatacaaaaattaactcaaaatgaatcaaagacctaaactctacactcaagaactaaaacctaaaaatttcttagaagcaaacattggggataatgttcatgacataggatttgacagtgctttcatggatatgacaccaaagcacagatagaatagaaagaactgacaaagtagactgatgaaaattcaaaacatctatgcatcaaagggcacaatca

SEQ ID NO: 122062 - DNA, 520 bp, Homo sapiens
acaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaat

SEQ ID NO: 122063 - DNA, 295 bp, Homo sapiens
gtccctatagcctacgtgtagtgtacagagtacctgaaagttcccaagtgtcctatttggatgacatgaaggggttgaggcctgaccagatagccaaaatctggggtcaggattaagaagcctcagcatgtagtgttgttttgttttgttttgcttttacatcagaaagacatgtctgagaatccggtatttgtgtcaggaagagacaaaaaactagatgatcaggcaagagaagagggagaaggcagaggacatgtgaatctgaggcctcctccctgtgccataagatcatata

SEQ ID NO: 122064 - DNA, 122 bp, Homo sapiens
tggccaacatggtgaaaccctgtctctatgaaaaatacaaaaattagtggggtgtggtggtgttgtgcctgtgggcccagatacttgaggggctgagatgggagacgcttgagcccaggaga

SEQ ID NO: 122065 - DNA, 472 bp, Homo sapiens
tgggtttttactgtaccataaaaatgaacaagctgaggatttgacatcgagagaaaggttggtgcctccatggaaaatattttgccttcaggagtttaggatgagacaaaattaccactgggtaagggtaaactaactattgtgatggaactcagatattgaaattccacttgtgagtggcacaaaaattacagcgcagggaagatgactccatttctaagtataagttgattactgatgcaaacttggtttcaggatcctttcacaatattaccactaacataaccgttcctttaaaaatgtgaagaccggctgggcatggtggctcgtgcctgtaatctcagcactttgggaggccgaagtgggcagatcacctgaggtcaggaattgtagaccagcctggccaacatggtaaaactccgtctctaataaaaatacaaaaattagccaggcatagtggcggatgcctgta

SEQ ID NO: 122066 - DNA, 307 bp, Homo sapiens
ttctttagttctagtatcaaataaaccccctatttctgctttaaaaaaaaaaacagtgtgctagacctaaaaccagattcacaacatattttattatttggtatacagaagacacgcagattacacacttttcctaccatctttaacctcctaaactaataattcattcaaataagtactggaaaccctagtaaatgttttgtatttgtgggttagtaaatgttttttgacttgctaattcatgttaataactaagtggaaaaaccaagggcatagcacttcacaaataaaggtgaacaaacaacag

SEQ ID NO: 122067 - DNA, 1083 bp, Homo sapiens
attcgcggcggcgtctacgagagcagctggtgcctgtaattctagttcccttatgacttcattatttctcatcatttaattaacatttttcctaatcctcttcaaaaacaccttgcacaccaggattgctttttttgtttgtttgttttttatttttttaaccacagcagtacatttctaaaggatgcttagtgtatgattccctgggttggctacacaattgcaagtccctttgttaaaaattaaaaatttttaagatggcagtaacagagctttaaaccccaagtgccagacctgcataacacaggtttcctgcccatgaagctgaccctgatagttccagatattttgcctgaaattttcttttttaaagattaacatgtcaaactttatgcttaaatgttttgatatgccacagagaatagtaatttttttgtaaaataagatcattttctatctttctctgttgatgaggttatgctgggtaatatcactgaagctcttcctgagatttcttgaggaagaatattagaattatataactcagaaataagcagtgtatattctacttggagttgtaatgtctagaatgcaggaaccaagttactcaatggagttcaaaaatgatacttagatattcactgtccactatataattggatttggtcttggtcatttaatttgtagtgggatgtttggagatgaataattttaaaaagagtgtgtctattaagatgtgactattttcccaaaatctttgaaaggagacagcttggatcagctatagccctttttatattaatataaatcacttaggtggtgacgcagatgggttttaccagatatgctgaatttcacctaagtgaaatgatggtaatcttcttacacataagtcagaaataatataatctgatgtttgtatatacatacttttatatgtaaattgattagctttttgtcacatctgatttttctgtttgaataatatccagtatttatttgaataattttgataaaagtggaaaagttacttttaaagtaaatagtatttgaagatttgcatagggaaaagactagcctact

SEQ ID NO: 122068 - DNA, 320 bp, Homo sapiens
attcgcggcggcgtctacgagagcagctggtgcctgtaattctagttcccttatgacttcattatttctcatcatttaattaacatttttcctaatcctcttcaaaaacaccttgcacaccaggattgctttttttgtttgtttgttttttatttttttaaccacagcagtacatttctaaaggatgcttagtgtatgattccctgggttggctacacaattgcaagtccctttgttaaaaattaaaaatttttaagatggcagtaacagagctttaaaccccaagtgccagaccaagggtcgacgcggccgcgaattta

SEQ ID NO: 122069 - DNA, 418 bp, Homo sapiens
gcccgctctgcggtcctgccaccagtgccctctgaggtccatggtcccacggcaccacggccgcccagtgcactcgcctccacactgagttttcatttttcccagttaagccccatcttccggaaatgcagctccagagggtctctgtcccctcttgctggtggggcaagggtctgcgcatcagaccacatggacccctgcaccaccatctgctccgtcctctccctctggtcagctcagcttattaaacaagccttggtcaggaaaatctaaaccacttaaggaactgggcagaaagaaactgaatgcagggagaagaaggctggggagccaaggacaggagaggagacataggggagtcacagggacctgccacccagatccccactgcctgatgtcctggctgtggagggcacct

SEQ ID NO: 122070 - DNA, 606 bp, Homo sapiens
aatcttggttcacatcattctcctgcctcagcctcccaggtagctgggactacaggcgcctgccaccaccccagctaattttttgtatttttagtagacagggggtttcaccgtgttagccaggacgttcttgatctgatcctgtgatccgcccgccttggcctcccaaagtgctgggattacaggcctgagccaccatgcctggccgaacatgagccatttcaacccagtaagagcttctccaaggagagttcataattgttccaatgttaggtagtcttttctgcagtccaacctcagtgacttccattcttgctaaagctgcatttttcattttttctttttttgagagggagtcttgctctgtcgcccaggctggatagtggcactatcttggctcacttcaacctccacctccggggttcaagcagttctcctgcctcagcctcccaagtagctgggattacaggcattcaccaccatgcccggctaatttttgtatttttagcagagatggggtttcaccatgttgtccaggctggtctcgaactcctgacctcaggtgatctgccgccttggcctcccatagtgttgggattataggtg

SEQ ID NO: 122071 - DNA, 959 bp, Homo sapiens
cagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgg

SEQ ID NO: 122072 - DNA, 334 bp, Homo sapiens
agctgggacctgaaaatatcaatccccagccacaccaaataatcacagaaatatttaagtaagtaagctttgttctaacatgaacttcaaaaagaaagacaagtcagggcaataaaaacaagcagaaaacatccatttcatttaaaaagaatgaaagagagaaagggaaggagaaaaagaggaataataaagaactatgcccatgtttaacatggccacagttatgtgtaacaattcccataaagaagtgcagttcgtctcaaaaaaaaaaaagagtgtagttcatttccccaccccttgaatatgagctggccttgtgacttgcttcaaccat

SEQ ID NO: 122073 - DNA, 434 bp, Homo sapiens
tatgggcagggaggtggcagggcctgggcactccgcatggtgacggcagcatgtgcagcagctcggacgctggactcaaactagcgctagcaaagggaaattgaacctgaggagcctggggtgtctcgggaccaagaggtaggaaccacattgggctttggggctgccgagccccaggcacgtgctcccaccctgagctgggcccctctctccacacctgctccgtttctctttctctcactccggcctggctcccgtatgtcctctggagtcgagcgtgcaagcgttgggacttgcaagtgctcagtattccctaatctcgtgacctgagatgacctgagccttagacctcaccccaaattcctggagaaggaggtagactggcacagccgggccaggcactcgccaggaacaatcaaccatggcggaggggg

SEQ ID NO: 122074 - DNA, 841 bp, Homo sapiens
tggaggtcgcacgcgctggccaaacgggcgcaccagacacttttcagggccctgccaaagacctcccaatgtctactggcgtcccagacacaagagatccaggccaagactcacacttcacaagatacacagacacgggccttagggaacaggaaattccatgaaacttccatttacccaattagccggactcactgagccccagaatagggttttcaaccaactcctactaaaattaaaaagtaatgtgtggtatagattggaataatagacattggaggctacaaacgatgggaggcggagaggggtgagggttgaaaaattacctattgggtgcaacattcactatccgggtaatggggcactagaagcccactccaccactatgcaatatatgtatttgtaccccgtaaatctataaaaataaaaactacattaaaaataataataatgtctggtcatctaaatagtacctctacagcttattaagtgctctggagacgtcccagttgcctgtccttcccattaaaggtgatatccagtgctgatttccccttcaacctcgggttcccataaacctcttctttctcactcctgctgccctccggtactccaataaagaatgatagatgggccgggagcagtggctcacgcctgtaatcccagcactttgggaggccaaggcggatggatcacctgaggtcaggagttggagaccagcctggtcaacatggtgaaaccccgtttctactaaaatacaaaaattagctgggcatggtggcgggcctcagtaatcccagctactcaggaggctgaggcaggagaatcgcttgaacccggg

SEQ ID NO: 122075 - DNA, 253 bp, Homo sapiens
tgtttagttatatctgaaggattaaaatataagtcaggggactttggagattcaaaatattcaacagatgatggtggggtataaaactgatctaactcagatatttcttcactggttgtacttcccacaccaatggaaatgtcagactcaggagaaagtggacgacctagtgattcctgtttctggttgtagtattcatacacagtgttgaaagttacttcttccacctccattgaagtgattgattcactct

SEQ ID NO: 122076 - DNA, 208 bp, Homo sapiens
ttctcatgttaaaaccacaaaaccctatcagatattaatggcagtcaatgaatgtggtaacaacctagtggaaagtatatgggcatttattagtctttccactatttggtatgtttgaaattttttcctttttttttttcccttttttttgtttggagacagagttttgctcttgttgcccaggctggagtgcaatggtgcgacctct

SEQ ID NO: 122077 - DNA, 133 bp, Homo sapiens
agggaaaatagtgcaccgggaaactgcaaagagttcgcgattcctgaaggatagtagaaggccagagggcagtgaataaggaggactgcaccaaatcagcagcagtggagtgatatttaggaggtggaataat

SEQ ID NO: 122078 - DNA, 421 bp, Homo sapiens
tggggccccacccccagagattctgactgctgcatgggtacaggaatgtacacctgatgattttgatgttctagccaaaatttccacccacaggtcatgattttccacacctcccagtgtttgcataggctgtcccttcagcctggaccaccatttctccacagggtcatcttttaagactcggctccgccaggcacgatggctcacacctgtaatcccagcactttgaatactgaaagtagggctgggcatggtggctggaggccgaggcaggtggatcacctgaggtcagcagttcaagaccagcctggccaacatggcaaaacctcatctctactaaaaatacaaaaattagccggacgtggtagcgcatgcctgtaatcccagctactggggggctgagacaggaggattgcttgaa

SEQ ID NO: 122079 - DNA, 273 bp, Homo sapiens
gttagagtaagaatgctagattagattaagaaaacctggttaatgccagacagaaataaattataatctttagtgttaccttatcagacagaaattatttgtatcactgctggacaaaaatctataggttacgttgtaattgcattaagtctaggacttttaatcagtagtaaacaatgaactgaataaagtacaatttccccacataagtaatctttgggatggcctgtcattattttatgacattgaagtgacattccacttatcttttgc

SEQ ID NO: 122080 - DNA, 354 bp, Homo sapiens
tctcagtctgagctaacctcatggcagagacaactagttgtctcccaaaatctgttcttcccttcttcctcagtattagaactactaaatattctctggtcatctagaatagattattatatcccagtctcccttgcagttatatgtagccatgtaatttggccagtggaatgtaagtagaaatgttgtctattcttctttgctccttcctgttgactggattgttgatgggatggctggatcttgggcagccatattgaatcatgaggtgcaacccatactgaggaaggtggaaggtaaagctgcccatctgccctgtgctcactgactctggacttctgttacatggcagga

SEQ ID NO: 122081 - DNA, 392 bp, Homo sapiens
cctaattacggactgtgggtgataatgatgtgtcaatgtggatccatcaattgtaacaaatgcacatctctggtggggggatgttcataatggaagaggctatgtgtttgtgggggaaaggggtatatgggaaatctgtgaaatgagttaggtattatcattacatcaatttacagataagaaaatcaaggcacagaagttaaacaatcttgtgcaaggtcacaaagctaatgagtggcagaggcaggctttgaactcaggcagcctatctcaaggccaaaagcccactctcctgaccattacactctgctgccaccaagtcatgggcacaccaccatttatcaccatgtattccatacttcagatcagcttttccctttcatggcacatga

SEQ ID NO: 122082 - DNA, 304 bp, Homo sapiens
tgaaagatcatttcatacatccccaaacttaagtgaatcaaaaccattcaaaactcatgataatctctcacagaatgtgattaattatctccaggagagggagatggaacatgtttcctagaaaactcattctaatattccatgaccttcactctcagataatttttctaattaagtactttgcatttgaatttgaacccatgttttcatttttgagttggagaccaaaatctgaataacagccatttctattgttgatcacaattgtttatttatccctcagcatcttctccaactgaaacag

SEQ ID NO: 122083 - DNA, 417 bp, Homo sapiens
ttttatcagctgcaacaaaaagtaaaacaaaactgttttactgttactgttatccttgccaaatataacctctgtaaaaagtatggtgaaatatgttcatacatataaacatgactgcaggcgacagagcagtctttaacttataagcaacctaaaggtcatcttgtattaacgactctgctaaagacatcttgacagcacgatatgctaaagatttctttccaggctttcaaagaacctatctgtaatataccaaactgtaatttttctaccttacaagaagaacggttgggtatttacactttttacaacattcatccttatattgttcaaatatacagtgaacatgtgctaatttcataattctaaaaaaagctaatttaaaaaactacccataatattattgagtaacatgta

SEQ ID NO: 122084 - DNA, 418 bp, Homo sapiens
gggtgggaagcgtctttggaccctcaggctcctggcgtagacttatctcctcttctgaggttcaaatgcacattctacttgccaacccaggctctctcccatgtcaatttcagaaggcagtcaaagcaaacatttcttttctaattgtgtcacctttccctgttaaacaacctcctaatcctaaacttgctggtgcgaggaggcctcattcctctttggcccttctgtccatctagggtgaagggtaaatgctccctcacacctctcggtggggggtcacacccaacacaggtccttttcccttctccgtgtgggcccctgtgcttccctctcttcctgacctggcacagcaggctcctacagccttggtgtctcctgttcgtgcatctttggtgtgaccccacatgatgtgccttct

SEQ ID NO: 122085 - DNA, 310 bp, Homo sapiens
atgtcgggagcctttgctgttttgttgtgtatttaagtgaaatgtactttgatggaagttatttttctattgtagctgtggtttcttctggtccattttccttgtcactttctgcttaaccctttaagaaattaaatacaggcattatttcaaggagtgttaaataattttgccttctaggacacccttttgaggatctttcttcttttcttttcttttttttttttttttttttagctatttatatttagagatgagggacttgctgagtggcccagactggtcttgaacacctggccccacgtgatcc

SEQ ID NO: 122086 - DNA, 151 bp, Homo sapiens
cgccccagtctgagcgcacggctcctggcgccctggacgcgcgcgcgggccggtgccccccacccccgcccttcccaagggcctccaggggtgtcctgagccccccgccactgcgcaggtcccgagttaccgctggagggagaggggctgc

SEQ ID NO: 122087 - DNA, 512 bp, Homo sapiens
tccaaatgtggctccatgattggcaccaaaggcatcacttgagtttatatctcttaaaagctttctaaacctgtttaaaatattgctacctactgaatcagaaactctggggagtgggacccagaaatcccttaacaagtcttcaggtgaatctgatgcacaccaatatttgtgaaccactgcattctgccatgttttcagagttgataatcaaggaattctagcatataatgagaccagaagaaaaagggagaattataactagtagatcaagtttcctaaaaatagatttacagggctacaaggtagcttcagttaacatagtgagtgtgaactttctcaaactcaaaaatgcttatgatgggatgaaaaatagatcctatcacatgtgtcaagtcaaactagttggctgtgactacctgaaacactctgttagtccattctcacactgctataaagaactacctaagactgagtaatttatgaagaaaagagatttaattgactcacag

SEQ ID NO: 122088 - DNA, 1099 bp, Homo sapiens
cagatcatgaggtctggagattgagaccatcctggctaatacggtgaaaccttgtctgtactaaaaatacaaaaaattagctgggtgtggtggcgggcgcctgtagtaccagctactccagaggctgaggcaggagaatggcgtgaatccgggaggcggagcttgcagtgagccgagatcgtgccactgcactccagcctgggtgacagcgagactccatctcaaaaaacctcagtggtagttgtctgctatctaaggctaacaataaaaggctgttacagagctgtatggcagggccacccctgtatggagggcagactccagacctgtagagccatcagcatgcaatacttgcctgagagagcccaggtacctctcttcaactgctgagagctgctgggttggaactgtgcccatcaaaaccatggggtagggctgccccggggctttgggggtccaacccccagcccaatgcatcctgaaggcaagatactgagtcaagaattattctcaagcttcaagagttaatgttgttggccttttgggtttttaacttacttgggacctattactcctttcttcttgcctatttctccctcttggaatgggaatgtcagtcctgttcctgacccatcattgtgttttggaagcacatgtatttgatttcacaggctcacagctgcaggagaagttgcctcaggatgagtcatggccttgagtctcatccatatctgatttaggtgagactctggactttatagttttgagttggtgctggaatgagttgagacttttggggctactgggatggataaatgtatttttgggttttttttgtttgtcttttgagacagtgtttccctttgtcccccaggctgaagtgcagtggtacgatcttggctcactgtgaacaacttccgcctcccaggttcaagcaattctcatgcctcggcttccaagtagctgggattataggcatacaccaccacgctcagctaattttttttatttttagtagagacagggtttcaccgtgttggccaggctggcctggaattcgtgacctcaagtgatccgtctgcctcagcctcccaaagtg

SEQ ID NO: 122089 - DNA, 334 bp, Homo sapiens
tacaaactggttcagttaaggaggaaaaataattgaatttgaaacaatatacgtaacacgtagaaactaaatagtctttaatgaatacctactagcttgaaatctcattagggaaaagagttttctcaagtgtatgaagttattaaccaagagcagtgaaaagctgacataacatatgtcagtagagactggtatttcccaaatctatcgaacattgaaaacttaaacatagtaatttattgaaggcactcccatagaatcctatctgtggtgtactcagattaaaggaggtagtgaaaatgaactcagatgaattaagtgattgttccccgct

SEQ ID NO: 122090 - DNA, 443 bp, Homo sapiens
atcaccatacgggggcttccctggcaaggcccatctccctccctgacagtcctgccattgagggatccatctaattttatgtacaactgtaaagatgaatgataagtagaaaggatgaaggcaagaacaagatgaataaattataaagggcaaatgatgacaagacaggggtccccagagacagtgatatgataacagaaactaaagacgaatttatgatggatgtagttagcatgtatggaggctgttaattcttcggggtagttttacaatttctagtgatcggtgcaatcaaagcttttcattttagaaatgggatgtatttccacttgtttgtcctgtaggcacagtgttggtttttgtctctgaacagtgagtctgggtcccatcagcacctgcatcttccctcccagcccctgccaccttctgtttctctgcagaga

SEQ ID NO: 122091 - DNA, 341 bp, Homo sapiens
ctgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactc

SEQ ID NO: 122092 - DNA, 85 bp, Homo sapiens
tgattcttggagagaagttagggttgttttagcctttacctacatttcagtttaaggcttatccacaatctagaaatgcaatgtt

SEQ ID NO: 122093 - DNA, 396 bp, Homo sapiens
tcagcctcccgagtagctgggattacaggcacccgccaccatcccgggttaatttttgtatttttagtagagatggggtgttgccattttggccaggctggtctcaaatccctgacctcaggtgattcgcccaccttggcctcccaaagtgttaggattacaggcgtgagccaccgcgcccagcccactgttatattttctagctgcagcctaactctcttccctaggccttaaacctcttcacacctgaactcttccaatattgaatgtctaaaatgtgtgccctttttctcagcccctcgctgctcctcctctagcctctttctacaccacacattctctgatcaccacacattctccgcctgaagctgcggcaggaccaccaatatcctccaa

SEQ ID NO: 122094 - DNA, 794 bp, Homo sapiens
tcagaggtacatgtgaaggtttgttacataggtaaactcatgtcattgaggtttgttgttcagatcatttcatcacccaggtattaaacctagtacttaatagctatttttttctgctcctctcctaccctcttcccaccttccaccctcaagtagaatccagtgtctgttgttcccttctttgtggtcatgagttcacatcattcagctttcacttataagtgagaacatgtgttatttggttttctgttcctgtagtagtttgctaaggataatattttacttttttttctgtctttctgaataatttaaaactgctatgcaaataattggataaaatatttctgtgttttatatataaactatatttaaactatatatataaactatatttaatatagaatcaaagttgtttcataaggaaacacttgacataggatatttgaaatactctaagtagtccatgtcattgtaacaccactttaaaagattccttcagaactgttccactgagtgatttctaaaatggaattttacagtacagtgaatggatatatgaatgtgtgaaaaaataaatacaaacctattgttgctggcatacatgatcattacaccatgaaatacttaaatacatagggcattaatcactgcattatttactcattgtaatttcatttacttattgcaagcaattattgtaattattatttaatgatgagtctgtgtgagctctggctcaaactgcctacagtattccttaaatttcagtgaagaaaattaaacaattaagaaga

SEQ ID NO: 122095 - DNA, 241 bp, Homo sapiens
attaatgattatattcttgatttattcatgaaaatgcggtttttgtaaactaggtaagtaaagtcattttcaagggacagaccagacattacattttggagcatttcatgttaacttggtagaataggagagtgttagatttttagagtaggaaattctgataaatgttaaggctaattcaatcaaaagcaaactcaacccatcattaatgatgctttgatttcaaacacagagttatctg

SEQ ID NO: 122096 - DNA, 252 bp, Homo sapiens
tctgacagtcctattaggtgaatattattacacatgcagaaatgagaactgtgagaagttaagaaacttgattaaaaacacacagcatgccatgcatcattgagagcactgtgatagagagaccgagaactagggcaagagtgagagtgagagctggagagaggcagatgttgggtatgggatgttgagtaggtgtccctgcaggggagaaaaaaggagaatggaaggtaaaggagtagctaaattctggcc

SEQ ID NO: 122097 - DNA, 213 bp, Homo sapiens
tcctagctgccctcgaggtgatccatccatgacagttacaccagggctaaggcagagatgagagagaaatgggcctcttgggaaataccccaaaatgaatggaaacctgggggttccacccttgctttctccttcccccaacaggagaaactgcaggccaatgagatctctttcagcactgccatggcttgggggagacctgagcaagccagg

SEQ ID NO: 122098 - DNA, 547 bp, Homo sapiens
aatagaggatataacctccatactgtagaaggaaaaagaatggcataagaaaacaaaaatagaacttagtcaatccaaaaaaaggcaagaaagacagtaaggaaagggccactggttttgtctcttctgtcccagcccatgtgtgattgcagatgggtagatctgctgctttgcatcagactcagggccttggcactcacatccagccccatggtgccgtcccagctgtcagacccaggtgcttgcttgccacaccttgaagtgatactggcggggagctcttccctgctcctgggaagactcccccaaagcacatcacagccccttgcatgtcttaggcgctttccaccttctctgtgtctgttttctttccccctatatgcccctcccttacccacttcctggatgaatttacaaatttctccttaatagacctcaatggattagaatcataatctccaattctttgtcaagagtaaggtggggaagagaggccttaaataatccattttggtgttaaaatgtttctttttggctgcccgcgtgg

SEQ ID NO: 122099 - DNA, 451 bp, Homo sapiens
aaaaatgacagtcctgggtggggtgaaccctattgtgcagggaatattcaaaataatctgggctgagagtcagtggatgtgaattgaaggcccaactcgatctgttagttgctaaaaaaccttgagcaagagtgactaaaatgctgggccttggttctctcacctgggaaatggggagatagaagctatagccctgcagtcctcactgggcagatggcaggtaatgtgcattaaagtgctttattacaaacaaacaaacaaacaaacaaaaacaaaaacaaaaaacgaaaagaaaaatggtaacacctaggaagaagttaccttttatgggaggatataaagtcactaatggggcccagaccccgacctgattgttctccattcttaagcctcactgttcacagggctccaagacacctgccacctgggctgtctcaggcattcagctgac

SEQ ID NO: 122100 - DNA, 266 bp, Homo sapiens
caggtgatccacctgccttggcctcccaaagtgttgggattacagccatgagccaccgcgcccagtccctcacattgtcttatttaagtctcctgatagtcccgtgaagtagcttagggattgccctcatttttcatatgagtatactgagtaagcattagagagctggggtctgcaggactctaagccctccataatattagcccctacactctgtacagaaggtggtacataaaggcatttttaaaaatgtccagcccaactga

SEQ ID NO: 122101 - DNA, 500 bp, Homo sapiens
agcgggtgatctagagcatccgtgaggggttcggtctctccgtcttcctagaccactgcccctggctcccaatcacttctgccatttctagtccccaccccattatctctaccctctgtctctggctcctggcccctgtcacccaggctctcagagcctatagcagctcctctccccagtgttctcacatccacaccttcctgccccctacaagcttctcttcgtagcagccacagctggggtgtggcttggcaacatctcagctcccctttgtgcctgctgaccctgaccactggctccccaggatgacattcctgctgagcaaatgtgcccaggatctgctgccctctatcccaaaaggttctaggtcatacccaccttgggctccatccactctctggcctccaccaaggatctgttgggccatgtggccaatgggggccaccttcctggaggcctctaagaccagcagtgattccacccatccctgccttcctgcc

SEQ ID NO: 122102 - DNA, 380 bp, Homo sapiens
ccatcttacaagggtacctaatagtacctaccaagtaggttactgttgttatccctattatatcacaaggaaactgagacacagaagttaagaagctcgcctagagtcatgtactataactggctgagccaggatttaaacctaggcactctggttctagagttttctagagttctcgttctttttttttttttctcttttttcttttgagacggagtctcgctctgtcacccaggctggagtgtagtggtatgatctcagctcactgcaacctctgcctcctgggttcaagcaatccccctgtctcagcctcccaggtagctgggattacaaacatgcgtgcgccgccaagtccggctaatttttgtattttcggtaga

SEQ ID NO: 122103 - DNA, 777 bp, Homo sapiens
aacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccacc

SEQ ID NO: 122104 - DNA, 457 bp, Homo sapiens
gacacacacacttttctactgctttgtcagttcagtattgacatattgaacgtattgagaatttattaatatataatatctctgccactagtaataaaataaagattaatcttgttaaattactctatacctatctgagaagtgaacaatatagtcaactgctagagaaaagatatgcaaaaaacgtacagtagttcacaaaaaaaagatacaaaatggccaatgaacacttgaaagtatgttgtctcacagcaaataaatatgtttttaatgagatattattcttttacttatcagactgggaaaggtaaaaaagagtgttaatatctagtaatggtgatgtatggaaaacaagttcaaattcaaattggtatagttctcacatttgagggcagtttggtaatctttattaagacttaaaaaaatctatactccaggccatgcaccgtggctcatg

SEQ ID NO: 122105 - DNA, 438 bp, Homo sapiens
gctctgagctcaaggagttgattttgttaaaaacaacaacaaaaaggttatctcagtcaaaaaaggccacataaagccctaatatgaaatgtccaaaataatcaactctatagagacagaaagtagatttgcagtagtctagagctgtagtgggaggaaggcttgggagttactgttaatgggtatggtttcttttaggggtaatgaaaatgttctaaaattgactgtggtgatatttgcaaaactgtgaagatactaagaatcattgaactgtacactttaaatgggtgagttgtatggtgtgtgagtcatctctctcagtaaaggtgttattttaaaatacgtatatatgggccgggtgtgatggctcagacctgtaatcccagcatttggggaggctggggcaggcagatcacttttgagctcaggagttccaga

SEQ ID NO: 122106 - DNA, 669 bp, Homo sapiens
tcacctggtgagattgattatctttagggaatggtgcagatgggatagtttctagacaatttgggaacctcagaaatgggagtacttatattagaatgacataaaataactttttgccccagggatcttgcagtaaagattatcatcacagttggccataccatgaacttttctaagttatttaaatttaccttgaaatgttatcagtgtctgctgtcacagagaataaatgtatctggtattaacattttactcatgcttgccttgcctttactaaatcttatcttgtaattgaagaacttgactatttttaattctgaatacaatatgcctcagaataaggttttaagctttaggtaaggtaaagtttaactttagtttgtatctgtgacacctaacacaatactaaggaattcaactgaatgagaaatttattctaggcatccaccatgttcaaaacatactaagtacctaggaattacttatagaatagatgtaactctattgaactataaatcaaatatcaacatacaaagttgagtgagcagacttgtttgcctcttttcattttttgttacactgatggataccacatgtcttaggtgattgggggtgcggtggctagtaattactgccattattgtctgtgatacagcagtgttcagatag

SEQ ID NO: 122107 - DNA, 505 bp, Homo sapiens
caccatgccttccttctctcagagtgcaatcttgttcttcaatttccaggcccctatctgctcacctctgtgcattcatcaccttctgccctcattatttgctcatatgacctatctgaacccatgctggctttccttacgcagagacaccttatcacttcatctctgcttcccctccaagcccccagggcctgaagcagtgattaccagcaagtatgccctaagctgagcttggggaagctccttctaagaagttattacatgaaaatgcttggctttccatattctaaaccatactggtcaaggaggtctaacggttgctatcccctagaatagcaaaggaaaacccccattcacaggctctgtctaaacagcagtgctgtcccaccaaccacagaagccaggagctgcatgtggcaactgagcgcttgaaacatggctgttgtgacagaggaattggtattattaatcttattcaatttaattttatttaaatagccacatg

SEQ ID NO: 122108 - DNA, 634 bp, Homo sapiens
ggaagaatctgaggtctccagtacaacaggaaagacagctgtgtttgtacctccagtacaacaggagggttagagaatgaatgctagaatgttgccagccctgatctagccccactgcctcatttcacaggtggaactaaagcccagctgaatgatttgttcttgctttctccttctactcgagatagaaccaggacctgaatccaggcctacttgtttctagtcattgctgttttcactataaccaggtctctcatatccctgtcccttttttttttcctggcttcattttcagatttgggagaacgatgggggaaaataaaaggaaaaaataaaatctatgttttttggagttccattacatatatatacaaaacatacacagcctttgccaagtgggagtaactcttctgctgacaaaggggtattgtgggatgggcagaagtgacctcgtctcctttcttgagcctcttttatacattccagctcagcccagctttcagattgttttacagggccgaatgcttctagacaatgctttatttcctaggatttggtatagctgagtttttaagtgtggaaaagagtgattatgaaaaatgtttgagaagacagcactgtcctcagagactgt

SEQ ID NO: 122109 - DNA, 583 bp, Homo sapiens
ttgaaaattttcacaggggtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacagactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacat

SEQ ID NO: 122110 - DNA, 269 bp, Homo sapiens
cccaggctcaaaagactgttggagaaacgtctgccctggagatgaaaatagaaaatgattctgtgctgatacagtaattgagccaaaaagaaaagctaacaaagcaaggaatggttggccttgaatgcttatactggaagaggaatggatttcacctgatgttgtggtggaggcagctggggatttccaaggtgcctgtgggtccttccaatggcccaggctctttgcgtgttcagtttaaagcctgggcatgttcttcatcctccaca

SEQ ID NO: 122111 - DNA, 253 bp, Homo sapiens
catctacttaatcccaaaacatctattagtttcgtcttgtttcacctgattattttagctacataaaaggaatcaagttcatttcctctccaagcctcaattttctcatctgtaaaattgggaaggaactagcacccaccccatccagtgttgtgagacatagagaagatagcgcatacagtgagcttgtcctgatgccggacacatggatagaggcacatttagtaaatctaataatcatagtgatgcaaag

SEQ ID NO: 122112 - DNA, 602 bp, Homo sapiens
cccgcccccgcgtcaagctccttctcccacttcctactcccacacaacttcccagccactgaaacttttctttcaaatctctattatcctcttaacagttgcttgaataaatttatttttgcactatacattttctttttgccagatgtgtctaacaagtgtgtttggagagacctactcccagccccgtctccttccccgcctccccccgtcacattctctcaggccttctctggtatttataatatatcacagaagtacccagtcttatagccctcggttatgcctttttttgacattttattttttttaagctttttatatatatatatatataaatatattactttgtcaagtttttttgctgtacaaaagtcttaagatttaaaactattatttgtattatatgatggtggtatgttaatgttacaaaattattaatgaagaaaaaatttatttttgttactggtctgtttcataattcttttttaaattggtatattgtaagatatctatgcaaaaaatgttatgtgacgcatttttatttaagaatgtaatatgtgtaataaacagtagaatgtgtttggccttggaatacttta

SEQ ID NO: 122113 - DNA, 419 bp, Homo sapiens
tgcgtgagatggatgcacaaggaaagaagtggccagcagtaggaatcacgaaaggcttatcaagcaagtgaccactgtggtgggcctttcccggcagaagctaggacctttgttttaaaagacattgtaaggctgggtgtagtggctcacacctgttatcccaacactttgggaggctgaggcgggaggatcacttgagctcaggagttcgagaccagccagggcaacatggtgagacctcctctctacaaaaaataaaattagccgggcatgatgccgtacacctgtgctagctgcctgggagactcaggtgggaggatggcttgagcccaggaggtcgaggctgcagtgaagcatgatcacgccactgcattccagcttgggagcttgggttgacagagtgaaaccctgtctcaaaa

SEQ ID NO: 122114 - DNA, 2143 bp, Homo sapiens
  misc_feature (2143)..(2143): n is a, c, g, or t
ccggagccgcgcggccgaagcacccggcccggatcgcagagcccgcgccctgcgccggcggcaatgaagatctggagctcggagcacgtgtttggattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaagagcacgtctggctgcgagggcacacagggccggggaggaggattaggctggactgatcgcgggtcgcaggtgaccccgggaccagatgtccctcccctcatgagcgtgcaacagggagcagccccagccagacccaccgccgccgtctgcgtggatggagggctcgaggccctcgcccgtgtcccttaggggcggcgcccatcgtcctgcctgccgcggtggcccagccccttctctccctgcaggtgacccgcgccgcccccgcccgcccgcccacgctgtcctccacttaggcgcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggaaaaaaaaaaaaaaaaaaaaaaaaaaaaaaaaaaaaaaaaaaaaggggggggcccccattaaagaaatatcactccccggaggggggcgcccacatacgattacgccgcctctcaccccaagcgtttttttgtggtacaccaagggaggcgccccaaaattagagaagacggccgttatattataacagcgacagaggagaaccgagggcgccggcagtatataaaaaaaaacactgtgtacgatcgtggagaaaaaacccgctgcctaactgagggagaaactccttggtgggagaagagaggaaccccctcttaatcgtcagcggagggggggggagaccaacatatgggtgggacagcaaacaacctcactctaaaaggagagatattattaaacggacccctcaagaggaggagagacaactatacaaaacttttacaacggtgcgtattatagggggtggttaaaacacataccgctcgcaaatattatcacgtggccccagtctgttaaaaaagacttgcgagctctaacaagaggaattatgacgatttgagagacaacacttttttttaccaccaggagacgcctggtgtagtaaacatacacan

SEQ ID NO: 122115 - DNA, 2355 bp, Homo sapiens
  misc_feature (2355)..(2355): n is a, c, g, or t
atgttcacttgagcctgggaggtttgagtctgcagtgaccctgatggcaccactgcattcctgcctgctgggcgacagagtgagaccctgtctcagacaaacaaaaaccaaggggctgccaggtgccgaggcgtgcagccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaagagcacgtctggctgcgagggcacacagggccggggaggaggattaggctggactgatcgcgggtcgcaggtgaccccgggaccagatgtccctcccctcatgagcgtgcaacagggagcagccccagccagacccaccgccgccgtctgcgtggatggagggctcgaggccctcgcccgtgtcccttaggggcggcgcccatcgtcctgcctgccgcggtggcccagccccttctctccctgcaggtgacccgcgccgcccccgcccgcccgcccacgctgtcctccacttaggcgcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggaaaaaaaaaaaaaaaaaaaaaaaaaaaaaaaaaaaaaaaaaaaaggggggggcccccattaaagaaatatcactccccggaggggggcgcccacatacgattacgccgcctctcaccccaagcgtttttttgtggtacaccaagggaggcgccccaaaattagagaagacggccgttatattataacagcgacagaggagaaccgagggcgccggcagtatataaaaaaaaacactgtgtacgatcgtggagaaaaaacccgctgcctaactgagggagaaactccttggtgggagaagagaggaaccccctcttaatcgtcagcggagggggggggagaccaacatatgggtgggacagcaaacaacctcactctaaaaggagagatattattaaacggacccctcaagaggaggagagacaactatacaaaacttttacaacggtgcgtattatagggggtggttaaaacacataccgctcgcaaatattatcacgtggccccagtctgttaaaaaagacttgcgagctctaacaagaggaattatgacgatttgagagacaacacttttttttaccaccaggagacgcctggtgtagtaaacatacacan

SEQ ID NO: 122116 - DNA, 1535 bp, Homo sapiens
ccggagccgcgcggccgaagcacccggcccggatcgcagagcccgcgccctgcgccggcggcaatgaagatctggagctcggagcacgtgtttggattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaagagcacgtctggctgcgagggcacacagggccggggaggaggattaggctggactgatcgcgggtcgcaggtgaccccgggaccagatgtccctcccctcatgagcgtgcaacagggagcagccccagccagacccaccgccgccgtctgcgtggatggagggctcgaggccctcgcccgtgtcccttaggggcggcgcccatcgtcctgcctgccgcggtggcccagccccttctctccctgcaggtgacccgcgccgcccccgcccgcccgcccacgctgtcctccacttaggcgcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggaaaaa

SEQ ID NO: 122117 - DNA, 760 bp, Homo sapiens
atgttcacttgagcctgggaggtttgagtctgcagtgaccctgatggcaccactgcattcctgcctgctgggcgacagagtgagaccctgtctcagacaaacaaaaaccaaggggctgccaggtgccgaggcgtgcagccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggaaaaa

SEQ ID NO: 122118 - DNA, 581 bp, Homo sapiens
acccgggaggcggagcttgcagtgagctgagatcgcgccactgcactccggcctgggtgacagagcaagactccgtctcaaacaaaaaagtcattcaggtttggtggcacacgcctgtagtcccagctactggaggtggggcaagaggaggctgaggcaggatgttcacttgagcctgggaggtttgagtctgcagtgaccctgatggcaccactgcattcctgcctgctgggcgacagagtgagaccctgtctcagacaaacaaaaaccaaggggctgccaggtgccgaggcgtgcaggtgctgagccggcggccggggagggctcgcgggactcctcagatttgtcggaccagcctttcattaaagtgaagagactagcgcgttgcccaggcctggcgcggctttttgcactccccgtcacccttgtcaggccccggccccggcagcttgctcaccaccgcactatgctctcaccgcagccacccgtgggacacggtcatccaggcggccatgcgcaagtacccgaacccgatgaacccgagcgtgctgggcgtggatgtgctacagcgccgcgtggac

SEQ ID NO: 122119 - DNA, 273 bp, Homo sapiens
ggtacttgaggacatactggaggcagacccatctgcgattacatcccaaccgtgctgtgttgctttgaacaaggcagccacatctccgaaccactgaaaaaaggcataataatgatagctggatcctgggatttctggattctgtaaaaccaattgtgtaaaagttctttgtaaatggttagatgtgcctggtttcttcagtaatcagttatttttgaaattatttttaatttgtcccatagtaaggaatatattttaatgttgtgatgggca

SEQ ID NO: 122120 - DNA, 780 bp, Homo sapiens
atctgaggctttcttcacagctagctgatcggatccttgcagctgtttcttctgtaggtctcggagctcactgagaacgtccagcacgccttcccggcggggcccggcccaggtgcgcactagatgaggcagtcaaccaagtcaattggttcccgatcaactaaatctctcctaaaaataaacactgccgcgagcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggattagcaccgaagggattcgaggaggcaaacgggaagtaaaaatgctgtgtggagctgcagagggcaaggggacaggggttgcaaaggaaagagcttcgtgagactttctccttcccggcgtagggaccagcagagtgcgggcaggtcagccctgtcaccggttcgtttagggaaaaagcgcgacatggggcctgggagac

SEQ ID NO: 122121 - DNA, 538 bp, Homo sapiens
cagagaaaattacagatttggaagatctacaaaggacccatcatatatcccagaatagaaaactcaaataggggaacataaatatttaaagatatcattcaagaaaattttcttgaagtaaaagaagataaatctacaaactgaaagggcacaccatgtcttggggaaaatgacaaaaatctgtcaataacaaggtaatttctatgaaagtaactagactaaaaatataaaagaaagggggaaacagctaaataaaaaagactttggacagtcaagtgaaaacatcaattcataaagggtaacaaaatagaagttagactcagactttcccacagtggcatttaactctagagacagaagtgacatctgtgaagttctcaaggaaagaaagtgtggcctaagaattttatattctggaaagctgtcaatcaaacacaaagactagaaacctttttgaacttgcaataactgaatatttttttttcatttagtcccttttgattaaactactggagaaggaatttcagcaaatcaagag

SEQ ID NO: 122122 - DNA, 107 bp, Homo sapiens
tcttacttctatgctctgccaggaggaaattccggacttttgtctctttatgatgtaattactggttggggagggccccaaatattcctggggaagggaggcctgtt

SEQ ID NO: 122123 - DNA, 165 bp, Homo sapiens
tacctgtatttagtgatcaggtggagcatcaggcagctgagggacagagcttcagacctcagggtgtctgttcagagagaaccactacagcagagattggatgagggaaatcaagcaggcacttagcatctccaaatggtctgtgtagaggaatgctgacaaagg

SEQ ID NO: 122124 - DNA, 272 bp, Homo sapiens
ataaccccgtttgggaaatactactaatatagctgtttcacagagatgaaaaccaaggcttagagattaagctagatgtcttagcgcctgactctgaagttcttcccctactgcctatagggatactattgtcagtaacattgtttgttgaacaagtacctatgtgctgggcataatgaaaaaagtagacaaaaatcctgctttcagccgggcacagtggctcatgcctgtaatcccagcactttgggaggctgagactggtggatcacgag

SEQ ID NO: 122125 - DNA, 233 bp, Homo sapiens
ctgcagtgaaactttggaattttactattttattaaaattcacatgaaggctatatattaggacacatttgcattacaaatatatgtaatatatttgtataataacaatatcatgttcaataatctgaaatagttttcaaaggtaagtcgtgaaagtatgactttcttcttggggttatatcctgtggtgacttaaaggtgttttttgtgtttgagagtttgtgcttttaagc

SEQ ID NO: 122126 - DNA, 398 bp, Homo sapiens
attcttgttcctcatagtcatattttcattgtaaatgtcttcacgacactctgttatacaaatatatcataattatttaatcatttttctattttggaacacagcatttgcttttactttctccttattacaaataacatagctataaacagtacatgtatctttttccttcttttgaattatttctctggaagcaattcccaggagtggaattattaggtcaaaggatatgagtgtctcttgacaagcattgccaaatcagccctggccttccttccttttgcaaagactcactgtatgtacctggtgtgtacaattgcaggctcagcgagatgtgccaggtaggagacatgaggtgagagccctccactaagccggtttagcaaagagccctttcc

SEQ ID NO: 122127 - DNA, 323 bp, Homo sapiens
ctccttctttataggcgaaagaagcagttaaatcccaattttccatgtccttcctattcagaataggcacacggcttatttacacactgtgagatctaaaagtttacaactttacgacttacagactgtgcggtttaagagaaaggttcccaccagagccaatgagaggaggtgtgctcccaagaaaataactgctgtgcctccccctcagccagaaatgacctcagacattcaccggcacactgcagactgtggtaatgtgacactctagagctcctaaatagaacgcttttattgttatttttgtctttttttaaattatg

SEQ ID NO: 122128 - DNA, 704 bp, Homo sapiens
gtcacctgaggtcaggaatttgagaccagcctggctaataccatgaaaccccatctctactaaaaatgtaagaattagctgggtgtggtggcgggcacctgtagtcccagctacttgggaggcttagaggggagaatcgcttgaacctaggaggcggaggttgcagtgatctgagattgcaccattgcactccagcctgggtgacaagagcaaaactccatctcaaaaaaaaagaggtgttgttccccttctgcagatgaagaaattgaggctgagaagagaagttgcccaagatgatgaagctaataagtgacctatccaggattcctgctgatgcctaagccatgccattctccccgcatagcagtcatctcagatagacaaccttcaggcattccctataaagctcaagccttccagcagccttgggacttcccaggcatgggattttccagtcttatttaactgctttccatcttcacattacaatctagacctggtgattttgctgatgattgtagtttggttttggatacatttaaacaaaagaacatcttcatcctaaatcttctctcccagcatgtattcataatcttgacctgcgtttcgagtagaagccaattcttgtagagtgtgcctgggctcagcctaggctcctcactcatggtgagattcaggctatgcatttttggcgggagcacccc

SEQ ID NO: 122129 - DNA, 1079 bp, Homo sapiens
acacacacatacactttaagttctggggtacatgtgcagaatgggcagtatttcttaatgtccttctattccctcataatacttggtgaatactctgacaatatgagtgctcaagtattaaagtattaagttagctcttgctgcctagatatgactccatcctaagccaagggatgacagcacttgactgcaaactctctatggcaacaaattaccagaccacctggtaatgtttgctgtcctgatctagaattccacagtccctgctgtggtttcctggttggtcttattacttgttggaatcagtttacatcttcattctcgtttcatttccagcctctgctaggcggaatatgtgatagtcattattcatcctccgaggatcagagaactctctttagagccaattcaggtaccaagttatcaacttcagaccttgcttgggtgctccttggaaacacagattcctggaatcttctaggtttaataggtttgtatagggcctattacatctatatttttaaaagctcctcagattatttcatgagcatctggatttgagaatctatgttctagattcttttcacattcctccttgagaagcaattaccaaagtacaaagtgaagaaacttaggaaggaaagttgtttaacagaatttgcaagagtgttggttttttactggcttggtaactggtattagtccttaatagcttatgaaagagggtcccatgtgcctcagtctctctcttttctcagttactgaaggcactagaatgtggaatgtgtgcagctatgccctgcctcttaaatggaaagccaaagaagacagaatggtgaagaggttaagagcatggcctctgaagtcttgattacatacgtttgaatctgtctgtatctcaaagtttccatctgtataatggggataataataattaataatacctgccccagggagtttagatagagaagatgaccaagagctgagccctagaatatttgggagtctgaggtgagaggattacctaagaccaggatttcgagaccagcctgggcaacgtagcaaggctctgtctctac

SEQ ID NO: 122130 - DNA, 216 bp, Homo sapiens
aggttaggcctttgctcattcaaaaacagttattcaagcacagatgcatctgccactgcattaggcactgagaatgtaaagccgacagcttctatgttagtaccatatgagctattctttcttcagcctagactttcataacatggaaaagtaaggcaaaaccttcagagccgagtccaccagttatgattctgcttagcagggcttgtgcatata

SEQ ID NO: 122131 - DNA, 489 bp, Homo sapiens
cagcatccacgtctctatttttctctggattcgcggagtccttccaaatgcgctcctgtgcccgcgccgcggcccaagtgggcaaaggggggcgggaggcggagagcggctcagggacacgatcctaccgaggagccaggacccttcagagcgccccgctgccgggctccagaccccaccgaaggttggagaacccacttcctcgtgccgcaccttgactctggggagagtaggtagtgagtgacctggattgccctgcgggggcagatggttcggtgtgtaggaagcggacggcaacactggatgtccctggcaggtccgggtgtctgtctccgaagaggacagagaagggcagccacgatctgcccgcctgccctcgcgagcctctcggcactgggtgagaggcaactctggccatttcttgctgccctctcgccctctcccggccgctcccagtccagccgggcccggcgctacccgagcgagggt

SEQ ID NO: 122132 - DNA, 478 bp, Homo sapiens
aagtgagagcaggggaaatgccagatgcttacgaagtgtgtgagaactcaccaagaacagcatgggggaaactgcccccatgattcaatcaccttccatcaggttcttcccttaacacctcggggttataattcaagatgaggtttgggtggggacacaaagctaaaccatatcaaagcaatagctttaaaatgctagtttgcccttgacaacagataatagcttcaaaatatagcttttggaaccatttctttccactatttttaaagaatgacatgagtagatagagggttcagactattctttagctacaactcaaagactacattcaaatcttttgagaagaattccttcttcccttttcgtcatcttagcatactctaaagacctactggtaattcatttccgtgaaacagaattgcaaggcagtctttaataaaagatggcaaatgcaataatttacagatgtgttttttta

SEQ ID NO: 122133 - DNA, 245 bp, Homo sapiens
atgaaaaataaacaagaaaaaagatgcagcagatcaactcaagagattcaacaggagttccagcaaaaagaacacaggtatttatcaaaataatgcagtaagaacatccagaactgaaggctacaattatcaagatcagggctgtccaacagaaatacaatgcagaccattatgtaattttaaattttctaatagttacatttaaaaagttggtcaaatacatcttaataatgaatttattttaa

SEQ ID NO: 122134 - DNA, 756 bp, Homo sapiens
ctcctgacttcaagtgatctgcctgccttggcgtcccaaagtgctgggattacaggcatgagccgctgtgcccggcctcaattaagtaacattcttgattttgggttagtaacttaattgactcagctacaaacctatcctaccaattggaggagaattaccaaaactgctaataaaaggagcactggactcttgaaaccagaaaatttagattaatttctttgccccatgtttattaagtatccactaaatattggattctggtgatatatagattaacaaggtatattaatagtcaaagctctgacattttaaaactctgtgacttggcatattcacacagctgagtttcttcatctgtcaagtagagataacatcttccctgactacctcacaggattattataaggatcagaaacatgctctatgatataaaatgtgctatgaataaaaatattatttcagaattaagagatatctagttggtgtgttcaaggcaatcagtcataacatttacatgcatagttttcccctttttacaattttcactggaatatataaaaattttccctgcatactttgctgcctatctcaaggccttgaatgctgaaagaggtcttgaaagcagaaaaagaatgagctgttactgttcaagttcagactttctttttctttttttaatttaaagtgtcacaagtgttctcatatttgcagttatcttgagcataatgtattatttcctgctgttgtgagcaa

SEQ ID NO: 122135 - DNA, 503 bp, Homo sapiens
  misc_feature (230)..(230): n is a, c, g, or t
tgatagttgtctatggggaatggaggataagaacattattcaatttgtgcatggagaggaagacctgaaggttcagcatagaggtgaggacagagggcccggctgttgaaggaccagctctccctgggaaatgctgacttcagatcacagatgtgaaattgcaggatgcaggggtgtaccgctgcatgatcagctatggtggtgccgactacaagcgaattactgtgaangtgaatgccccatacaacaaaatcaaccaaagaatttcggttgtggatccagtcacctctgaacatgaactgacatgtcaggctgagggctaccccaaggtcgaagtcatctggataagcagggaccatcaagtcctgagtggtaagaccaccaccaccaattccaagagagaggagaagcttttcaatgtgaccagcacacatctctccatgtctagactgtagttgcacctgttagacttggagagatgtgtgcaagtttcgtaggaaaat

SEQ ID NO: 122136 - DNA, 476 bp, Homo sapiens
atgtagggaggagagaaacttcctatagaggaaatagcaggcgtgaaggtttagggcaataaagaacgccacgttcaaggatacgtaagttaacaaagagggataaaaagaaatgtgtctggaaaggccagaccttgttaaccatgaaatgaaattctgactttatcctaagtgtggagagctcttgtaatattttaaacatgagaatgttgagatcagatcaaattcgtggtttcagaaaatcactttgactgcagcatgagaaacagattgcaaggtaggagtagaaggaagataagggagttaagactagaggctttgagactcatcttgaggagactgagtaattaagagatgatgatggccatccttagaataaaggcagtagggatggagaaaatgggaagatttgagagttgcttatgtaaatggattgacaaaacataatgatgtatcgctacaggataatgaaaaag

SEQ ID NO: 122137 - DNA, 500 bp, Homo sapiens
gtatccgtgtccggggttgcatgtgcaggtttatttcctggttatattgcatgatgctcaagtttgggtatgagtaatcccatcacccaggtactaagcatagtacccaacagtcagttttccaactcttgccaccctctatcatgcccctgtctaatagtccccattgtctatttttgccatctttatgtccacaagtccctgatgtttagctcccacttataaatgagaacatgtggtattcagttttttgttgctgtgttaattcacttaggataatggcttccagctgcatccatgttgctgcaaaggacatgctttcattcctttttatggttgctattttttacttcttctttgtttactttttttttattatactttaagttctagggtacatgtgcacaacgtgcaggtttgttacatatgtatacatgtgccatgttggtgtgctgcacccattaactcgtcatttacattaggtatatctcctaatgctt

SEQ ID NO: 122138 - DNA, 290 bp, Homo sapiens
gcttgttggctgcctcagcagcatggtgacctttccccttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacat

SEQ ID NO: 122139 - DNA, 315 bp, Homo sapiens
aattccaaacacatatttgcaataattaattataaatgggtaaattacaagaaatgaatctgtgagatgaagaaaatagggcctacacattctaatggataatgtcaggttgtccttcaaaaagcaggtattaatttatattctctccaaaatgttatagcagggctaatgaaactagattccattcctaaatttattgctttgaacatagtaaacacatcctcaaaacaatgtttcaaaaatcccagtatactattaattttaatatagcaactttagttttttatcatgggattctacatttatttttcattt

SEQ ID NO: 122140 - DNA, 455 bp, Homo sapiens
gtgttggtggatggtgtgaagattttaaatgacagatggtggtgattattaaatgataaataatggcaacttaccaggaaccaaacagaaaatagtcactttatgtttctggtatgcatctgaattattcttgttatataatgacttttttaacactgttgtagatgaacagtgcttacgactatggaagtttggaacttcagagaatttaaaactctatcatactgttacctctcattcctctgattagaatttacatagattaagcaagtagtctgttgagggatagacttctaagtaagcataaaatggaacattataacttggagtttgcatcacagattttttataagttgttggtcaaagaaaatgtcatgattttttaaagtaccaaatgtaaatcgtaaaaagcttaggcacagggctaaccaacagggatacaaaatgaatgtagt

SEQ ID NO: 122141 - DNA, 240 bp, Homo sapiens
tgaaaatctgcgtgcttttgtgggagctgctcagctgctatagggagacaaccgccttttctttggatgcccaaggtcaatgcaaaactggatttgatgttgaagattgcagagggtgggcagtgatgtgaaggaaaaatggagtcagccaggaggccttcttgaggcaaggaataagagaaagccccaactcactgggcattccctatcaccaggcctttttgatgtgtacataataca

SEQ ID NO: 122142 - DNA, 546 bp, Homo sapiens
cgagatatgttacgggaattacaaaatcccattcttcatttcctcagaactagaaagcctcatgaacaaactgcttaccctcaaccccaggaagaggaacacaataggctagattatggggcatccatgagtcaataacgaccaggggatactaaggccacaccaggagccactccctcattaccaagtccacggaaagacacagctcatggtgtccatggggttcaaggcagaccacatccaggagtccttgttgggaaaacaaatatgactacaccatggccacatacctagtcctggtgtataggaaactggaggaaggctccatcaagagagtgcagcccctgccttctgggggtcccaccaattcttccccattccccaaagtatattccaccttccctgtctactcaaagaggaggagtctaagctagcctgcctttcccacctttaccttggttacttctaaaagtcagccagctgagaagaacaagtgttagggcagaagaccaccagaaaagccaccatgcctgccagtcccttact

SEQ ID NO: 122143 - DNA, 522 bp, Homo sapiens
acatctaccacggggacgctcttctcttagccaaggccacgagctagatccccaagagtgggaaattaattctagccagtgaagggaccaggctctaccatgtgctgaaagcaaaaaaaacaaaacctaactctgagaattcaagcaaaatactgtagaaagaattatgcatttcttatcagtgaacctgagttttccaagactatattagtctatggttaactctccaatgtctggaaggacaatatcagctctaaagaggttctcttagactcatacatttttggatcacagatatcccaaaaaaatttcaagtttatgttcactactaggtatttgtccccaagattattacagacaatatttcaataggttatatcatataaaactctgtcttcccaaagggttaaaatgataaactgattttgggccaggcatggtagctcacgcctgtaatcccaacacttggggaggccaagtcaggcggatgaagagatcaggagatcaagaccatcctggcca

SEQ ID NO: 122144 - DNA, 823 bp, Homo sapiens
cagtggctcatgcctgtaatcccagcattttgggaggccaaggtgggcggatcacttgaggtcaggagtatgagaccagtctggccaacatgggaaaaccccgtctctagtaaaaatacaaaaattagccgggcatgatggtgcatgcctgtaatcccagctgctcgggaggctgaggcaggagaatcaattggacccaagaggcggaggttgcagtgagcggagattgtgccactgcactccagcctgggtgacagaataagactctatctaaagaaaaagaaaaaagaaaaactgaactgacaaaagacctttttttcaatcccagtcctgccattgtctttgatcttggcaagtcaaagcctttctgaatcttgtaaactctgagactagatggcctgcatcacaacaattgtcaggattgattcatatgggagcactttgttaattatacaatgtttttcacatataagaaacctaccagccaggcatggtggctcatgcctgtagtcccagcactttgggagactgaggcgggtggatcacctgaggtcagaagtccaagaccacctggacaacatgatgatgtcaggccactgagcccaagcctgcacgtatacctccagatggactgaagcaactgaattaccacaaaagaagtgaaaatagccagttcctgccttaactgatgacattccaccgttgtgatttgtttctgccccaccctaactgatcagttgaccttgtgacattccttctcctggacaatgagtctcagaagctcctcactggccaccttgtgacccctgcccgcaagagaaaa

SEQ ID NO: 122145 - DNA, 193 bp, Homo sapiens
tctggggtacctagaggatcccagacgtcattttgcatggagtgttggcagctgggggccgatggaggttttcagagaccacagataagcgtctgaggagaggttcagaggggtgtgtgtgtgtgtgtgtttgtctgaatgcctgtgtgaagagacagtgtgattaccccagcagggacgtaagggtggtagg

SEQ ID NO: 122146 - DNA, 379 bp, Homo sapiens
aggggcaaagagagagagaaagggttctaagatatttcttgggtttgggtgagttagatgaaagcttttactaccaaatgagatcaagaatacaggaagtgttggtttagggggaagacgatgagtgcagtttggcatattctgaatccaaggtaactgagagagatccaaaaccaggtgtctggcagctagtttgtaaatacacagatggctgaggctcaggagtgtagcctgggctggaagcactgaaagagatttgggagtcatctcatgaatgctaaaaccaaggaggctgaagaagagtagtaagtgaaggacaaaattctatgaagtgccaatgtttaataggcaggaggtggaagagggccaatgacagaga

SEQ ID NO: 122147 - DNA, 684 bp, Homo sapiens
gaggtggctcacctgaggccaggagttcgagcccagcctggtcaacatggtaaaaccctgtctctactaaaaatacaaaaattagctaggcatggtggcaggtacctgtaatctcagctactcgggaggctgaggctcaagagtcgcttgaatccaggaggtgaaggctgcagtgagctgagatcgcaccattatactccagcctaggtgacagtgcaagactctgacccaaaaaaaacaaaaacaaaaaaaaagtgatagcttgattctacctgtttctgcccagtggcctgttactcattgttgccctgggagcttgctgggtgaattgttcagctacaaaacttggactaaggacacatctgtttcaagagatgttcatgtggtatgtggaactgtgcatgttcttagggagataaagaagtgattaattttcgttatggtataagttttggaaattatatctgtgttccagtagttatgggaataatgttgcgctctgtccttttccctctgtcaggccttggactgtgaccattacatagtagtgggctccttagtcatttgagacccatgaaactataagttcttaagaaaagaactgttagaacccctaaagtccagtcttggtctccagtttaagaaacacctggtgccatttgttggcaccataaataaaatagc

SEQ ID NO: 122148 - DNA, 432 bp, Homo sapiens
actgggcactgtggctcatgtctgtaatgccagcacttaggaaggccaagagaggaagattgcttgaatccaggagttcaaggctgcagtgagtggcaattgcaccactgcactcaagcttggacaacagagtgagacctagtctcaaagaaaagaagaaaaacacaaataaaactctctgcggcttatcataaaatgaaatgtcagccaaggcaagaggccacgcccgaaggagaaaacagataggtctgagtgtgggggtaatgctccaggcagcaggtggtgagcaaaggggtcaagctgggttcctgggaagttccccataaatttcagccaacgatgcacaggcctcctcccaaacaccgctgagcagggcttctagatctcactgtttttgacaacacagccaacctcagctaccagggtcatttg

SEQ ID NO: 122149 - DNA, 691 bp, Homo sapiens
ttacttaaatctttgttggtttccttatctgtaaaaactctgccttacaaggtggtcgacagcactaagatattgtgaacttagcacaatgattgatatgtatcactaatgagtggcagctatcatcaccaccacactcatcaaccttgactgagatttgagacatacataaatatgagttggtattatagaattattgcctatctcaagtatctgttagcacccatagttgcagtgacagcaacccgactcacacagtttaagcttgaaaacacagaacttatgcagggcagttctgaggaccccaggccctagagtaccttaaccttatgcatgatggttgtaatagatgctttacattttttagagaatctaatatttgtgacattttggtggtgttatatgttgattgtcttttctctggagcattagtcggattttccttgttctttgtatatccaagtgatttttgatcgtattctggatatttttaatattatgttgtgaatctctagatccttataaaatcctctgtagacggttggtttgtttcagcagccagttgacctggttaggttcagaccacatgttttttctcccttttatgtgtggtggttccttccagtgtctattcagttttcaaaactttggctgtttttatcttttgtgtgtgtggagggggcaggtgagg

SEQ ID NO: 122150 - DNA, 802 bp, Homo sapiens
gcacaagggcatgagaattgttgagggctttcttggaacctggctaccaccatgaccagaggagcaagttaaagtgttctgaggggtcagacagataacaaaccagctgggataaggagatgtagggagtagaggggattgcttgttgaacacttatggcctgcaggaatttccaggatgctggtcaagtgattccttattgtacagttgtttaaaatatctgaaatttaggttatgtaaaatgttcagttttttttaaatgttggcaaactaattcagtttttaaaagaggcattttaaaggtcatcctggggattactaaatgaacctctgtgcagactgcatgtagtttggtagctgccaggttatgacttctgatctacttaacacttatttagtggatgaggaaaatgaggcctggggaagccgaaatgaccagcagtcatacaacttgtgaatgatagaactggaattagaatccatgtctccagcatctccattaaaccataatgacaacattgaaaaactaaggggaactagatgcataaacagccaatgtgatctaagtggttaacttaataatctaagtggttctcaaccttcaatgtgcattgaaatcacctggtgcgtttttgaaaatacagatgcctgggctccacccccagacattccattaccttgaggctataggcatcacttttttgaaacttctgaggtgattctgatgtgcagccaagattgaaaccagaggatttaactgctttaagagccgtatttacttgctctagctgacttgagatac

SEQ ID NO: 122151 - DNA, 293 bp, Homo sapiens
tgcaaacataggacagcttattactgtactgaatactgtaggcaattgtaacacaataataagtatttgtgtatttcacacatctaaacatagaaaaggcacaggaaaaatacagtattatgatcttatgggaccactgtcatagatgtggcccgtcgttgaccgtaagtttgtcatgtggtgcatcccgcctaccttaattctcttctcgtctctgtttgagatctttgtcagttacaccaccaattacagaaccttagtattttctatggttctggctacatgctggaatt

SEQ ID NO: 122152 - DNA, 100 bp, Homo sapiens
ccggccaagattgttctttttgaaggatctttcttacgctgagtttctacctctctatcgtctatgtatcatttctagaacagcacagaaaaagccaaat

SEQ ID NO: 122153 - DNA, 305 bp, Homo sapiens
tcccatcctgttctatgaaaacaggttttcccaaatccaggacttcacagctctcttaccaagtagccaacggctcctccttcagtgttcactctggatactggaacatttcgcaatcaaaacccccttctcctccaggaactgcacggttctgccgctctatggcggcagcctcagggcccgtcagagggaagcttagctgaataactaccgtggcgtcacctcgtgtttccaaagggtctccaggctgaaggatgcagcgtgtgagaagtttaacaaatgcacatccacatcccgatggccag

SEQ ID NO: 122154 - DNA, 585 bp, Homo sapiens
ctcctgccggcccggcccgcgtctcagctgtggggacccgggggcgccgcgactcgcccacagtcggacggcgggaggcggttcctgcagggtccagtcccgggagcacccccaggaggaggggagggtgggagcgcctctctttgagtccccgggtttggtcgctgggatgtgaggaagccggagaggccgcggctggacgcaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccaccggcccctccgggcgtctccccccaggccttgcccagccgcgcgcgggccccagccacgtgcgccccgccccggccggcaggctccggccacagcccagcgaggaccacctatgcggcgacctcggcggggacggggaccac

SEQ ID NO: 122155 - DNA, 661 bp, Homo sapiens
ctcctgccggcccggcccgcgtctcagctgtggggacccgggggcgccgcgactcgcccacagtcggacggcgggaggcggttcctgcagggtccagtcccgggagcacccccaggaggaggggagggtgggagcgcctctctttgagtccccgggtttggtcgctgggatgtgaggaagccggagaggccgcggctggacgcaggtgggtgtggaggggccgcccggactgcggggacccgctccgcgcacagtggctgagcgcccgcctctctttccaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccaccggcccctccgggcgtctccccccaggccttgcccagccgcgcgcgggccccagccacgtgcgccccgccccggccggcaggctccggccacagcccagcgaggaccacctatgcggcgacctcggcggggacggggaccac

SEQ ID NO: 122156 - DNA, 500 bp, Homo sapiens
attctgatgcacagctagatttgcaaaccactaacttagtggcttccctgactgtatgtgaacccatgtgggtccctaaagattctgtttggaactttcaccaaagcagcctttggacaggtcttttacatctgtgaaatgcgctgatttggggcccacaatgttcttcgtttgttccttcataggttcctttattcagaaatatctattgatcaactctatgtacaagcatgttctagatgaacaaaacagaccaaaacccctgcccctaggaaaattatattctaaagggagccacagtgaattatctagtattagaatgtggtaagtgctacagagaaaaataaagcagagaaaagtatagcgtgtgtgaggtgggaagggttgcagtattcaactgagtggttagagatggcagccttgagaagctgacatttgagcaaagacccccttttggggtctttgctccttgatgtgcttggcgctcttgtagtggatga

SEQ ID NO: 122157 - DNA, 593 bp, Homo sapiens
attctgatgcacagctagatttgcaaaccactaacttagtggcttccctgactgtatgtgaacccatgtgggtccctaaagattctgtttggaactttcaccaaagcagcctttggacaggtcttttacatctgtgaaatgcgctgatttggggcccacaatgttcttcgtttgttccttcataggttcctttattcagaaatatctattgatcaactctatgtacaagcatgttctagatgaacaaaacagaccaaaacccctgcccctaggaaaattatattctaaagggagccacagtgaattatctagtattagaatgtggtaagtgctacagagaaaaataaagcagagaaaagtatagcgtgtgtgaggtgggaagggttgcagtattcaactgagtggttagagatggcagccttgagaagctgacatttgagcaaagacaagaagtgagagagtgagccatctaggtatctgggaggccagcaaggacacaaccctgacgtgggagcctgtccggcatgctgggagagcagctaggctggcgcagctgggtcaagactggaggggcaggtggtgagaggagcact

SEQ ID NO: 122158 - DNA, 224 bp, Homo sapiens
agtagcaaatgctgcgctccagatctggaatccagacgaactcttagctccccataggagactacgggcatgccaccccatgagaaaaaaaataataatgttctgatttgatatgaaggcgagagatttcctctgacacccttgattgtcttttttcctctccagtccagaccagaacaacgagttggaagtcgttttcgaatgccacctctgcgccctagctc

SEQ ID NO: 122159 - DNA, 187 bp, Homo sapiens
gcctcccgagtagctgggattacaggcgcctgccaccacacccagctaatttttgtatttttagtagaggcggggtttcatcgtgttggcctggctggtctcgaactcctgaactcaggtgatccactgcacctggcccccgttcatgttttttaaagctttatggttgctctgaaatagagttgtt

SEQ ID NO: 122160 - DNA, 367 bp, Homo sapiens
acaatgtgggaagtgcccctcctcctataaaaggtcaaccctttcacatttgctttggatacccagccctgttcctccaaacaccttcttcagctgttgtctctctcacccaaaccatcttcagtgctttacaaacaagttctcctgactcccgcattaagatggatctcactgacccttcatacccttccagctcatactttatatttctagtccctttcattgcacattttcttctcaaaagagttatctgtacttctatttatccagatataagccatctctgattccttaatgactattttgtcttatcccatcccactctcacttctgtctgcacttccctacttgtgatgattaatactga

SEQ ID NO: 122161 - DNA, 147 bp, Homo sapiens
tggttttagccctggctcactgtctctccaacaccctctccatgcggtatgcctctccaggcataactcctgctggtcccaacacccatgtttccagtccccgtagggtctctcacatctggcccaccactcctccaataactttgt

SEQ ID NO: 122162 - DNA, 367 bp, Homo sapiens
gtgtaaagcaaatgggaacgttgaggcatgtagaggttttgaagcagagtgtcggtccttccttccatacgcctgaaacgcataatccggggctttttgagagcaaaaacatagtcagaaatgtgccctgagggagaatgtactattttggcacacatatgtatatatgtatatataatttttaaattttttttgagagggggtttcactcttgtcgcccaggctggagcgcaatggcgcgatctcggctcactgcaacctccacctcccgggttcaagcgattctcttgcctcagcctcccgagtagctgggattacaggcgcccgccgccacgcccggctaatttttgtagagacagggtttcac

SEQ ID NO: 122163 - DNA, 442 bp, Homo sapiens
gatttactcttgcatctgagttcagttgtgggtcagcaggaaactttgtttctggggtgccttggctctttgccacatcatcttatccttcactaagctagcctgggcttgttcgcatggtggtggcagggatctaagatagagtgaatgcatgcaggctcagaactggccattatcacttctgcctcattccataggtcaaagcaagtcatgaggctgggtttcattcaaggaaatagactccacctcttgatgggaagataggcaaagtcacatggcaaaggacatggatactgacagggaggggtagagactaagggccatttggcggtcagcataccaccccagcagtcacaagcccactgcacccaggcctggcagggaacaagggctgaaaaaggctgtgtcaggaggagataactgaggattaaatgcctcatgg

SEQ ID NO: 122164 - DNA, 270 bp, Homo sapiens
gggtccgtcgacggctccagttgcagaatctttgcacgtacccactctgactttggctaccaggaacctggggcttggtttaatcctctgattcaggtattagtcaatcttagatacctgggacagtcgtaacaatctacatgtatagaccccttactatgtggcaggtacggtcctcagatctttacatgaactagtaacttgcatcttcaccagaaccctgtgaagcaggtgctttctgggctggaggtcgacgcgcccgcgaattta

SEQ ID NO: 122165 - DNA, 250 bp, Homo sapiens
tcaaatctagcctgggcgacatagaaagaccccacttctacaaaaagcagaagaaagaaagaaaaaatattgaatgggtaccatgttagatgctaagaacaacgaccatagttcgttcccttttagagcttactgtcttctggagaacttgcaaaattaaataattcaaatttaaaactgttggaactttattctgagccttgagagaaatggactgagtcacatagcatgccgttgcaacttctgcttt

SEQ ID NO: 122166 - DNA, 600 bp, Homo sapiens
aatcagatttaaacatcttaggcacactggtgtgtgtctctagtcccagctacttgggagactgaagcagggggatcttttaaggctagaagttcacagctctagtgcactatgatgatcatgcctgtgaatagccactgtactctctttagcctgggcaatatagcaagatgttgtttctaaaaaaaaaaaattcttacctgggcagtcagggtcccagcttcctttttcttggtgtatctctctttcttcttcctctcctggctcctgtgccctgacaaactggatcgctcacacaacctcaaggtcagaatgatccttaaggaccagttggtccagtctcctctctgaaatgtttattgcctcttgctgttccccatagtgttctttcctctgcttatggagtttctccctcctgaaatgccccatagccagacccgctgttaacctctgctgttcatcaaagcctagctcatacaccttcatgaggccaactcagtatggccattttttttttcttttttcataccacaaagcattgggaaccactctagagaggagggagtttatatttacttagtacctgagatgtgtgaggaa

SEQ ID NO: 122167 - DNA, 600 bp, Homo sapiens
ctgggattacaggcgcacaccaccacgcctggctaaggtttgtatttttagtagagatgaggttttgccgtgttggccaggctggtctcgaactcgggtgatgtgcccgtctcagcctcccaaagtgctgacattacaggtgcgagccactgagtccagcttggccagctaatcctgaccttgcttgataagaatcactggggcattgtttaaaacacagatttcctggcaccttccccggagcttctgattcagaaggctttgcgtggggcccaagattctatatttgaacaagcttctgggtaatatttatgacagggaagtcttgaggaaatttggactataggtcgtcttttaaggttcttgccaactctaagactgccatcccataaacacaaaaagggtaagagccacttatgtggagaaggagccttagaatccctggccgggaacacgcgtgcttctgctcctgaggcccagccttcctggccaggaacacgcgtgcttctgctcctgaggcccagcctacctggccgggagcacacgtgcttctgctcctgaggcccagccttcctggctgggaacacgcgtgcttctgct

SEQ ID NO: 122168 - DNA, 617 bp, Homo sapiens
acttgtgactggtgtctgaagtgggggcagtcttgtgggctaatgataactcccaatagtaagcatgagaactggtatagaaaaaggacaggttggccaggcgtggtggctcacacctgtaatcccaacactttgggaagccgaggcggacagatcacctgaggtcaggagttcaagaccagccagaccaacatggtgaaaccccatctctactaaaaatacaaaaattagccaggagtggtggtgggcacctgtaatcccagctacttgggaggctgagggaggagaactgcttgaatccaggaggcagaggttgcagtgagccgagatcgtgccacactgcactccagcctggacgacagagcgagactccatctcaaaaaaaaagagaaaaggtatttgggggtcagaaaacagtactgcagcaggcctcaaggactgatacggtttggatattcgtcccctccaaatatcattaacacgtaatctccaatgttggaagtgagctcgaataggaggtgtttgggtcatgggggtgggtccctcaggagtggctttgttaccagtggagggtcttgcctaggagttgtccaggttgttcacatgttcaacaaaga

SEQ ID NO: 122169 - DNA, 441 bp, Homo sapiens
agcctaggcgggtaccctatcctgctctattcacaatgtctctggatatcaactccattagttgattactgatcttcaaaatatatcgacttaaaaaagaaagacaaaatgaactggcctttaatctgttaaataatacagcaaacttcagaacattgttagtgattctaacctgaaactatcttgtctaatccagagctgtccatccaaaaccctatacagttcatccatcacagctagatattctgggctgtatctagctgaacgtcagaaagctatgcacataatgcttcttaaactatgtatagaacagctttccgtgaactgtacttttagagtaagggcctcatcttatgttgacggatcttctatgaaacagcttttcaaaaaccaccactggcttcatgataggaatgttgctgtggccccttccatcccatc

SEQ ID NO: 122170 - DNA, 286 bp, Homo sapiens
cctgcttcagcctcccgagtagttgggattacagatgaccaccaccacgcctggcttgtatttttaatagaaacggggttccaccatgttggtcaggctggtctcaaactcctgacctcaggtgatccgcctgcctcagcctcccaaagtgctaggattacaattgtgagtcacagtgcccaacccctacttcctttttgtttccttattcttaaacaccttataaggtttttactgctacccatgagaaacaaacttcctcttgttcgctctagtctatacctga

SEQ ID NO: 122171 - DNA, 390 bp, Homo sapiens
gagaaataaattgaacagcctggtttctgtaagctccactgagacacacactgttcccaggtctcccagcacccagtaccccctccccagtaatgtgctgtctctagtggtttgctgcatgggatagcactattgatgtcagctctcctaaggcagaaagtctgcccacagtgggaaaatgtgtcaaacaaagaaaaggctttaggttaacgagaaggcaagttgagtcaccagggtgtgtcaagtctgggaggcaacttggggagtgggaccaacgtgccagcacgtgcgtatcctgaggactgccagtcagcaggattcctaagtgacacataacaccaaatttgtcaatcccagcaaaacctggcagggggcatcaacagcgccgtg

SEQ ID NO: 122172 - DNA, 310 bp, Homo sapiens
ttatctctttgttccaaggcaagcttaggaaaaggcatctatactaagctttgtccatcacagtaagagactcctaactgttgtgctggctactcatcaccacaaacaaaatttagcagagggacaagagtaaggaaagtaaaggacttcatatctctttgttgttgttagtttcaattcactgttctagatatttaagaaaccaatattcagatatcaaagtagtgcccatctggaaatgtctaccttatcattccttcacaatggcaacaaaactgagaagctactgtattcggtaatgtaaatgtat

SEQ ID NO: 122173 - DNA, 786 bp, Homo sapiens
gaagctgtttggcaggatatgaactttttggctgccatttttttttctttaagaaggcaaaaataggcttcagtctcttctggcttgtaaggtttctgctgagaagtctgctgttagtctgatgggacttcctttataggtaatttgggccttttctctagctacctttaaggtttttttttgtattaaccttgggaacggttgtgttgtatagtatctctcaggtgtactctcagtttcttatatctggttcttgacctctctagcaagattagggaaattttcctgaattatttcctcaaatatgttttccaatttgcttgctttttctttgtatttccaaaggctttgttcttttttttgctttatctgggttaatttgaaggaccagccttcaagttctgaaattctttcttctgctttgtgtaatctgttattaaaacttccagctgtattttgaaattcctttagcaaaattttcaatttcagaagttctatttgtttttttcttaatacagctatcttgtctttcataccctgaattatttttctagtgtctttgtattggatttcaactttctcttggatcttactgagtttccttgatatccttattttgaatattttatcatttcaaatttttcagtttggttagtatccattactagagagttggtgcaatcctttggaggtgtcaggacatcctggctttttatactgccagagttcttgctgattccttctcgtctgaggagctgctacttctcatttttgagtttgctatca

SEQ ID NO: 122174 - DNA, 349 bp, Homo sapiens
caatcctgtaatgtttctaatttgctatggtatggaatagcatttaccatatatagcttaggtttgtaggctttatcttttagaaatccttaattcttagacttctcactcatttatttatttttgataaatattcctgtatctgctctgtacctggtactatttctaggtactgctgaaaagtggttaacaagcagacaagtgttctgcttttaagttgatacttgaatgaagaagactgaaataaaggaagatactaataatttcaacaaatgataaaaagccatgaaaatcatcttaggaatagagattgaaatgagcttggggcattgcattaagttgttggtaa

SEQ ID NO: 122175 - DNA, 817 bp, Homo sapiens
gcgtcatcacctggctcagctctgcactcggccacccttggtttttgactccctaagacagtgtcatcatcctcagggaagtgggtttgctgcagttcaggatttctccaattcaactcatgtgtacattcccttggaaagaagaaaaagtgtggagtcctgtgttgatttgtgattgctaacctaatgttatttaaatatgtgcaaacataaattagattccttatgcttagggttctttcttaatacaactttcaatctaaggcatcacagaagtgaaatgaaaacaaaattataaacacacactgttgttgccacaacccccagtagctctccgggccagccagtggcttctgaggccaacccatgagcttcacccaggaagagggcttcacaccccacgatggttgattggaacctccttctgggggctgcagggcaggggacagcagagcagagaggcccagggaggggccaggtgtcaggagctgcagaagcttaagactgtgcccagggcacccaccataccaccgtctgggccctgttccttcctacccctccttccccacgtacctgcgatgtgagcctcacctgagccagagcaccccccgacgtgccacccagctgcacgccaagtgttgactaaggtcggtggtaccggggacaggattgcgagggggaccctgcttcatctacattgtttaaatgtctgcagcaagaatgacttcatgcatcatgtgattgaagatacagaaaaagaggatggccagcaaccgtttgtaagcctcagataaagtgtcaatttttaaagtactca

SEQ ID NO: 122176 - DNA, 352 bp, Homo sapiens
gaggagcgagtcccccaaagtagttttatttatctatttagagacaaggtctcactctttcggagtgcagtggtgatcacactacttgggaggctgaggcatgagaatcgcttgaacccaggaggaggaggatgcagtgagctgagaatgcaccactggactccatcctgggcaacagaacaagactttacctcccaaaaaaaaggtggagaggggaggactactgcactctaccaggatagcgaaaataaaaatgacttgacaataccaagttttgggaaagatagaagcttgaactgtctgacactactgaaggagcatacattggtacaactactttggaaacctattt

SEQ ID NO: 122177 - DNA, 681 bp, Homo sapiens
gctgccgcctactactactaaattcgcggccgctcgaccagggatcagaatttccctccctattagggaaatgcgtttaaaaaaaaaaaaaacacgccagtttggttgggatgtttttagtatgctaaaacgtttatgtttacccagctcatgagtcagaagttattttgctgcttataaattcattttgccatagtatgataaatagcttttaatgttgtaagcaaatagggcattggatagcagcactaagtcattgaaaacaaaaacttctttattggtgtttggtttttatatagtttagggaaaggctctttaaaccaagtttcaggtgaaaaaatgaaaaaactttttaaggattttagataacatgccaagcacagtgactcatgcctgtaatcccagtagtgaatctgagaagcgcaggcttcccagatcgcttgagctcaggagttgaagaccagcctgggcaacataatgagatcccgtctgtacaaataatttaaaaattagccagccatggtggtgtgcgcctatagttctagctatttgggaggctcaggctggacgctgagcctggaggaccacttgaacccaggagttggggctgagtgagccatgatcgtgccactgtacttcagcctgagtgacagagtgagatcctgatgcttaagtttaaaa

SEQ ID NO: 122178 - DNA, 591 bp, Homo sapiens
aaagaacaaatattgatgaagtcaatcccaacatgctcattccttttccctaatctcatctattagatgagttcctccttctcccaaagaggagtaggtgagaggaggtgagaaagaggccatgtcccactctcctgtgcttccagggatcagaatttccctccctattagggaaatgcgtttaaaaaaaaaaaaaacacgccagtttggttgggatgtttttagtatgctaaaacgtttatgtttacccagctcatgagtcagaagttattttgctgcttataaattcattttgccatagtatgataaatagcttttaatgttgtaagcaaatagggcattggatagcagcactaagtcattgaaaacaaaaacttctttattggtgtttggtttttatatagtttagggaaaggctctttaaaccaagtttcaggtgaaaaaatgaaaaaactttttaaggattttagataacatgccaagcacagtgactcatgcctgtaatcccagtagtgaatctgagaagcgcaggcttcccagatcgcttgagctcaggagttgaagaccagcctgggcaacataatgagatcc

SEQ ID NO: 122179 - DNA, 1310 bp, Homo sapiens
acttttaacttactacaggtaattaatcataaaatatagctaagcagtttccaaaatttgtaattatcactagaggacatatgactaatttgagatgactcaccagagagatgaataaattaagtctgtcataatgttatatatctattaaaatgtttttaaaaattcactgcatacacattttaactaattttcaattattaataatagccattaaaatgttaaaaagtttataaatatctaagggacctcatttaagttataaattaattgtgaaagattgtcttaaaaaaatgaatgtaatgaaagtagcctctgaattgtaatacttaaaataagacattggaatagccaattatttttatatctatttgcaaattaaaagttataatgcaaaaacaaatctgggttgggtacagtggctcacgcctgtaattctagcactttgggaggctgaggtgggcagatcacgaggtcaggaatttgagaccagcctggccaatatggtgaaactccatctctactaaaaatataaaaaatcagccaggtgtggtggtgcacatctgtagtcccagctactcgggaggctgaagcaggagaattgcttgaacccaggaggcaaatgttgcaggagttgagatcatgccactgcactccagcctgggcgacagagcaagactctgtttcaaaaataataataataataataataataataataataatctgtcaaataattatcaagcagattctaatggttggggatgatgttaaaatcagagcttcactagaaaattatataaagcagacactcctttctaggaacaattgtattagttataggtctgtacttcatgggtggccatcattaattaataactgaagacatgctatttgaaaattgattttactataacagagaatgagaatggttttttttaattaatattttttctgtaatgagaacattctatgtgtttcaacattggtgaaatagtccagtgtgattaaggatacaactattgtctatgattgattttgtatgtagggtttcaaaatggaattcagaaaacacagtcattttataaacatttacctagcatctaacatgtgcactgtatagcgctctgtaccacaagaactaaaaataaatacaaggttttatctttatataaaatgtattcagcacatgtataaatgaaacagctagaagttctatacaaacgataaaataagtagattcataatgtattattagaataaaattgtgaatgtgtagtttgagaataaagttatatttaatcataaaa

SEQ ID NO: 122180 - DNA, 978 bp, Homo sapiens
tctctctagcctgggcaacaagagcgaaactccatctctctctctcacacacagacacacaaagaggccaggttaggccaggcacagtggctcacgcctgtaattctagcactttgggaggctgaggtgggcagatcacgaggtcaggaatttgagaccagcctggccaatatggtgaaactccatctctactaaaaatataaaaaatcagccaggtgtggtggtgcacatctgtagtcccagctactcgggaggctgaagcaggagaattgcttgaacccaggaggcaaatgttgcaggagttgagatcatgccactgcactccagcctgggcgacagagcaagactctgtttcaaaaataataataataataataataataataataataatctgtcaaataattatcaagcagattctaatggttggggatgatgttaaaatcagagcttcactagaaaattatataaagcagacactcctttctaggaacaattgtattagttataggtctgtacttcatgggtggccatcattaattaataactgaagacatgctatttgaaaattgattttactataacagagaatgagaatggttttttttaattaatattttttctgtaatgagaacattctatgtgtttcaacattggtgaaatagtccagtgtgattaaggatacaactattgtctatgattgattttgtatgtagggtttcaaaatggaattcagaaaacacagtcattttataaacatttacctagcatctaacatgtgcactgtatagcgctctgtaccacaagaactaaaaataaatacaaggttttatctttatataaaatgtattcagcacatgtataaatgaaacagctagaagttctatacaaacgataaaataagtagattcataatgtattattagaataaaattgtgaatgtgtagtttgagaataaagttatatttaatcataaaa

SEQ ID NO: 122181 - DNA, 312 bp, Homo sapiens
ctttcctgtggctaaagtgaattcaaaaggtggtttttcttttccccctctctaaatctaccatgaacagatttgccttcagcaatttagtccagcccacttcaagtcttactcattcaataaagcacacacattcactatggatccctcaaagattccttccattctcaatgcagactaaaatgccttatcccaattataacttttcacttttcctcagaaaagcaaacatataaccagtcctcacctcacaaatactccatttgtaacataactctgctaaccttggcaagtcatctttgattcttcttt

SEQ ID NO: 122182 - DNA, 520 bp, Homo sapiens
accctcaccagaaggtaggcagctgttggtgtcatgcctgcacagcctgcagaaccatgaggcaaaataaacctcttttcttcataaattatccagtttcacatattcctttatagcaacacaggctaacgtatttctaattcaaactttgaatccaggttctagcacttaataatacatgtaacattgtgctttactatattctgtcttcctccctttcatatccaagcttctagaaaagaggagtacttatttctccagacttcatcatggtgcctagcacaaaggagttcaaaaaaatgtttaataaagtttttcaaatttaacagcctttgaatctatagggcaaaattggttttaagacttttccaatttaagcacactacagagaacatcgaaacactctattattagaaataggggccaggcgcggtggctcacacctgtcatcccagcacttcggaaagctgaggtgggtggatcacctgaggtcaggagttcaagaccagcctcactaaca

SEQ ID NO: 122183 - DNA, 200 bp, Homo sapiens
aagtaaggaagtagggagagtggtgagagcaagatgaagggcaagctagctgagagttccaatattatctacctgcgataaatgtttaaagacatttaaaatacaacctcataagaagttttttaacttcactgacagaaaaggctctcagatcctctaaaagcctttcttagaataggcaaggtaataagctctttatt

SEQ ID NO: 122184 - DNA, 303 bp, Homo sapiens
cttgagtataaatgtaggaatggaattactggattttggaggagacctatctttagctttagtagatcttgccagacagtttttcaatgtggttgaaaccatttacacctcaatttgtacatcaatgaatgaaagtttcattgcttcacatccttggcaacatgtggtactgtcacgcaaattaatttgagctacattagtgggtatgcagcagtttcttaggtttaatttgcatattcttgataagtaatgatgcagtggtagatggttgccacaatgacttcttctatccctctatgtata

SEQ ID NO: 122185 - DNA, 660 bp, Homo sapiens
gctagtcattaagaatagcttcaatctttaaaaagtgctaccctgtcagtatctcaggaaagataaattgacaacaacaaacctcccagacacaaactcaaaagctagatgcttactgagaaattatgatgtgccaggaattgtcttagtaccttacctaattcaatttaatcttatcctcattttgcagaggagggaaccaaggcacaaaaaacttaacttggtaacatcatacagctagagggtggtagagccatgatttcaactctaacagtatgactccaaagcctgcacaattattgtagcacagggatcagaaacactcaacaccatcagtcataaagctatataaacattttacaggctgggtgtggtggctcatgcctgtaatcccagcactttgggaggccaaggtgggcagatcatgagatcaagaccccgtctctaccaaaaatacaaaaattagctgggcatgctggcgcgcgcctatagtcccagctactcaggaggctgagacaggagaatcacttgaacccaggaggcggaggttgcactgagccaaggttgtgccactgcactccagcctggtgacagagcaagacactgtcttaaaaaaaaaaatatttttttttaccctggatggggaagacattaacatag

SEQ ID NO: 122186 - DNA, 823 bp, Homo sapiens
agcagaatttctcagcattccagagagagattatatgggggaagaaagaacaagaaagtcagacctgagccaggcctgagaggtcaaggccaacaccccagggagacccatttcctctctggcctcttcacacccttctcccctccttcttcttcttttaacgtttctctctgccccctgtcttctctacatccctctttcctggctcccttccctgagcccctgcttacaggaggtgtctaatccacatgtgccgtgtgccaggcacaggttcatgcgcttcacaagtggggactcattgaattcccctgctctgtgtaggaggcactatgatcactcccatttcactgatgaaaaaatggaggctcagggaggttaggtgacttgcctgactcacagtagatggtggacttgggagtttgatgggactccaatgactgcaccctcagttacaaggtatttggatggtctctgttgtctgagaaactcaggggcccccagtgaaatgcaggtgagggtgggaggcagaaaagaggcacaggtggcccatactctggagaccccgttgggcctccgcactctctcttccttctgtctacaccccatactgacaatcctggtttgggccagggcagaggatgaggctggcagcccattcctcccgaaacactgctttggggctgattccctggccttagccgaccaaagcactctcattcaggctcaggaaagactccccagtttagggatggcactggaaagtccagggggcctagagacctaggtaccactcccagcactcacacattccccagagatgccc

SEQ ID NO: 122187 - DNA, 578 bp, Homo sapiens
agccacactagcacacctcgacagcttaatagccacatgtggctactagctggctatcatattggacagcacagatatagaacatataagtcatcacaaagagttctaccacgcagtactgttgctaaactactggaacacatacaaaagggaaagatatctttaacaacagcaatatgcaaaactttacagattccctaaccctttagttatgcacagacagcaaatatctgagtggaaataaatctggcacaaaggaataacctcaactatatgcaatgccatctttttgtatgtatgttgcgtatatatgtaaatgtataaatacacatacagttcaagcataattgattatatgaatgtgtatataagcacacatgaacatacattatgatagggaactcaaaacagttaagtgtaattgattatatgtgtatacttacatatgtatacacaaacacactaagtcaattatactttaactgttttgaattccttgccataatgtcattagctcaactatcctacggggatactaggaggagtattgataactgccattcatggaacacctgtga

SEQ ID NO: 122188 - DNA, 212 bp, Homo sapiens
aactttcagtaatattaacacatgaaaaaaaatccttacacctaactataatcagtaatatgttgctggatcttccaaaacaagagatgaggtattcttttatttttgttttattttgttctttttctttttcttttttttttttttttttgaattttttgattgattctatattcttttttcaaattttattttactttaagttttagggt

SEQ ID NO: 122189 - DNA, 295 bp, Homo sapiens
actgacacgggaggtgggttagggggcatgagtagaggatccctgcccctcttcaggggtctgagtgagaaggactggttcccacggcttccccgaacccccaaggaccctggcactgctcagcagatcagagctatgcacataggtttgttttgttttgctttcaatctagctggaaatacaggacttgtccatggttgtgaaaaaggcaattaattcagaccccagatgtctgggcctcccagagatgaaaacacacacacacacacacacacacacacacttgcatacattg

SEQ ID NO: 122190 - DNA, 461 bp, Homo sapiens
gaaattcagctcggttccgtccatttcacctgcacagtgtctacctcataaggttggcatttagatgaaataacataatgtactttatgcatagtacatagcttaaagtaagtcctcagtaagtgttagctgctgttattgttgttgttcttactatcattatcatgattcctaccttagtatctcccacctgggctagaagccttctacctagtcactcatggagagtgaccacagcagtgtggaatcatccatggctactgtgggaatatttgtcccttgaaaacagccgatgatgaaagaaggcaccaagcagaacagcctcataaccacgcacagacatcagctatgagaccattcctctcccagggggcccaggcagagatatggtattctagggatggaggtcccttggagagcatctaattcaatttcctgattttattcagcaggtgaaatgt

SEQ ID NO: 122191 - DNA, 622 bp, Homo sapiens
gtgggggtagggacaaaaggagtgagctggcgatgagcacggtgctatttgtagactaattataggcacccagcctattaaggagcagtgttctgtgggtttgggaaggctggcctcctctgcttgtggaatgatgggctttgtttgttcctatcgtaccagccctgaggacacatgactcccagctgattgcagcagagagaggtctgccagggaagtgtgagatcagaggcctggcctggatccaccgagtgaaacattaactccaccctgaagttgcagctgaatggaatcattttccctctgtatctttctcccatactgttatgtgatgctgcagtaacttgcgaggcctcatcctggctcctggagacctgctgatacagctgccttgtggctactgctgagtgggtcaccagccagggtggcactgtttgcagaacgtctccgaggtggagatgatgcaggaggaacaattgtcttcacagctaacttccccaggtttaatgctaggcgattatggttttgattctgttgaaaacaccattcctgtcctcttgatctagatccaatagagtaagagaagaggcctgggctgcaaactcaaaggctggcaggggcc

SEQ ID NO: 122192 - DNA, 252 bp, Homo sapiens
ctgagtggaactgagaattactgaaaagacaagatagttagtgaaaaattttgagcatcaactatgtgccaggcattctgccagttctggggaatatgacagttttcaagacagacaatgtctgcatttttctctgttgagcaatacatgtcaacgatgaagataaactccatcagagcaacctgccagcacctgaatgggagattttgttcttgagtatttcccacaagttctaccagcagatgaaatcgt

SEQ ID NO: 122193 - DNA, 330 bp, Homo sapiens
tagaggatcccttatttccttctttattgatacaaagtggatataatgcagttaaagttaggaaacacggtacatattgagaactgttagttacatgattacatgatcacagcgaggagctgtttctgtaagatcagaatgaatggagcatgctgcctgggaacctgtagctgcttggttagaatgagtgggtgctcagctggtggtaaattttttgtttacctttttgggttgtgaaccagctgcactgtaatttatgttaatttgtgctttaaaagttttcagggttgtactcgatcttaattgtgggtgagaaagatgaaaattatg

SEQ ID NO: 122194 - DNA, 494 bp, Homo sapiens
ccagggtagccctcaaaatcctttaatctatatggagattcagcattagaatgctatcagatctaactatcatgttcttagagatatattacttccaagttctcacatgggatgacaaaaatagatctcccttaaactaatcaattgggacacaactgtatacaagaaacactatagaaaatgcatgttcatattcagggagattacacgggtgtctgaaaaagaagtatttgcccttccccagaaagacattctagacaaatggagaatactgagagctaatgggatcagctttaccacctgacatatatctgcaggcgaaagagctggagaaaagagaaaccaatcagacaatatcaaatcgcattaacgttctcgaaacccatgagtggtggttatattaaagtaactctaccacagacactgcctgtcccatcatcaacgtcctgagcagaaaacatgggagacagttttccagagttttacttaactgt

SEQ ID NO: 122195 - DNA, 232 bp, Homo sapiens
gctagccgctgactctgccccaagcctctaggacactacctcaggcactaagctaaggtctctgcttcttagctcatcctgtagcctcaagggctccccatcctcaggcaaccaggggtatgggtccctcagtgggcctaggcacagctgtgactccttgagtgtggctctggctggcctgttgctacgtgctcgtctcttccctctctctgctcagcagcacccccttgac

SEQ ID NO: 122196 - DNA, 857 bp, Homo sapiens
gcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctgtgctggtggatggggagaaggaattataggagctggagaaacaacatcttctggaagggaagacaagacagtatacaatcccctacagaggagtaccagtgctccggggtcctcgagaccgacttcgccgagctctgcacgcggtggggctacacggacttccccaaagttgtcaaccggccccgcccacagccgcccttcgtcccctccgcctctttgtcggaaaaggccaccttagacgatccgcggctgtcggggtcctgcagcctcaatagcctggagagcaaatacgtgtccttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcaggtcagcagactgggaggccccc

SEQ ID NO: 122197 - DNA, 769 bp, Homo sapiens
gcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctgaggagtaccagtgctccggggtcctcgagaccgacttcgccgagctctgcacgcggtggggctacacggacttccccaaagttgtcaaccggccccgcccacagccgcccttcgtcccctccgcctctttgtcggaaaaggccaccttagacgatccgcggctgtcggggtcctgcagcctcaatagcctggagagcaaatacgtgtccttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcaggtcagcagactgggaggccccc

SEQ ID NO: 122198 - DNA, 513 bp, Homo sapiens
gcggatcaagtgggaccactgtagatcaggcacggcgggcgagttgcagtacgcctctgaaggggactggagggttccgccatccgtccctcgctgcagctccaaagacgtgggcactgcccctgatggctgtgttacgtctaggtcgacctagacctaacacagtgatattcttattgggaaataatgatccaaaatgagaattcaaagccagggagaggagtttttccaaaagcacccttttctcccagtatcatcatcccctccacacccccatttcaaatcaatagtctgagaggtacgatgtcttactggtaaaagaagtaatacaaaggctgggcgcgatggctgaaagaactgagagatcatgctgatagtaacattgttatcatgcttgtgggccataagagtgatctacgtcatctcagggcacgtacctacagatgaagcaagagcttttgcagaaaagaatggatagtcattcattgaaacttcgggcctagactctacaaa

SEQ ID NO: 122199 - DNA, 311 bp, Homo sapiens
acatctccccaatccaggctaagcctccacaatagtacgccaaaactatcatcacaatagtctttgactcccttgtcccactcctaggtaatctacactctgttgccagattaaccttgtgagtacacatatagcaacatgatgttccctggctcaaaaacttctccaacaaccccatggccttatgaatgaagttcccagtccttagaccagaacactagggtccagtcccaccatacctttcagaacttacatgtccttgccctgcacatcccacccaccctaagcctcctgtcatactggattactgc

SEQ ID NO: 122200 - DNA, 301 bp, Homo sapiens
aaggaaatgaggggaatgtactgcagctatctgggtaaaataataagggtcacatctggcagccatctgggggaaagggataggatatgtcctgcagccatctgggaaaaggaataagaggcatgtcctgcaaccaacttgggatgggaatgaggagtatatcctgcagccatcggggaagggaatgaaggtcacatcctgaagccatctgggaaagggaatgaagggcatatcctgcagccatcaggggaagggaatgaagggtacatcctgcagctatcattcccctcatttcctttct

SEQ ID NO: 122201 - DNA, 204 bp, Homo sapiens
tacgttttccacatggatacaacttcacagtttacaatgcgttttacatatacaatctcatttcatccatacaacaaccccatgagatcaatgacagtttgataggattagttctcacagttgctttatgaaaatccaactgttaatagtaacaactttcaaacactctttttttagtgatactgaatattccttcccttacat

SEQ ID NO: 122202 - DNA, 534 bp, Homo sapiens
ttattgtggaaagatgtgaagtttacagaaaagttgcacaaatactccaatgaactccaggagtccatccacctagtcttgccaactgccaacattttgctacattgctgaatcctctatctgaatgctgaaatcatttgagagtaagttgcagaagtcatgttcctttgcccctaaattcttcctaagaacaaggacattctcttaacacaccagagtcagctatcaaaaccaggaagtgagcactgaggcagtcctaagccacaccctgttcaaacttcaccaacggacctgagtctccgatcacaggcctgtccctccccgtccaggaacattgagctgtctccttagtctctgatctggaacctttcggcctttctttgtttttcctaactttgacatttgggaaggcccatttactttaagactgaccctgagtctgggttggctgatgtttctgcgtggtttgccctagatggacacaactggccagaaaaccctggaaggacctctgtgtcttctcgagcatccgcc

SEQ ID NO: 122203 - DNA, 715 bp, Homo sapiens
ctcccagcctccctctctcaggcttcctctggcaacccatggaaccagctccagtgcctgcaagaccaggcctgaagggctggtgggatggaggatgtgtgttaactacagccctgcctttcccttcccgtcttgttctcctctcccttaggtgctgctgagcctgtaataacagtgatgcccaggtgggctacagggctgtcctcccttgtcttagcatccctgacactcagaaaagggactcctgagctctgaccaccccctacaccctgccaaaccacctctaatctgcttcagcccagttcagccctgctgtgctatggagtgtgaaatgccctcacttgggggttaggagacctgggatcctgccccaggtctgccacttcttggctatgtacccatgatttaaattacccctctgtaaaataggactgatagtctgcaggatgatgagacacacagataaaataatgaatagcagaggactttgtgaacactaagtgatgttaggctctccactccacacctctgctcacatcttcaccaactggtcaaatcttacacaacccgtagacgccactctgaccattccttccctgtcctctgaccattcctgctctgtcctctgagcgctgtcccatcagttccagtcacacctcaccttgcacatacacacgacgctaacaaagggctgtgactggagtggggacttccc

SEQ ID NO: 122204 - DNA, 474 bp, Homo sapiens
ggtctatgcaggctggatgtgagcagtggagattagacacctggtgacagcacacacagggcagggcaagcaccagaaacatggaacaaagagcctgatggcccggcaagcacatgcatgcctgaaacagtctggagcacctctgggccccaaggtggccagaacctgagcccagactggtggcagcaacagtgacagcatcagcaaccacaggaaagagaaggggctacatgagatatcagtgctggaaccctgcttgggaagcctgcttgtctgtccctggctgtataaaaaataactcatagggctgggcgcggtggctcacacttgtaatcccagcactttgggaggccaaggcgggtgtatcacttgaggtcaggagttcgagaccagcctgaccaacatggtgacatcctgtctctaccaaaaacacaaaattagctgggcgtggtggcgcacccctgtagtcccagc

SEQ ID NO: 122205 - DNA, 419 bp, Homo sapiens
ttttttccacatgagaggtccatgccacagctcccacctcacctaggagcagtgttcaccatgccaggttttggagtcagacacacccaggctcaagtggtctctgaatttactcttggaccttaagttactaaatctctccaaaactccatttactcatgcatggcattgtgttaacaatagtccctcacaggattgtttctcagtttaagcaagaagtggccatgacacagtgtaaccctccagtccagcagctctcattcttatttgtctgtttgcagcagccctaacatctggcatgccagcctagagtgggagtgaggataggaaggatcgacttggaggaagggtcaggccacccagaaccctcatccctccctttctagctgctgattcaggctccatccacctccttcaca

SEQ ID NO: 122206 - DNA, 449 bp, Homo sapiens
atctggccacttctttctatcatcctcactgctactgccttaattcaggcaccctcacctctgaacaagattacaataggaataatagtgatgatggtaaacactgtgtcctaagtgcttcacatacattaacttattcaatcccatgagttaggtactatgattgccatgtctattttatagatgggacatctgacagggaagttacctaagattagaatcagtatgtagtagagtcaaaatttcaatccaaatagtctggctcaggatctacactcttaactactatgacctagtgcttctcgccctgacacatacttcctacacagcagccacagggacttttctaaaattcatacatcaacatgtttctttccctgcttaccatattccagcagtagcccactgccctctggagaatacacactcctcaagggggttggcaaggc

SEQ ID NO: 122207 - DNA, 573 bp, Homo sapiens
agaatggattcagctggatactgttatcctaagcaaattaacacagaaacagaaaaccaaatactgcatgttctcacttataagtggaagctaaaatcttgtgtatacatggacatatagttgggaacaatagacactgggaactctggaggagggagggggcaagagttaaaaaaactgcctattgagtactatattcactgtctagacgacaggatcaatacgagcccaaatctcagcatcttgcgaacatacccttctaacaaatctgcacatgtaccccctgaatctaaaagaaaaatggaaataaataaataaagctacagtaaccaacaacagcaacaaaaacaataaccaaaaataacaataatctactttacctgtactccagaaatggaacatctaagcctggatgacagcgcatctgtttatggcatggtttacttaatattttaaacccgccattgagacctactgctcagaaaaagacattcctctgaaaatattactgctcattgacaatgcatctggtcacccaagagctcttatggagatgtacaaggagatgaatgt

SEQ ID NO: 122208 - DNA, 435 bp, Homo sapiens
ggaattaaggaagtttgggtgcccctagcgcctcccaggatgaaggctttatcaatgaattactaaatgattgttcacgaagtcttcaacaatggtcatttgtaattcaccctctcttcctatatgtgtggtccttcaaggccgctttttcctgttgttacactagtgagagggaaccgaacgggctcatattcagcttaaggcacaagcgaaccccgtttgccttcaaccctgagacccgcctcccagcttggcagttagggtggcccttaaggtctcatttggcatcaaggagagatttccagtctgccaagttttcacagtgagtgaatcattgtctgagaaaatgacctctgaatatacatatatgggactattcagaagggctatgcagcaggattcagaggaaagactattaaaattccagtgtacacc

SEQ ID NO: 122209 - DNA, 594 bp, Homo sapiens
tcagctcggtaccgggcagtacggatgtgcctgaccgcaggtgatccaccgcctcggcatcccaaagtgctgggattacaggcatgagccactgtgcctggccagtctttctttcatactcaattgctacaaggttctggggggactaaagcagtcatgtgtatcacaggtccagcaccccatattcccttaacttactgccatgactgactgactgcaggaccataatatctaagactgttccatattaacaatcacgaactctagtattctcttctcatcttcctgtttctttcatctcttcctctgccttattcttctatacttaatccctgatctcatgaagacgctgtcccttgatgactattttgtcatcatcagcctctacctacattgactttcttccttgtctagcccacactccttgttttattatttacccacatcagtatccacaatttctttgccttttgtgtttcttccacttttgtccagcatacctattctagtttagtctagccatttgctttctctcctcatatagaaagggtattgtattagtgaaaatcatgtaaccagattattgccatgatg

SEQ ID NO: 122210 - DNA, 362 bp, Homo sapiens
atctgcctgccgtggcctcccaaagtgctgggattacaggtgtcagccaccttgcccagcctcttagttcactttcaatgttggttttgtcttgtgtaagtgagtagcctttgaaatagcattattttcaccatgtgtttaatgatgaatatgtatttcctttgtgtgaaaaaaagtttttgtgatttgaaggtaattttcaagaaaatttataattctttattttttctgtcttttttcctaaaataattgttgtaaaaacacataacatataatttaccttcttaaatctatttcaatgtacatgtcagggccaggcatggtggtggctcacttctgtaagaccaggattttgagaggcc

SEQ ID NO: 122211 - DNA, 331 bp, Homo sapiens
cacacccagctgatttttgtatttttagtagagacggagtttcaccatgttggccaggctggtttcgaactcctgacctcaagtgatctgcccgcctcggcctctcaaagtgctggaattacagacgtgagccactgtgcctggccgccaatgtctatttccagaatgctttcagcattctaaacagaaactccatatccattaaatattaactcataatttctcctctccctggcaactgctattcttttttttttttcttttctttttttttttgggaaacagagtcatggcataggccacggggagcggaagggggggggatctttaa

SEQ ID NO: 122212 - DNA, 381 bp, Homo sapiens
gaatagtcagacgttgagcagtggagggggactcgaggcatctgaggaaaaggaaaagtagagaaaatctttcagattgaatggagaagttactgagatagaaaatacggaaagggccaggcgcggtggctcacgcctgtaatctcagcactttgagaggccgaggcgggcagatcacttgaggtcgggagttcaagatcagcctgaccaacatggagaaactctgtctctactaaaaatacaaaattagccaggcatggtggcgtgtgcctgtaatcccagcgactcgagaggctgaggcaggagaatcgcttgaacccgggaggcagaggttgcagtgagccaagattgtgccattgcactctagcctggacaacaaga

SEQ ID NO: 122213 - DNA, 827 bp, Homo sapiens
gggctgctggttggctatttttgtggttatttcttgatcatatgctaaatagtgaattattaatatgtatgagtttcttaggaaaggggtagggaattcctggaattgagggttgttccctttttcagaccatatgtgataatttctggaagctgccgtgggactggtgggagtttctttattatattaatgtattataattagcatataacgaccagtgagcacaagcagatgtcacttttgtggccatctttgttttggcaggttttgactggcttcttcacctcatcctgtttcaccagtggggtcttagcgattggtttctggtaaaacaagtcctgccagattcctatctcaggagcaacagaatgcctaaaatataaaaccaatatgtaaaatcagtttcctaaattcctaaatttgtcacacagtagataaaagagtttattattttttatcatcttgatcctgacaatccaactgcaaaatgatctaaatgatctaaattgtttgttcctcacgccatcaccctcctgctgcctgattattgatttgatcattagcatcatttccagaggaattgtcaggaaaaaaagaaagagattgaaactgcatctagcagattttgtttccttgtgatggttaagaaccactagagcaatgcctacattataagatgatgagcttgtcctggttagcacaggactgacttagttttagactataagtcgtataccatgggagccttctaagtctcaggcaaactgaaatcattggtcatcctaatttgacaatctgtataaatccttaacggaggtcagaaatgg

SEQ ID NO: 122214 - DNA, 325 bp, Homo sapiens
ctaagttcttttttctcaggacagctttggctatttggggtcttctgtgataccacacgaattttagaatttttttgtatttttatgaagaatctcattggtattctcataggaattgcattctatctctatattgcttttagtagtagagtcatttttgcaatattatttcttccaatccatgaacatgggaagatgttccatttttgagggaccttttccatttctttcatcagtgttttatagcatttcttgcagagaactttcaactacttggttaaatttattcctaaatattatatatgcacctattgtaaatggcatt

SEQ ID NO: 122215 - DNA, 248 bp, Homo sapiens
agaaaggaagggaaagtcttccatttatggcttgctttacccaacactgtacagtccttgataacctgaggatttggctctcagcttctgcctttctaggctctatgccttctttctgtggctgggatccactgtttccaagtaatccaaaggaaggtgcaaaagtgcttttgtagcctgatgctttaactataaaagccagttcttctgcctccagatttcagctttaacatctcatctttgcataa

SEQ ID NO: 122216 - DNA, 174 bp, Homo sapiens
accagtgactggtcaatgaagaaattaagaagaaatttttaaaatttcttggaacaaatgaaaatagaaatacaacattccaaaccctgtgggatagagcaaaaacagaattcagagggaagtttatagcaataaacatttacatcaaaaacatagaaacggctgggcacatgg

SEQ ID NO: 122217 - DNA, 557 bp, Homo sapiens
agcggacgggggcaagttcccggaagagggaaggtggctgaatccgggaagagcggcggccgggagaaaaactagtgaggctctgacaacccggcgtggctgtcggcgacgctgctacgggcgtgagccaccgcgtccggccccatctgttattattcaaggtattttagtgcatcaccgcgcacacgatcttgggtctcgccattattttgttatctctgtacttgaagaagagagacattctgactggcattaactcaacattttgtgtgatggactattacatatggctcggaacgcatttttgtttgctatatagaaatgatcttctcttctgtgtgataaatgatacagctaaaagtctcagaattaatcaaacttaccatcaattaatttcaaatttttgactagcttccttaagtatttaaattattatgatttgcaaaataaccttgaaagtcattcagtcaaaatggctttgaaataaaatcatcacatgttaaagtaagaaattatatcctacctaataaggacaatagatacattaaaatagtctc

SEQ ID NO: 122218 - DNA, 524 bp, Homo sapiens
taccatctatgaaaagatcacaacccagaaggcataggcaactgccacggatctaatgaataggtgatcagaagacctcccaatactcttgaaagtactgagaactgattccctattctctcacctatgaccagccggagagaaccatattttctggtcttccagatgaatcctattcaaaatattattcactgtgaggctataattattagtccttaacttactacttaacagtagccctcttctaagctgttatctctctgcctgttgtttggcttaggaaattcctgcaggacctgccttgactttgaaccttttttatctcaccttatttgtcttattcccactacattagttaaaacaaaattcccctttcctgtccagacacatcagacagataccaccaataagaccctccctgcttactggcaagagcatatcaaaaacacctagacagttttcctaaaaggagaccattaaaaaataaattcagaacctaaaccaaacttctaggtgtaattcat

SEQ ID NO: 122219 - DNA, 340 bp, Homo sapiens
acagtcaagtcctaacatcctacatggggaaatctacgcagttagcagagccaaatatgacagcgacatgagccagccactttgggaaacagtcaagtcctaacatcctacatggggaaatctacgcagttagcagagccaaatatgacagcgacatgagccagccactttgaacctgacgtttcatcgtcacgtgagactgtagctctctgagtcccacaccctggtcaccttgtcctggttcctgcacctttgagggtgagttattcaagtcagccggtggagtagacggtgctcctgatcattcctaaaaggcaacagccttttctgcatttcttgc

SEQ ID NO: 122220 - DNA, 221 bp, Homo sapiens
gtggtgagagtaagtggaaatcgaggcaggcttgtggagaggatgtcacctggagcagatgtggccgggttatggggaagaaggacctctgagaggggattcagatctgttccctgggtcacagggaggaatgttgtaatggagccagtaggttacagcagttgctgaaagagggtgtgagatgggacctttgcatcatacacacacaaacacacacacac

SEQ ID NO: 122221 - DNA, 395 bp, Homo sapiens
ctgacttaaaaaacttagaaggctgctgaaatgatgtctacattccatacattctgtaggagtagaggaaaggggcctctgtgtaatctcctcttaagtcactggcattataaactactacataaatatattgccagtcttctgaaaggggcacagagaagtcttagagtgaggggctacctccactctgaagtttaaccctgaatgcagaattgccggagcagagtaaaggaagggaaggaggcaaaagaaatagatgcaagaggcaaagttttctttcttctacaggcttacagaagcttatataactgggttattctgagagtgaggaaatatcaagaaagagtactaacttgactatcactacagtctaattcaaacatttaaggaatggg

SEQ ID NO: 122222 - DNA, 627 bp, Homo sapiens
cctcattccaagtatatgtttcttttttccccttaattaaaaaacaaagatagtgaaaattacaaaacagcaaacaaaacaaaaatcaaagaaaaaaacctgaattgctgtttgttctctgaagtcttccaagaaatagcttatagttaaatttggttttcttgactcgaagtttcaaatgccaaactacacttatgaaagtcatataatccatcattctgaagaaatgtaatactctggctaacaaagaaattctgattaaattgaagtaattagcagaacaccaaacgtatggcatgagctctgccactcagttgtcctgtgctcatggcagacttcacgtgattgaggacagatccatcaatgttctttttatccctgagccaaacagggcctgagaattcttattatcaaagagctccaggcagagactaaccaccattggaagttaatgaataatttgaacgtatttgctatttttatactatatcatataccttcttcgttcctctttcatttctctttccaccatttccctatcctgttttaccagagtagaaacactaaatacacaagagaaatactcccaaaaaatactgcataacccgaaactacataaaactaaag

SEQ ID NO: 122223 - DNA, 392 bp, Homo sapiens
tgaatattttctcttattctgtaggttgcctgcttactctattgatagtttcttttgctgtgcagatgctccttagtttaattaggtcccactcgtcaatttttgtttttgctgtaatttttttgaggacttggtcataaattctttcccaaggttgatacccagaatgatgtttccttggctttcttctaggatttttacagtttgaggtgttacacttaaatttttttttttaatttttttttttttattatactctaagttttagggtacatgtgcacattgtgcaggttagttacgtatgtatacatgtgccatgctggtgcgctgcacccactaacgagtcatctagcattaggtatatctcccaatgctatccctcccccctcccc

SEQ ID NO: 122224 - DNA, 500 bp, Homo sapiens
acactctctcacacaccttcacacatgcatccatgggtgtatgtcaaagagacacaggagccagtgaaaagaactctcaatagccaaagtaggaacaatttgaacaataaaataaataagagtattggattatattctaaagtataaaataaatacctgtattagtctactctcacactgctaataaagacgacccaagactgggtaatttttaaaggaaggagatttaattgactcacagttccacatggctggggaggcctcacaatcatggcagaaggcgaaggggaagcaagacacatcttacatggtggcaggcaagagagcatgttcaggggaactgccctttaaaaaaccagcagatctcgtgagacttattcactatcatgagaacagcatgggaaagacctgcctctgtaattaaattacctcccaccaggtccctcccacaacatgtgggggattgtgggaattacaattcaaaataagatttgggtggg

SEQ ID NO: 122225 - DNA, 186 bp, Homo sapiens
gtgaacagatacaagagaacctttttaacaaagtgttgtgcttattgtaggtctttaataaatgctggatgcttatttttgcatacttctgttacacttaacattgttctgcaattatataaatttatctgtaattgattgtttaatctgtcagtgagcttcataagaaaaggagcaattatttta

SEQ ID NO: 122226 - DNA, 649 bp, Homo sapiens
atgccctgaaagggagcacacaaaacagattcaacaccaccattcagatcaagacagtgatggtctccaggtcctgggagactgccgtgctgcctgagggccattctctggcacggtgccctctgcctcatctgagctttccatctgtggaagcagccattactcctgagtttggcttctctcccgaaacgttatgcttgtgggacccatccatttgtttgtgtgcagcaatgtttgctcgtctcatctcacaagtgtgccactgttgaacatacccacctccagtgtccattctcttggggacatttgggttgttttcaggttggagctttcactgggtggaatggctcgcgcctgtaatcccagcactctttgggaggctgaggtgggtggatcacaaggtcaggaattcgagaccagcctggacaacatggtgaaaccccatctctactaaaaatacaaaaaattagctgggtgtggtggcgcacgcctgtaacaccagctactcaggaggctgaggcagaagaactgcttgaacccaggaggtggaagttgcaatgagccgagatcgcaccattgcactccaccatgggcgacatagcgagcctctgtccccccaaaaatagaagttaaaaaaaaaaaacagaga

SEQ ID NO: 122227 - DNA, 485 bp, Homo sapiens
aggcagaacactcaagtgggaatggcttttactgagaggtaatcttgtggcaggttagagagcaagtctgtcagcccctccatgtactctctttcccagcagaacgtgccagctgctcttctccagtgtttctgaggctgtgtttcaggaagctgtaagcagccacacaggttcaagctggtacactgtcctcttctctgtaccacaatggccaaaccagaaatgattagggatgttactcatagaattcactaaggaaaattttgctaggtcttgtgttcaacaacccgtgttatcagagaaatcctcttgaagcttaacctaaatctcctgcaatcatttggattcacttcctcttctgatgtgagtcagcctttcatttgttagttgatgtattcgtccagtttccttctccacacaacccacccccaacctcaaacacacgtgtgtccacgtgcacactcatacactctcctcacactctc

SEQ ID NO: 122228 - DNA, 126 bp, Homo sapiens
ccactacgtcattcttctattaacttttcttttaaagaaaagtctccaaagagttgctctttccacttcttcaccttccagtctcgtttttttttttcaatcagctttattgcagcataattgaca

SEQ ID NO: 122229 - DNA, 228 bp, Homo sapiens
tgtatctctaactagagagaatagtatacttaactacctcagggttgtaaggattaaatgagttaatatattactcaaatttctcaatgttattgcatgttaatacattagatatagtagttcctggcatgtggtaagtgctaaataagtaaattactgttatttggggttatttctttaggatagattcctaaaatgggattatcttctcaaagtatataaacattt

SEQ ID NO: 122230 - DNA, 221 bp, Homo sapiens
aagagaggtgctatgggaaccaggtgccaggtgaggccaggtgaagacaggtgaggccaggtgaagataggtgaggccaggtgaagacagatgttacgggaaccagcaggtagaaagctaagtgctgtggagaaagagcgggaagaaatggaggaggtgtctgggacaacagaacttgaaaagaacctgcttctcagtagccccaagtcctgtgtgtgcct

SEQ ID NO: 122231 - DNA, 358 bp, Homo sapiens
tctgactccagctcactgctggcttcaaggatggcactgtttttcctggcacctgggcactgccagaaaccatgtctcttccatgaagcaccacttctggcctaacacagggtttggcacatggcagaagtttggtatgtggcaaacaaaaatgaccataacccagtgcctgctctaaccagcaagtaacttggcctatctgagcactgtatgcattatagtatgcagcactgttgggaagcacttagaaaagtgcaaagtgctaagtgggggatggggagaggatgatgatcatgatggtgatgatgatttgcatgtattgaggccagaaaaggcttgtggggggcatgttgcggca

SEQ ID NO: 122232 - DNA, 297 bp, Homo sapiens
tgcacacgccgagtcaccagactcgcagaaaggtcactatggacgaagttgttgcaggtccgaatggacgaagttgttgccacacgccgagtgaccaaaccccagtgcctgctctaaccagcaagtaacttggcctatctgagcactgtatgcattatagtatgcagcactgttgggaagcacttagaaaagtgcaaagtgctaagtgggggatggggagaggatgatgatcatgatggtgatgatgatttgcatgtattgaggccagaaaaggcttgtggggggcatgttgcggca

SEQ ID NO: 122233 - DNA, 691 bp, Homo sapiens
gcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaa

SEQ ID NO: 122234 - DNA, 268 bp, Homo sapiens
cactgcaagcatggaataggcggctaggtaagttcagccaagattgaagttttactctgtgggagtaataaaaggacaaggaacacgaaggctaaggacattaacacatggaggaatgatttcagtggaggttcagttggatgaagataggttagtgctgatggagaatgacctggcagtgtcagggggcaataaacagggtagtggtagtacctgaataagggaactagctatgagtgcttctccaactgtaatgctaatgtgaatc

SEQ ID NO: 122235 - DNA, 195 bp, Homo sapiens
ttaccaatgtcacaaattacatctttttaataaagttcatccatttacatggtttttttagttatttatacttttgccttctaaaccctataccagaattaaaagtgattcacgcaccactgttacaatattataggattctttgtttaggtattaccagtaaactttatatttccatatgctctcatgtttctg

SEQ ID NO: 122236 - DNA, 351 bp, Homo sapiens
cgagctcttacccctttggggtctttgctgcaccttctgccctttacattccaggcctcactctgcagccacataaatttgataacttagatgaaaccgtccatttccttgaaaattgcaaatcaccaaaattcatccaagatgaaatagataacctgaatcatcctggaatttattaaagaaggactagatggtttcactgatgaatcctactgaacatttaaagaaaacaccaatttgagaagaagacggagtacgtacttcctcactcattttaaaggccaatcttaccctgctatcaaaaccagatgaatacagtaccaaaaaaactacaggcaaatatcccttttg

SEQ ID NO: 122237 - DNA, 474 bp, Homo sapiens
tcctgaatgttgatgatcttcgttcctatccatattctgaattctatttctgtcattttggcttggttaagaaccactgctggggaactagtgcagtcaacttagcagcaagaagacactggcttttggagatgccagagttcctgtgctggctctttcttatcttcattggctaatgttctttcaatctttgaagctgctgtcctttggatggatttttttgggggtggtgcttttatcttctttgatgtctttgggggtttgattgggttcagtcaactggcttcatttctgacagatttttgggggactaaggctcagctcagcactcctgggctatgtcctccaacactggggggctggtattgggcactcagctttgttctctggctctctgaggttgagaacatgcagcactggaggggttgaggtgttcttgggccacagccacaacactctgaagggtagtgccag

SEQ ID NO: 122238 - DNA, 419 bp, Homo sapiens
ccacgccccacactctggccactcttcctctgcaggactctcctcttctggccacattgcctctgcaggcctctccctctcctttgaccacagtctctctgcaggatcctcctctagtttctccctctcttttggcctcaccgcctctgcaggctccgccccacccacaggccccaccttctatgactacgccccctatgcaggccccgccctctctccagaccattcccccaatacaggtcccacattctctgacctcaccgtctctgcaggcacctccctctgctctggctttgtcctctctgcaggccacaacttctttgggctcacccactctgcaggccacacattctttcctgacaatgtcccctaggcaaacccaagcttctttgatctcaccttctcggccggcctctact

SEQ ID NO: 122239 - DNA, 346 bp, Homo sapiens
caatctctgtgagcagtgaatgtggaaacttagaagccagataatttgattttgacaaaacatactttagggagaggtgttatcttttctgctttcccaagttttttggtcttaaccacaaataaacattaaaaagaaccaagccaaacaaacaaagaaaaaacccacagtcttcgacaggagccacgcaggccttgtgccgttgtgaggctggctcctttcactcaccattggtctttgagatctgggcctgtggttgtgtgcagttgtgtacggctcattctcgctgctgagtcctattgccctgtctccacacatagggggtgttcacagcagccccaagaag

SEQ ID NO: 122240 - DNA, 349 bp, Homo sapiens
tggaaggatatagggaaccccaggaatacagagattacattttgagaactattatactacttatacaagtgtactcagtttctgaaaattcacttatgacacgggcactcttctataagtacatcatacttcaataaaagatgtattttggctgggtgcagtgcctcacgtctgtactcccagcactttggcaggccaaggcagacagatcatctgaggtcaggaattcgagaccagcctggccaacatggtgaaactccatcactactaaaaatgaaaaattagctgggtatggtggtgcacgcctgtaatcccagctactcaagaggctgaggttggaggatcactt

SEQ ID NO: 122241 - DNA, 108 bp, Homo sapiens
cataattatgttatttgtatcgtttcatagaataaattaaaacctaccctgtgagagaacaagaagaaaaagagagtcagttgaaaatgaaagtgattaagtccatct

SEQ ID NO: 122242 - DNA, 336 bp, Homo sapiens
gacaggcattaatcacacaagcaggaagaaagctaccagctgagccacatgctttgaaggaaaagatcacatctctaggctgaaaagtgagggaagtgaagttgggtgggagcctgaagagaatgagcgtggtctatgataggtggtgctggtgctagtggatgtggtggtgatggtggagttgatggtgatgatggaggtggtagtgatggtggagttgatggtggtgatggaggcagtggtgatgatggtggtgatggtgatgataaggtggtggtgaaggtggagttgatggtgatgatggaggtggtggtgatggtggagttgatggtggtg

SEQ ID NO: 122243 - DNA, 560 bp, Homo sapiens
tgcagtggtgcaatcatggttcaagtaatcctcctgtctcagctttccaagtaattgggtctacaggtgaacaccaccatgcccagctaattaaaaatgttttttgtatagatgggctcttggtatgtttcccacactgatcttgaattcctgaccccaagtgatcctcccgcatcggcctacacttcaatgcttgctttcctaacaaaattgatcctaaatttgtgcaaagaccctgctgtccaaaaattttcaaatgaatactgaaagcataaagtgaaaaattactgtttatgacaggttgagcatcccagtttgaaaatttgatatctgaactgttccaaagtccagaactttttgaatgccaacatgacactcaaaatttcagatttgggattctcaactgcaagtataatacagtattccaaaatctgaaaaaaaaaaaaacaccaaaacacttctggttctaagcattttggataatcacatttattttgtgattttcactagggaaatctgatttacaagtattttaatgactactagatacattaagctag

SEQ ID NO: 122244 - DNA, 140 bp, Homo sapiens
tttatattttataaaactcaacctctgtatatcatacaaacattatctatgttggtaaatttgtagataatttttgaaattctctcatccacaagtctaagaactgaaaatccctaactcacttagagcatttcattatc

SEQ ID NO: 122245 - DNA, 319 bp, Homo sapiens
ccatactgcaccggctcgctgagaaatcagactatcagactttgtttcctctttaaaaaaaactttttttagcaaggtatgggaggaagtgaagagtgagatccccatccttggagttaggacaaaatttattttgtgcttttcattgctaaactaatcattaattaatacttcccatgagaagcaacttggagactgagtacaagtgaacgcggtcagccttgctgtcagttggttcctggcttgcagtctcaaacctgaccgctgagagcacagacaattctgagtatagccccagtggtttaagaaaggtcagatt

SEQ ID NO: 122246 - DNA, 362 bp, Homo sapiens
gagtcaagcaagcctcccacatcagcctcctgagtaggtgagtaggtgggactacaggtgtgtgtcattacatctggctaatttttaattttttgaaatagagacagggttttactatgtttaccaggctggtctcaaactcctggctcaagtgttccttccacctcagcttccctgtgttagtctggttccacactgttataaagaactacctgaaactggggaatttatgaagaaaagaggttaaagtgactcccagttctgcaggctgtacagaaagcatggctgcgaggcctcaggaagcttacaactatggcggaaggcaaaggggcacaagcacaccttaccatagcaaagcaaaa

SEQ ID NO: 122247 - DNA, 330 bp, Homo sapiens
aaataaatgaaaagaaaagctgggtttgcagattagatgatttcatcttggaatgatgtcaacactactcgaagtgacctagattcaatacaatccttataaagattccaatgacatttttgataaacagaaaaacctatcctaaaattcatatggaatctccagggcccatgaataggcaaatcaatcttgaagcagaacaaaattaaaggtctcaaaacaattacaaaactgcaataagccaaaaaaaaatgtggtcatggcataaagacatacttgacacacttatggaccaacacaacagagacctcagaaaccaaccctggcata

SEQ ID NO: 122248 - DNA, 498 bp, Homo sapiens
tatggctcacaggctaaaatggctcttgcaattttaaatggttggggaaaaaggatcacaagaatactattcttcaacacatgaaaatgatgggaaattcaaatttctgcatccataaataaagtattattggaacacagccacacccatctgtttacatatcatcaaggcagctttcacgctacaaaggcagttgaatagcaacagagatggcacagcccaaaaggcctgaaatatttcctgtgtggccctttacaggaaaactttgcagagccttttcctaggagaggatgatcgaccagccggacatggtctctgccctcgtggaatctgcagtgcagcaggggagacagctattaaacccgtgccctataaacagcccgtgcagaaactgaccaggtgaatgcatgataatgcgatgaagtccacttgctggaatcccgagggacacagggcagacccagttccagcagcagcagatgcggtagccccaggcat

SEQ ID NO: 122249 - DNA, 800 bp, Homo sapiens
gattactgtttaaaagtccgttcattctgcttcgtgtactggaggatttgcttcatgcttgttagagatgacactcaaagttctttacagaatttaatcctgaccctgtttttaaggggtagacacatttatctctttcgcagatggagatttttgcctaaagtctgtgctgagggacagagaaaaagaaatagttctcttcccgtttttaggctacatgggttttcaagatatatttgtatcccctttctcaacatgtaaacctcagtcataagaaaatgaagggctccccctcacacctctgttctgtcttcacgcctccctcgtttctccatgactcctcttcctccttctccttctgttcctcctcctccttccacttttccttcctttcttccccctaatccctacccttggctccttgggtctgggtctgtctgacaagcaggcatttagtccaaagggaacgattcagcccatatcttctttctcaacccagtactaagcagggcagccatcttagtccacctgaactgttttcttttttgccgtagacctcaatggacttcatttgttccctttcagctctctggtcttgaaggagacaaagtttttaaatagtgcagactaacatttaaggtttgctttgctcttagcttaggcattttccctttccctcttttcacaatgtggttttcttttacctagttaaaaagaaaaattagagctttcatgccagtcaggttggggcatgctctagagagacaaagtcaagacttgcaactggcaagaagtcaatc

SEQ ID NO: 122250 - DNA, 236 bp, Homo sapiens
tcaataaatggtgttgagaaaactggatatccacatgcaaaagaatgaagtcggatccttactttacacaatatacaaaaataaactcaaaatgaattaaagacctaggcataagaccttaaaatataaaactataagaagaacacaggagaaaaattttataacattgccaaatccactgttataaaatttttctcctgtgttcttcttatagttttatattttaaggtcttata

SEQ ID NO: 122251 - DNA, 567 bp, Homo sapiens
aacccagtgtggtggtgcacgcctgtggtcccagctacttgggagtttgaggtgggaggatcgcgtgagcctgggatgtggaggttgcagcgtgctgagatcatgtcactgtactccatcctgggtgacagaatgagaccccatctcaaaaacaaaaacaaaaaccccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatactcattaagcagtcactccccattccctccctccctcagcccctggaagccacgaatgtgctttttgtttctatggatttgccttttgtggatatttcatataaatgaagtcattcagtatgcggccttttgtcacatgt

SEQ ID NO: 122252 - DNA, 315 bp, Homo sapiens
cagagtcacctttttgctgtgctgagggaagagtatctaggcctctggctctggctctcatgagctaagtgacctcaatcagatcacttggcttcttcactgcagtgtaaaatgcaggagctgggaaggtgaccctgtggttcccactggccctgcgttgctatgattctgtacttcttaaggtgctgtgttttttcccatcatcaaactaatcaggcaccaccttcatgccaaacccccgatagcagaaagtcctctaatagcaaagccagctcccatcaacagggcaggaattggcactatttgtgtacagtt

SEQ ID NO: 122253 - DNA, 262 bp, Homo sapiens
tctgcattggaaattggctgaatgacagtatgtgggtcctttgcaatttttctctgtataaagagtgccatagtggctgcatctgagcatgcctgcattcctacagatatctaaagattcctccatgtcaggcagttgaaagggtgattgcttcctctaggaggggacatttcctgttttcttagatctgacaagattcctccctgtccccaactatcaaagtatccgtttccagcaagatgagattcctcttcagttaaac

SEQ ID NO: 122254 - DNA, 337 bp, Homo sapiens
caaaaatagaccaatggtgcttaaactaaaaagtttctgcacagcaagaaataaccacagagtaaacagacaacctatagaatggaagagaatatttgtaaactacgcatctgacaaaggactagtatctggaatctacaaggaactcaactcaatgagaaaaaaaacaaccccactaacaagtgtgcaaaggacatgtacagacatttttcaaataaaaaaaaaaaacataaaaatggccaataaacatataaggtttatattctttcattttgccaatgagaagaacaacgcctagaatggttgctgactatcagggttcatgtgccaataagca

SEQ ID NO: 122255 - DNA, 325 bp, Homo sapiens
tggaaaacatgcctgtaatttattttcctggttttttttctttaaatttttacctaagttcttaaaattctaaatcaaagatcgaaagtggatctgtaccagcctccacagttttctttgggccagaggggaaaaggaggtaaaaatgaaggaaagcaccactttctttgtggagtattcactcctcctcaataatatctcaaggctcacaaaagggtccctcattgagactctgcatgcacatacccttttttctctttgctgcttatggtatccatctgagaatttcactcagaagtagcaaacattggcctagcatggtagc

SEQ ID NO: 122256 - DNA, 268 bp, Homo sapiens
cccaaataacgctaccccaagatataatgatcaaactctcaaaggtcaaggacaaaaggaggatcctaaaagcagcaagaaaaaagaagcaaatgacatgatgcaaaggagctctaattcatctggcaagaaacttcactggaaactacacaagccaaaagggagtgtgacaacatattccaagtgctaaagaaaaaaaattaccaacccagatgacccagcaaagctttcctccagacatggagagatcaagtatttcccagacaaa

SEQ ID NO: 122257 - DNA, 452 bp, Homo sapiens
agatcccactttgctggatcgacagtctcggtctgttgtggatgtcctgaagaggaataagaacttcaaagccatcgagaaaatcaacagtcacttagaaaagctagctacgtgttctaaggacctatcaggattcagcaatggtgatggacccactagtgaaaacgacattttcaggaaggtcttggagcagctggtgaagtatatgaactcaggaaaccggttattgcataaaaactttctgaagcaggaagtagttcagaggttcttgcgtctcctttctactctgcaagaaattcctcctgacctggtctgtgatattaatcaagactgtgccaccaccgtcttcaaattcttattggaaaaacagagatggcctgaggtgcttctgctgctgacccgcaaagtaagtggagaaccaccgcttggggattgcctcatcaaagactgca

SEQ ID NO: 122258 - DNA, 239 bp, Homo sapiens
acacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagac

SEQ ID NO: 122259 - DNA, 539 bp, Homo sapiens
taaggtatgtaccaaggagggaaagacatcaatgaaactgcatagctggaatgattaccaaacacagaggcaagacagtgtccctggttagctttagggtctgcctgtgcagtcctcatcactgtggctatcgacttgcttgtcctagaaaggtgaagaatagtaaataactcctaaggcttttttttttttttttctgagacagagtctttgctctgtcacccagactggagtgcagtggcatgatcttggctcactgtaacctctgcttcctgggttcaagtgattctcatgcctcagccttccaagtagctgggattacaaacgtgtgccaccacacccagataatttttttgtattttcagttgagatggggtttcactgtgttagccaggctggtctcaaactcctggccacaagtaatccgcccgcctcagcgttccaaaatgctgcaattacaggcgtgagccaccacatgcggccaactcctaaggctcttatctgactggtatacaaaggaccagatgaatctatctagt

SEQ ID NO: 122260 - DNA, 119 bp, Homo sapiens
atatatatgtatgagtccatttacatgaagaccaagaacaggcaaaagtacgttatggagatagaagtcagaacaatgattgccttcgtggggtgagaggggtggtttcttttcttttt

SEQ ID NO: 122261 - DNA, 353 bp, Homo sapiens
aactaaaataacttgatggaagggagacaagaagagggaaagtagaaatattctaattttgatattgttcacagtagggagaaaataagcgctgtctagagaaataaaaggattaaagatatcatgtcatattataattatgaagataaccatgggatcaaaaacgcagctttccaaattatcagaagacatacacacagaaaataaaacaaagacaacagagaccgtatggtgaaaactgacaacccccacaaaactataaaagcagaaagcctatcaaacaatgatgacagaactaagaccaaatgcatctgccatatctgtaaatgttagtgagccatacacacttgctt

SEQ ID NO: 122262 - DNA, 640 bp, Homo sapiens
ttgtacttggtccttgctgttcaatttccctacttgcactgtggcttcttgacatcctgccaagtttcagacactgaaatatgaatgggattaataaggattaagaaagagtaaatgctattaacagctcttctattgcatgcatctatcttactcaggagccaatgacccaccagggaaaaagaagggctgggagggaactgagctcattcaacacctgctcacagatggcaaggtcagcagttaatgctgggctttctccaaccacaatcatgtgtctgtcaaaggtctgcaccactcatcttgacacttaatcaaagaacacttcatcgaggatcgtcagagccgcaggagccattagcaaccagtggcttccctttttgtctttttctttttcttttttttttttttagggcagcaaaatcttcttgagaaatacattttataagaaacccaaataaactcggataaaatagttaacattattagtaagcctcaatttgaaaattccaaattcacaacatttgcttattatagagtatcaatctattttataaaggcaatttgagcaaacaaaaaatacataaaatcgcttgttacatttccttcatttccgggtttcatttagttgtacacgatc

SEQ ID NO: 122263 - DNA, 186 bp, Homo sapiens
ttctccgtgtagtctgggcttgctcacgtggtagattctcaagggttaggagaaagagaaatgtaaatgaatatgtaaatagtatttgtttcttgttcatcactggaattcagtatccttacccccaaagatttcaaaattccttactgaggccaggctcagtggcttacagctatgatcctagca

SEQ ID NO: 122264 - DNA, 1424 bp, Homo sapiens
  misc_feature (601)..(601): n is a, c, g, or t
ttttccccaaccagaattaagagaaaaaaagtgaatatggtttttgctcacagaatggataacagcaagccacatttgattattcctacacttctggtgcccctccaaaaccgcagctgcactgaaacagccacacctctgccaagccaatacctgatggaattaagtgaggagcacagttggatgagcaaccaaacagaccttcactatgtgctgaaacccggggaagtggccacagccagcatcttctttgggattctgtggttgttttctatcttcggcaattccctggtttgtttggtcatccataggagtaggaggactcagtctaccaccaactactttgtggtctccatggcatgtgctgaccttctcatcagcgttgccagcacgcctttcgtcctgctccagttcaccactggaaggtggacgctgggtagtgcaacgtgcaaggttgtgcgatattttcaatatctcactccaggtgtccagatctacgttctcctctccatctgcatagaccggttctacaccatcgtctatcctctgagcttcaaggtgtccagagaaaaagccaagaaaatgattgcggcatcgtggntctttgatgcaggctttgtgacccctgtgctctttttctatggctccaactgggacagtcattgtaactatttcctcccctcctcttgggaaggcactgcctacactgtcatccacttcttggtgggctttgtgattccatctgtcctcataattttattttaccaaaaggtcataaaatatatttggagaataggcacagatggccgaacggtgaggaggacaatgaacattgtccctcggacaaaagtgaaaactatcaagatgttcctcattttaaatctgttgtttttgctctcctggctgccttttcatgtagctcagctatggcacccccatgaacaagactataagaaaagttcccttgttttcacagctatcacatggatatcctttagttcttcagcctctaaacctactctgtattcaatttataatgccaattttcggagagggatgaaagagactttttgcatgtcctctatgaaatgttaccgaagcaatgcctatactatcacaacaagttcaaggatggccaaaaaaaactacgttggcatttcagaaatcccttccatggccaaaactattaccaaagactcgatctatgactcatttgacagagaagccaaggaaaaaaagcttgcttggcccattaactcaaatccaccaaatacttttgtctaagttctcattctttcaattgttatgcaccagagattaaaaagctttaactataaaaacagaagctatttacatatttgttttcactcaactttccaagggaaatgttttattttgtaaaatgcattcatttgtttactgta

SEQ ID NO: 122265 - DNA, 156 bp, Homo sapiens
accttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtt

SEQ ID NO: 122266 - DNA, 532 bp, Homo sapiens
aggagccagacaggaactagtattaagcctcactccattgttagcctccaaaatttgaggacattttgttcctgcagtataagttagcctaaactgatctactcttttttctccctttaggcaccatcctccctctttcaggcctaatacacacacatacacacacatgcacacacacacacacattctctctctctctcattcacacgcagcttagcctcctttttatctcgagggatagagttccctatcaactgttccactgctgtctttctccttcattgaagatgtcaaccttcatcagaatttaacaattcaaataaggtttgaattctataaatgtttgtagaacatatcccatgtcaaagtgtggatttctggaggtttaaaataacccaagccctggacccagccttcaggaatcgaagagtatggtgtgggtgctgtctattcaagtagctatccaacaaggtagacaatgttgggtgctgataaagggtgtgctttgatcctcagtgacctgtttatgtag

SEQ ID NO: 122267 - DNA, 456 bp, Homo sapiens
ttctggcctcatccccactttacagatagggaaaccaaggcagagagaagtacctgacccaggagtggaaacaccaggtctaagcagatagagtggcccaaaacctggcatctgattcctgggcagttaagttggcctttgaattaaggaagtcctcattagtgagctgcacacacacacatcagaagtgtccaacacagatggtcgtgacacagtggccatccttaacacacacacacccaggcccctgaggaaagaaactgctggaggttgtctgttcaaatgtgaaggtatgacatgttcgacacataagacaaacctggtagctaccagtaccccaaagtttctttaaggaggctctgaagataaccaatgaaagtgacatctggccgggcacggtggctcacgtctgtaatcccagcacttcgggaggccaagaagggtgggtcacttgag

SEQ ID NO: 122268 - DNA, 376 bp, Homo sapiens
aaagaaagaagaaactcttcatgcaattcaggttacattatggccaagttcaaaaatctaggggcagaacagtgcagggaataccccactgtgcattaaaggagagaggcctgccctggccaatatgacaaaaccctgtctctactgaaaatacaagaattagccaggcatggtggtgggtgcctgtaatccctgctactcgggaggctgaggcaggagaaacgcttgaacctaggaggcggaggttgcagtgagctgagatcacgccactgcactccagcctgggcaacagagcgagagtctgtctcaaaataataataataataataataataataataataataataatgaaaagaaaaagaaaagaaaaagg

SEQ ID NO: 122269 - DNA, 601 bp, Homo sapiens
ccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccacccccctccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatcttt

SEQ ID NO: 122270 - DNA, 245 bp, Homo sapiens
cccgctaccatgcccgggtaatttttgtatttttagtagagacagggtttcaccatgttggccaggctggtctcaaactcctgacttcaagtgatctgcccatcttggactcccaaagtgctgggattacaggcatgagccaccatatgcagccgattttataatgatactctaaataacacttttcctacactggatatgcacaaagatcaattggtgaacccttcccacccttgtttttgaag

SEQ ID NO: 122271 - DNA, 366 bp, Homo sapiens
gaaatacagtaaggaggaaaccacgagcaccagagtgggtggcagagggtggtgacgaggcagagatgtgagctggaggattcatcctcagggaccagcggccaggatgaggggcaggtcagtgactccagaccccagcatttcacgaaccattaaaatatttaaagactgaacatcctactgtgatatggtgacataaggatatttacagaaacttcatatagcagcgcagtggctcgcatctgtagtcccagctactcaggaggtggaggcaggagaatcacttgaaccagggagttggaggttgcagtgagctgagatcgcgctactggactccagcctgatgacagagcgagacttcgtctc

SEQ ID NO: 122272 - DNA, 344 bp, Homo sapiens
ggctcactgcaacctccgcctcctgggttcaagaaattctcttgtctcagcctcctgagtagctgggactacaggtgcacaccaccacacccagctagtttttgtatttttagtagagacagggtttcaccatattggtcaggctagtctcaaactcctgacctaaggtgatccacctgccttggcttcccaaagtggtgggactataggcgtgaaccaccgtgcccagccacaatagcattcttaaattgcttatgagtagagtatcaaatccttcatcataaataacaaaaaataagattctatgataacatgatgcagtttaaatatttttcctccatata

SEQ ID NO: 122273 - DNA, 875 bp, Homo sapiens
atatgtaatcttttttaaaacttgtatgtctgagaatttatctctggtgaaggagtctcaccggcacttttccaccttcccattcacagtcgccacctaccttgcccctcaaaaagaaaaaaaacttgcttgtcctgaatcttgctggattagttccttcttgccctgctatatagaaatacctgacactgggtaacttataaagaaaagaggtttaattgcctcatggttctgacagctctataggaagcatagcaagggaggcctcaggaaatttacagtcatggcagaaggcgaggcggaagcaggcacatcttacatggccagagcaggaggaatagagagagtggggaggtgctacacacttttaaacaagcagatcttgcagtaactcactattacaagaacagcgccagagggggagtctgccccatgatcctgtcacttccagctaggctccacccccaacattggggattataatttgacatgagaattgggtggggacacaaacccaagccatatcacttattatggtggattaccctgaattgtaaaacaaaaaaacccttgagtacaacaaagagacagttgaaaataaagatccaatttttctctgaaattcttggggccagaatttttttcttttggattcagaatattctggattttagaaaggtagtgctgtacatatgctatattacacaacaccacttgagggcctgcgacagtaccctgtaatctaacattggtatatctgaagtaaaacatatgaatatttatagtaaaagggataagaaaagactaagtagtcttactccatgtaaataggcttactttgtgtcaattttgagccaagtgaatcatgaaaacct

SEQ ID NO: 122274 - DNA, 2761 bp, Homo sapiens
ctttgcaatagcccaaagttaatttgtttctttgccatttgttttcgaatgggtgtggcattgcttataaaatgttgaatgtaagttgcctaggacagcgcctggcatatggtggaaactgaataaaggctgctaggtagtgtagactagatggactagaaaacagtacagatgcagatgctttcagatgttctctctgccacagagagacctttctgtgtgctttgttcaaagttgacagtgtgagtaaactaccatccaccaggcgttacttttgggtaattttttccatgtttatcccagttccttcatccgcttttacatagcctcttgtactgccagctacactcagttttgaagatggtgggttagccttagagtggtgttctgtggcccgtggaggaggaagcttgctcactttaatgcagaatgtctaagcatcctgcgctaaccattggcaggaaggttatttcagtgagacgctggttccttctcacccctgcacccttcctggaatcaccactggttgcagaagcctatatagggtggctcatttggacgaagtattgttaaggtggttattagaagactcgcaacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgtt

SEQ ID NO: 122275 - DNA, 2099 bp, Homo sapiens
  misc_feature (24)..(24): n is a, c, g, or t
caaggccgccggattgctatcaangcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgtt

SEQ ID NO: 122276 - DNA, 2198 bp, Homo sapiens
cccgactctgaggatcccttcgattggcgggcacttagaaaaggaagtaaacatgttaatactagctttcataaatccccctctctaaaaaacacccctttctaaaaaattcacattactaaggcatcccctacacagaatgtttagtagggaggtattaaaattaatagcaattctgagtaagttccttctcatgtagttaatgcagcatgatgaaagaaataaaagtctccttatttttttactttctgtgttgcttcttaaatatactccttcaagtcaggttagcttaccttgggtgtttgtattttgttggcttatgtttgcatgtgtgaattaaaaaaaaaaaaaagagaaaattaggttattaaaaggaggatatgaaccaaaatgttggcatgaattaagaaaaatcagtgaagaaatgttgcttaatttgtacacttccctgcagtgctggaaatggacttttcctttgcatttccatgagtcagggagaaaacagaccagcctggtttcacgttccagacagcatgaagtacctcaacagcaaagaaggaaataggggccttagtttttaaatcctctgtaagatagtcaaggcttctccagtagaaagttaggttttgtaataagggaccattttgtcctttctgttcaggattcaacaattgcttgttgatttggggtgaagatgccatgaactcaggagcgggtgaggagggcctttctctgcctcccattcccaaagcattctccctaaccccatggtggaggctgcggagagtgttgtaggcagttgcagtgcccgtcactctctgggtgaagccagtatgtcctggtggtggccttagaagacagcccctgtgaggctcagtaagccgcagcctagattggaacagcgtgactgcctggtaggataaaggagacgacatctgaaaagagggtttcaggtgtttgcaaagaggtcagatccctacacatgaaacgctgcggccacagctgcagccatgctacctgccacatgccctggcctgcgtcagcgttatggagtaggcaacctggttcggcgcaaagaggaaatgcgcgttctgtgcccagtcctcgctcccctttgccaaccgggctgctgagtgtgatgctccctttgtgaagtggacatctgtctaatgggaactggacggtgaccaccagtccgttttacacaggccaccatacagctgccaggtggcgctggctcttagctgttctgcaagtccagcacagggtgtattcagctctagaggtggcaaacacggggcccttccaccaggcccactccctgcaaaggaagtgcttccgagagccaaggctttgctctaatctctgtgaaggaagaaaaagacttggggaaaggtaatgaataaattaaagacacacttttgtaatcgtatattttaggctttcctctctacctaattgtgctctaatctgtacttaggagtatagttttttaagtgggacatgtcaggcttttatgccacagattaaactccaaggcaaataaatgtgtgacagcttaagaggcgaaaagaagagtcttcgtcaaatggcagagtttgattgtttaacctagactaatcagtctttggagggcctgccacatgtcttccagacggctagaatgctcaggagataagagtggggcctatcgctctgtggctttctccccctgcattagccgcagagctgagtgagtctatgaaaacccattggtcgggctgccctagcaacacagaatgctgtgctgacacatactccatcacatgtttgcgatgaaaatgctgtatttttagaacacttcaaagtcaggaaaccgttaaaccacactgcatcctctcttgccctctggccacttcctccacacccccaggaacattgcccccatttcacagaaaaggagcctgagacaaagattaagtgatattttaagcaaagctgataatcccagggaaaattgctgatcaagtcttgaaatccaacacatccttcggagtaatttttaatgctttcgcttcttttacctaagccatgtgtgttccatatgaccttaaatctaagccctaatattgtaaatggagttcagaagacaacttagtctcccattttctttcctggcattcattcaaataaaaataggcacgtaatactgtactgtt

SEQ ID NO: 122277 - DNA, 595 bp, Homo sapiens
aaacgtgttcggggttgcaggcatgagccactgcagctggccatgagtgggttttgagctgggaagggatgtttctggttggagtccctgagaggattcatgtccacgtgatttcttaagaaagtgctcccagaacagagtaggggaagtaggaaggggaaggggaggaagccaagcaaggatgtgacctcaggcaaaagcccagaaccagtcaattatgcctcagggttgaaggtaagagagctaaacctcagagttactgattaatttctccacttggcagtcactggttaaagtcagttgggaaagtgaacagctctattaacctaaggatggttttttaagaagagcctcaggtgctggtgtgggtctttgaaagcacatcaaaggtaatctgggcacacagaaacagcaagaactcccagaggatctgggtggagcacctacattgtttttttgtttgttttgtttcgttttgtttttttaaacggagtctcaatctgttgctcaggctggagtgcagtggctggatcttcgctcactgcaacctccgccccacccccccccaaccccgaacacggatagggaccgagca

SEQ ID NO: 122278 - DNA, 233 bp, Homo sapiens
tagagaggtgagcaacctgtcgaatcatccagtcatcgtgggaaagagccaagactcttaacattaggctcacctctccactgcccttccagcgtcttcccaatccacaaaggtatagcagctacaaagaagaaaagcatggcatccccgccacacctgagaaatagatctgccttgcaacgtacttgaggcgagcactgacattctgtgctttggtggaacagccccggtga

SEQ ID NO: 122279 - DNA, 372 bp, Homo sapiens
aaggggagccgatgagggaagacacgaaattgagaccagatacgtgccaagcagggcacacaggtgacatcgaagcagtggtagctggtcagagaggagtcacagctgctgatctgctcaggggcaatgacaaattccacagagtttgtcacaggaaatctggtgtcatcttctcatctcaaaaccatcacacagctcgcacacaatcacacaccattcactgagagccttttacacacaaaggaccacactgagctcttaacatgccatttatttctccaaaaagattgttgcctgcatgatccacatagagaaacctaagcttggcttagatgaaaccacttacccaaggtaacacagcaagtgatatag

SEQ ID NO: 122280 - DNA, 118 bp, Homo sapiens
ggggcctagattttgcctgaaggggctgctgacaggaagggagataaaggcagagggagaaagagattagagggagaataacagaaaagagagaaaacagaagattcagcagaaaagg

SEQ ID NO: 122281 - DNA, 593 bp, Homo sapiens
tgctggaaagagagggggtgttggaatggagggaaaagagggaagtgttgcagagaggaagggggctgctacgtggtaaaatcctgaatgccagaacaggacatcattctgtaggaaaggaaggcttttgggtaggatgtgaaattacccaatcagtattctagtaggttaatatgagaggggcaagatttgagtcaggaggccagctgggaggccggtgaatagtcttggtgtgaagtaaggagggaggccctggatttggtggtgttggcagagagaacaagggaggggaggatcacccagctatgctaaattcgtggataactggagtctgcgaacctgggaaattggtctcagtaacagcaataaggaggttgggatagaagtgcaggtctgctgaccctgtatgtgccctccatggccctggggcaaagagcccaccagcagggcagagtgcttctgctcactcactgttccattccaagacaggactgactgcgcacaagtgtgtgaccctgggcaaatgacttgactctgaaccacagtttcctcatctgtaaaatgggggtaataacgagggttcaggagactta

SEQ ID NO: 122282 - DNA, 309 bp, Homo sapiens
ggcgtgtgagatctatggtagtagatgatatgattccttgtctgggcttttgccgaaagctagcttgaacctcaggagttagctgagggctagctaagaactcttcccctgcaaatctgcttcccacacataattaattgcttcacaagttactgtcaacatgaaaatggcctctgagacatcccaagtggctttcaggtgtgagtggatcctcttcaatttctttcattagtgttttgtagttttcattttacctccttagttacatttatgtctgggttttttttttgggtccttagatggttacag

SEQ ID NO: 122283 - DNA, 334 bp, Homo sapiens
tttaatagcttttctgattaaaattcaccatcacaaaaaagttaaccactgaatttaatttcctattcagtatactgttttacatcacttttattaaaaacatgttttattagattttccaatgaaattaaatggtgaacagcacatagttcttgcttttactgctggtttatacactttaataattacataaaactatcttattcaaccaaattaaattcaattttagccacaagcatatttttactaaaattttattcacatataaactgggcagtaaaaacagcatttcaaaggagtatttcatgtgtgtttgtgtgcgtgttctaaagtc

SEQ ID NO: 122284 - DNA, 416 bp, Homo sapiens
aaatgatgttctgggagaaagggactgaggctgccgtggacagtggtcatctcgggcttcgaagtatctattccagcttcctaagggctcacccttgtcctggggtgaaatgatcctcccaccacgcccacagcccacggtggaggggtcattcctggcacctcctcccgcaattggattacaagggttcccaggccgagtccactccgcggctgcgtgagaggtgggatgcgggcagagctcagccgcccgcacccgctctcccagggcccttagtgttgagcagcagtgggagaaccgtaaggctggctggagacgtaggtggaatcctccgtataagtctcagctgtcctcttcagtcaattgtgtgcgcctactgcacctttcccggcgtggccggttcccaccaccccacc

SEQ ID NO: 122285 - DNA, 496 bp, Homo sapiens
ttttgtacctattccctgtttcagtgcatgtacaggaagagttgtctcataaggtgccactaaggaaaactttctccataaagctgcctgctgtgcacgttgcctgggctttgctacccctggtgctgcatctgcctgtgttctgtcttctggttctgctgtgctgtgggggaggggacgcttgtactcctctccttttggcaggaagagtcacttccacattgaggtcagaattgaaaatgggatttccccgttgggcagaggggatgggaggcctgcacttcctgtgtagtgtaaattaatcgctgccccttccctgcctgcagccgtccaggttcaggggccggccctgattaaaccattttcctgcccaacgttgtgaaggctaagaaagacctgtgtgagctttcgcatcctttccttcctacaagttcggtattaatctcttgtagggcatccctcaggttagggagctctctgtgctgggctcgtttct

SEQ ID NO: 122286 - DNA, 119 bp, Homo sapiens
ttgtgcagtagaaagagcttttggaagttggcaagtagcaaggctagttctcatacattctatgctctggccacctttttctgtggcaggaaaacaaaacaggcaaatgcacacaaact

SEQ ID NO: 122287 - DNA, 284 bp, Homo sapiens
ttcttatttttcccctcatcatgaaaacgtcttcgtgacgttcagcctgtagctggctattttgttacattaacatttttaaagaaatgtgtctgtcggtcagaaggagggttggtcagctacagcacagaggaagagagacgtcgcagagagactgtcaggcagtagcctgtctgcactgcccagaaaagagccatcgccaaatacccatttgattccactagggccagatgttctgagttcacccccaccagacaacgttctgattatgattggtttttcca

SEQ ID NO: 122288 - DNA, 430 bp, Homo sapiens
caaaaatggttagatcaagtgaacatttaatattctttcaatcttagtttctaaatagagctgtctgcctatttactagctgtgtgaccttaggtaagttacttaacctctctgagtcttagacatcacatctgtaaaaagaagataatattattatggtaattaaatgaactaatatttgtgaagaaatgagaatagttcctgagacatagtaaatgctaaatacatacttatctaagtaaaataaatataactatttctcaagtaaactttttatacaaggataaaagtgtaacaaatgttaagcagaaaattactcttgagctaaagaaaggaaagtagaattgcttatactgaaagagaaatgatttttatatagctcacaggattctgtgagaaattgtatcggtgaaaacaaatgacctagttt

SEQ ID NO: 122289 - DNA, 424 bp, Homo sapiens
tcaagtgtgcacacagaaacatatagatcatgttccatttgacattgcttattttagcagaaaattttgactgatctaaatgtccatcagagagggagtggataaatcagttgtggcatatgcatacagtggaatcctgtgcaatggttaagtgaagtactgcaaaatgtatcaacatagaaaaaaataaaaacaagttgctgaatgatttgaagggggttttattagttttgaaggactgccataacaaagtacaatggattgaatggtttaaacaacagaaatttattttctcatagttccgtgtgctagaagtacaaagtcaatgtgtgatagggtttgactctgtgtttccacccaaatctcatcttgtagctcccatgatttccacatgttgtaggagggaccccgtgagagatgattg

SEQ ID NO: 122290 - DNA, 696 bp, Homo sapiens
cacttattactgagtaaattaaaatatgtttagccttttctttttatagtcactgatttcattttcaaaatgaaatccattttattttctaactcagcaatctgaaaggaaatgaaaatataaatttagcgtgcttgtagattctgatttagaggaaacgaaagctttttctttccctttttcttttctttaatgaagtatttaacaaagaaaaaaagccgtggtcttaaagagttgcagagttccccatctttcaaaataccatctgtagtcatatcagagaaagcttcagggtcattaaacattgatgactaatgtcagattgtaggaaaatcggaactatgttatcggcggcaattttgttagtctgggttgagttacggtataaagtgggcaagatggagtgaaaacacatcacttgcttctaaatattaagctttgtgtttcttttctaaaatagaaactacaaaatgtgaagtctaagtatgattttgggttttcttccatcttggggaaggacatttttaattacaaaatttccaggcacagagtagccaaatcctagtaccgagaaatttaccaacaaaatatatacccttgttcctaagatagttgcttctcaaatcccttgtcttacttataggttaaaggaacactttctctttgaatatatctccttcaacattttatcttgtg

SEQ ID NO: 122291 - DNA, 817 bp, Homo sapiens
attttgtgaaacacaagaatattggagtttgtttagaaagatgtcatgatggcaactttcaaagttgtatttttaaacatttttaaatgtgatccataaaaaggtatttaaaattttttttctttttataggtgaaaggtatttaagcccatcttagattgaggggatggaataactcttgggatttttaaaacaggatttgttcccctttaatagtaaatactgtctaaaagcattagaatattactgctaagaaagagcagccaacaaatatgtttcgagtgcccatgggatgcctagcagtgtcctaagtagtagaatttatatgaaaaaaattaaagcccaacattgtgttgtaatcccaacactttgggaggccaaggcaggtgtactgcttgagcccaggagttcaaggaaggcctgagcaacatagcaaaaccctgtctctgtacaaaatacaaaaattagccaggtgtggtggtgtgcacctgtagtaccagctacttgggaggctgaggtgggaggatcacttgagcctgggaggcaaaggttgctgtaacccatgatcacaccactacactccagcctaagcaacagagtgagaccctgtctcaaaacaaacaaacaaacaaaattaaagccctcatctccagataattcagtgtttcactggacatggtggtgcacacctataatcccagctacccaggatgctgaggtgggaggattgcttgaccccagcagtttgaggccagcctaggcaacatagcaagatcctatgtcaaaaaataataataataatttagtgtttaatggg

SEQ ID NO: 122292 - DNA, 398 bp, Homo sapiens
cttttgggtctttgctctttttgggtctttgctcttttggggtctttgctcttttggggtctttgctcttttggggtctttgctcttttggggtctttgctcttttggggtctttgctcttttggggtctatgctctttaggggtctatgctcacctgattgagaatgaatgcctcttttaaataccttctaaggtttaatctaaactataactatcctagaattaaatctgggcccataatgcatagaaattataccatttctaaccagtctggacacttaaagagatgtttattccttttttcattcctttaacatgtaggtgttaaatgccttatagatcaaatactaaggtggggaagaaaattattttttataaaaatacaaggcataccctg

SEQ ID NO: 122293 - DNA, 197 bp, Homo sapiens
cttgggagactgaggcaagagaattgcttgaacccgggaggcggaggttgcagtgagcggagatggcaccattgcactccagcctgggcaacagagccagattctgtctctaagtaaataaataaataaaaataaagtggtagaagcaaacataaaatttcttcttctaattactgaaattttatgaaatatgcacc

SEQ ID NO: 122294 - DNA, 218 bp, Homo sapiens
cattcgggacgtctttactaaggtctgaaacagatgacgagagcgtgaagcagaagcttcaacagacaaactgtgactacttctcccctgtgtcttcaacaagtgatttcttaaagcttaaccattaaatagtacagaacttaaatggttatttaagaccctaaataatcatcaccatcctgtattttaaacacacacacattcacacacacacagca

SEQ ID NO: 122295 - DNA, 597 bp, Homo sapiens
actcaggctagaaggtgacataaagcacataggtggccacgcccccatccctgtatccacagagaagaaagaggctgtgcagcagagtggctggagcctgatctccagatccagagcactggacacacatttccaccctgccaatgactgacagtgtgaccctgagcaagggacctacctcatttccttcatctgggcaatggattaatacgagtccacatcccagggctgctgggaagattcaatgagctaattcacgcaaaccactaagaacggcgccaagcacacagtaagcgctagtgagaagtgtcagcgaccatgatcactaactttggctcaaatgcctgctcctggaagcaggcccggcgcatgcagatgcctctagaagggcttccaagagagggacagtgacaggtaccctgatcagagctactttctgaaatgacagagtgtgcaccagatcctgagcccagggtcctaaatgggtccctattctgcagggatccagaggaaacaccctggtttctctttttatttttggccctttgtgttttgtgagagagcttctcaaagaagcaaccaatcctccaggccatc

SEQ ID NO: 122296 - DNA, 319 bp, Homo sapiens
ctgtaaataatgaggattgactgtgttgggtcaaagactatcaagagttttggctttagattttaattcacaagtagtcataacaattatactaggtattaatagtgctcagaataaacatgtcttaaagtgcctggtacatggaaagcatctaataaatgttcatattagccacgcatggtggcatgcaattactgtagtcccagctactcagaaggctgagctgggaggatcactttagcccaggaggttgaggctgcagtgagctgtgattgcaccactgtactccaacctgggtgacagagtgagaccctgactc

SEQ ID NO: 122297 - DNA, 375 bp, Homo sapiens
tccatagttaaatgtttcctttacctaaaacttacaaaataccttttgaaaaattaaaacttttaagtcataaaaatgacgtaaatccccactacataatcctctcatttatattctttcccgtgtctcaaaattcatcagatctcaagcatttggcaaagctgcagacatacaaaccaagcatgaaacatgagctatgccttcatctacctgagctgtcggcagacattgttactttgacagaatatttaagaaaagaagtcaccaaaaacttaccacagcctaatactggcaatggggggtcttaaagatcagttctcatagaaccactaacaagcacgggtgcagtgtggcaaaggcagccactgtgtttca

SEQ ID NO: 122298 - DNA, 229 bp, Homo sapiens
gaaaactgcagcctgtaggacaaatcagggctgtggtgtgttttcaaaaggctaatgctatagaataaactgtgttcccaaaattcacatgttgaaccctaactcccaaagtgactgttgaagaaggtgattgaccgggcacggtggctcacgcctgtaatcccagcactttgggaggccgaggcgggcagatcacaaggtcaggagttcgagaccagcctggccaaca

SEQ ID NO: 122299 - DNA, 405 bp, Homo sapiens
aacttgttcctgactggagcagatcagaggaaatgaatacagaagtcaatcagtgttacaagttcatttttgactagtaaatttcagattgggaatcattatctttggttgtgtctaatattcgaagcccttttaaatacacaatctcatttgatactcacaataatctcagtttatagatgaggacactgaggctcaaacaggacaagcaatccacctggtcacattactagtaattgacagagccaagagtcgaaagacagaacccagatccctcagactccaaagcctcacggaaggagcagcaccagacggccgagtaggtcaggccccccatttgctcactgaagacatccccacgtgctgccctctacccccactccacacatgccaagtagttaagac

SEQ ID NO: 122300 - DNA, 405 bp, Homo sapiens
tggtaaagacagaaaaacagagcctttccctcagcgagctctctgagtacaggagagacagacacaagctcatatttatctgccataacatcactggggcgagggaacctgggggcagggttccaggaggaggtggttcttgagctgagacttgaatgacaagggcagccaagcagcagaaggcctgccaggcgaggggtcctcttaggtactgtccttggtcagaccagtttctacagccaaaggccagccctgcctcctgcaagggaggacaggcggtgatggccaggaaggcccagattctggccgaggcccaggatgccattgggcactgagctctgtccttagctcatggcatccctcagccctacttcccaagtgatccctccattgccagctcatggc

SEQ ID NO: 122301 - DNA, 242 bp, Homo sapiens
ggtccttggagtgtgaagcctgcactcctgggcactgtcgctagagagatttcaaccctgaatctcagggtgggcaacgcttccttaggctgagagtgggtaacgaagcggcatcgcccaggcagcctctgcctcgaacacctctcttcttcctccttttcttccaccccccttattcccatctgtgcggcaaggaaaaggtcagtaagcacagccctatcttggtattctctccaaagctc

SEQ ID NO: 122302 - DNA, 557 bp, Homo sapiens
ggcacggtggctcacgcctgtaatcccagcactttgggaggctgagatgggcagatcatgaggtcaggagatggagaccatcctggctaacagggtgaaaccccatctccactaaaaatacaaaaaaattagccgggtgctgtggcgggcacctgtagtcccagctaatcgggaggctcaggcaggagaatggcatgaacccgggaggcggagctggcagtgagccgagatcatgccactgcactccagcctgggcaacagagagagactccatcttgaaaaaataaataaataaaataaaataatcatatgatcaatagatcatatgattccatttatatgaaatatccagaataggtaaatctatacagacaaaacacagatacacagattgatggctgccaggggaaagggagagggggaattaggaacaactgcttaacaggtatggatttccttagggttgatgaaatagttttgaactacatttatgatagtactaaatcccactgaattgtacactttaaaatgattaattttatgttatgtgattttcc

SEQ ID NO: 122303 - DNA, 705 bp, Homo sapiens
cgcagtggctcacgtctgtaatcccagcactctgggaggccgaggcaggcagataacttgaagtcaggggttcaagaccatcctggccaacacggtgaaacccgtctctactaaaaaagtacaaaaaattagccgggcgtggtggcgggtgcctgtagtcccagctactcgggaggctgaggcaggagaatggcgtgaacccgggaagcggagcttgcagtgagccaagatcgtgccactgcactccagcctgggcaacagtgcaagattccgtctcaaaaaaataaataaataaaatttaaaaattacctgggtgtggtggcgcatgcctgtaatcccagctactcagaaggctgaggcaggagagtctcttgaactcaggaggcggaggttgcagtgagccgagatcgcaccactgcactccagcctgggcaacagagtgagactccgtctcaaaaaaataaataaaaaagaaacactgacattcaacagcaaagtggcagaggcacccactagagctcaggccatacagagcagttgttcccacccttctgtttcttagtaccactgctctggcaaagagccaggtcccactattctagaaacaaaaggtttactttttgagatagacatttatgcctgcaatctgatttttccctcctcttaaaacatactcgaattttattcgagtatggtttttgtaaa

SEQ ID NO: 122304 - DNA, 394 bp, Homo sapiens
catgccacttctcggaatccacaatgctgggctctgggaaaaggcattcgctacaacttccacagccctgataggttccacacaatcggtttcacgaagacacacaatggtctcctcaaacaactccatttcaaattctggtctgcaaacagaccccgaaatgggcctctatcttgcaccacaaacctgaatctctcttaatttagggcctttcggttgactcacacctcacacaaactttaaaaaacattaccatagtcccctttaaacataaaaagagggctatgtcttgcattcttgtatataaaagctcattacatattggggccttccataatgtttccccctattcctataaatcttgcatcttatccccaccccatcagggctggag

SEQ ID NO: 122305 - DNA, 512 bp, Homo sapiens
agtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgccaagaggggtatttttctgtggaacttcatgggtggctttcatagggaattctccatgtcatt

SEQ ID NO: 122306 - DNA, 255 bp, Homo sapiens
ccctgagccgctcgaggcctacacagcgcaggctgacccacccagggaggcagtgccagacaggcacaggccccaagctgccttttaggcatcagcaaagggatgcgttgtccttagcagtttggtgggggggatagtattctccttgggctggactcagaaggtgtctgggaggggagaggtggctgggccggcatcatggccctgcagcatccagggtgtccaagcgcctccagcttccacccttcggtggca

SEQ ID NO: 122307 - DNA, 539 bp, Homo sapiens
  misc_feature (493)..(493): n is a, c, g, or t
  misc_feature (525)..(525): n is a, c, g, or t
cattctcagctatggaaacagcagaagcaaaaacttgaagacaggcataacacagcttcctttccatcaagctaatgcacagatgctggggagtaccaggaactaacagtggatccctacagcacaggattactaaggacctgtttcattacttgattctaaggaccctggacttgatcctaggaccacaagaggcacgttctgagtatttggagctggcaagtccatcagactaagggaatggtacaggaactggttcagaggccaactcagcatgtagtcagagtcaatgcaggtctgcactggaccaggctggatcccggaataggggtcaatctgagcgatttcaagtgactcagtgagatcgaaaggcaacattcaattaatgagtctccccagaaaaggacaggctgcagaactgaaactgaacaaattccatcctgagcggaggaccatcgtggggggctcaatctggactcactggaacctctanctcccaggttcaagggattcttgtgcctcagntacctgagtagctg

SEQ ID NO: 122308 - DNA, 662 bp, Homo sapiens
ctggaccactgcagtggcctcctccgtggtcttccatgtgccctcctcaccccagctttcagtgtgttctccactcgagcccactaattgggtcgatcctctgctcaaacctctacaaggtggcccacgtcactgggagtaaaagccagtcctaactttcatctataagcccaacttggcacctgtactttcctctcctcctgtgtgtccccaccccaattctatgccagtttcagcaggctccctgctgttcctcaactctgcagtctgggcctcagaggcacctcagcctggtgcggcctcccgactcatctctttccagccttagctcacagaccaccttctcagggatgcctcctggtgatccagctttaacactgcaaacccacctcagaccctcccagcccccacaactgctgcatatttctccatatcatgaaccaccttctaacaagctgcatcatctactgcttatgctgtagcccccactgcaacataagctccatgaagatggggggttttgtccactgctgtctaactgagcctggaaccatgcctggcatgtagaaggcacttggtaaatacctgttagatgaatggctcgattctgggaactcagaaataaataaatgaggtaggatcttggccctccagaggctaca

SEQ ID NO: 122309 - DNA, 477 bp, Homo sapiens
acatgtatactgggaaatatatataaggaggtcatactagcagagtatgaattataaaaaaactgtagaaaaaactaaggtcccttagtagaacagtagatagagacagtcataaaagggaatattagaaagcaattaaatgaaaaaattaccatggcatgcatcaacatggatctcaaaaatgaatactgagtgaacgctattacatctggcatgacataacatataaaattcaaaaccaaaaagcttcattaattattggggggatataaataggaaaactgaaacaaaaaagcaagagaatgataaaaacaacatttagaataatggttactcctggggagaagaaaagggaagaagagtggggcagggcacacaaggaaactgataataaactaacactggataatggatacatgagaatttattattttcatatcatgtgtattatattcatttttttgtatacaggaaata

SEQ ID NO: 122310 - DNA, 275 bp, Homo sapiens
gaattacagatttcttttttgatgacggtggttagggtaagaagcggcttttataagctttatttatctcttttaattacctccttctcctgtctcaatgctcacacttacactcactttaaaaaatttttatctttcatgggatctatatctaaataacaccacatcatatgtaaattaagaaacattccaaatattctccgggacattgaaaggaaatcaagcaaaacattctgtaatgtgtaggcaactttaaaagtgcttgaggcagaagc

SEQ ID NO: 122311 - DNA, 326 bp, Homo sapiens
ctttggtagggtgtgtgattggagagtgttctttatctccatcagccacccccttggccttgctgcttcatggataagacaggccactcccttaatgagtagccatcattccatgctccagggcagcttgtctcttgaggtgggtccatatgccattagacccatccccagcattagggattcattccttctacctaaggagttgggctgtaataaaatgctgttctctgtagcatgacaccaggcctagtgtgaaagtgaatttgtggatgtaatccgttccagatgaaccccaatttggctgagaggtagcaggcagaaattag

SEQ ID NO: 122312 - DNA, 394 bp, Homo sapiens
ggaaagataaaggtaactattttaaacaaggacatttgaggagtgcaaagtgggaaggggtaaagatgagttcagtttgggatatattaaatttaaggccctggtgagatagccagatgagcacacgagttaggaagatttgcagtcccgtgtcctttgctccatgctctgtggtgttggacaccttatttagcttcttgaagtctcagctccctatctggcagccgatacttccctgtaaggattaaagtgagacagtgaataaaagggtttagcttattgcctggcaattaagtatcagaaagtatatattaatagggtgatgaaggccccgcgtggtggctcacgcctgtatcctagcactttgggaggccaagacaggctgattgcttaa

SEQ ID NO: 122313 - DNA, 272 bp, Homo sapiens
aaggattgaaaggagaggagggttcaatgaccaggggaaggattggaaaatgaggtcccataagatcttatatgtcatgctattcagtttgcatggagggtcttagcttgaaatgatttatctcctagacctttattggttttttgagacagagtctcgctctgtcacccaggctagagtgcagtggcgtgatctcagctcactgcaacctctgcctccccggctcaagcaattctcgtgcctcagcctcctcagtagctgagatgacaggt

SEQ ID NO: 122314 - DNA, 143 bp, Homo sapiens
tgtttttcttgcaagactattgactgcccaccattcattctgctaaataagttgagtagggaagacctgttgcattgtgagtagatattcataaactggaatgtgagccatgtgtaaaaaactttggtttcaactttaatggt

SEQ ID NO: 122315 - DNA, 609 bp, Homo sapiens
ctttttcaccagacgcatatatctttttcaaatatcaaaagatagtaaagctatgcatgtaaaagtcataatagtaatagtaattataagtattataagggtaagaataatgtacatgattcttactgactcccaagcattggctaagcactttaacttttcaaaatctcagaatgctatgctgtacatatgataagaaaggagaactttcttagtttagaaaactgagttgcagaaaggttaagcaacttgatcaaagcaaattagtaatgggaagagcagaaatttaaacctaactcatctttcatacctatgaagatgcaaataagtcaaccaattacattggtgtgtaatatatttgccctcttgatgaatactgaaccagagttagagcatcttctattggtttcatgaaaaagcattgacattatacacgattggtgtgttctacttggaaatcacacttggttactctaaacattatttgaataagaagtggctaataatttgagcagttatttcaaaatatttatgtactattactacacagatggattactcttgagcttggatccaatttttaaaattttctaactcatgtgtacatga

SEQ ID NO: 122316 - DNA, 565 bp, Homo sapiens
aaaagcctcccttcaaaggtttctctgtgatacctcactccaacctaccaaaacataaggactgagtatatctatatcatttcttaacatcaaatgctgaaataccatgattttcacagactcaacatttcatatacagtcgctgcttcagagaactgacacttttttactaagcacttcctctcttcaagtgtctgatgtgacataaatgttttaaaagatcatcaaaacaaagttaacttcaaaatcgacatttcggaaatgtttcaagaataaatcatgagccaaccgtcagcatctgtattttatccagagaaagctgtcattcacactcaactcttcggaatggagatttcatttcttacctgactcgggctagtcttttcttcagcagctgtggaatgttgatgtggatcttcctttgctccctcagagggttctcttataattcctgcctggccccctggatctctgaagacctttggctccatgctctcgcttctctttgccctatccaagatcccagatgccacagaacctcctgctgtggagtccactagcccac

SEQ ID NO: 122317 - DNA, 530 bp, Homo sapiens
tacaggcatagcagatgcaaacagtgatgagctaaggatgccttttgaattgaggaagaaatctttcagaggcgtatttctgtgttttaaagagtgggacagtttgctcatcacccaacagatggcagtaaatgtcagcactttgtccacactggtggtctgactccctttggaagcccttcaatccttagggaatcccaattcccatggcatttcattctcttttgatgacttcatttcatccttgaaaatcccctagggaatattatctcattttagagatgaaaaaaactggaacttagagaagttttgattttatgctgttactgagtttttaggttttttttgtcatctaattgtactgtgttttgtattatccatattttgcaattaatccacatttccttaaaatttcatggatccttcctttgctttttatttttgttttgttttttttttttgctccagtaagtgtcttcaataatttcattcaaagaaagcaagataacctagtgtctctgaagaaaaaa

SEQ ID NO: 122318 - DNA, 357 bp, Homo sapiens
gttatatcttaaagtgagttactttgggtgaggtaatgtaggtggcagtgcctctgtttgagaattattttattttgtcctagattttggaatacagagtacttacgaggtcttttatttactccgtttatttgtattgtctaaaccaagcctttaatactagtgtgtgctttggcttggttataaaatatctgcagcaaaataatgataatttggttgtttggaaacatatttatacagagaggtagagtatttaggccaatggctgtcttagttgatgccccagagggcagtctagaaattagcatatttagcaaacaagctggtctacttttcctttcttacacttattcctcc

SEQ ID NO: 122319 - DNA, 277 bp, Homo sapiens
ggagatactacagcatgtttggatcatgaccggaatgatttagtaagaaggaaaagccaataatgtaagaaaggcgattgcaggagcaaagactttaaggaataaaaaggacaaaattgtttgtttctcagggaagtataaaagaaggtcatcatctgacattgagatggaagaaagggtgtggaaaatcaaagagaaagaggaaaatgtaaacagacatctttaaaggagaggacaaatgaattaactagggaaatgtagtagggtcacctactgg

SEQ ID NO: 122320 - DNA, 656 bp, Homo sapiens
ttgtatcacagggggggatccctgaaaatctatcttttaagcttcaaaggactttatgccaaaaataattcaggacatagcagatcctatcacttcactgtttaaaacattccagtggtttcccttcacacttaaggcatattaaggaattttttaaaagtaattctataaagccaaatataatctaatttcttgctacttctctgaccccatctcttatcttcccctcacttattctagtctccacttcactggcctccttccctttatctaacacactaagtaagctcttactttagcacttcccgtttctttgccctggagactctttgttcatatattcttaatatttgcttccttgatttattcaaatctctgtgcatgtattacattctccaggaggtcctccctagttaccctatcacagcagcagcctccatcactctctgccttattctgcttttcttcatagcactcatctctgtggtcatttctgttacatgtctattttttattatctatagttcctactacaacataggatccatgaggacctggactttattttgttctctcctgcatctctaggcactgtctaggcatgcagttatagttgaataattttggtcaacaaggactcctttataattgctaat

SEQ ID NO: 122321 - DNA, 381 bp, Homo sapiens
tcttttttttcctgatatccatgacgatttcacaaaatgccccaaaattccattaggaagtaaacatgtcttgaacaagcaccactttataattattaggtgttttaggttgagtttcttagaagcagaacctgaggcaagaattctgtgtataaatgttttattgagggagtgaataaagcaggataggacaagggaagaagataggcaaagaaatgggttcagaggaagtctagtctgtctgatcccgtggggagctctgaagtatgaattaccacctaaaatgtatgccacttacacaaaaggataccagcctcttatatcccactatcagtcaggggtacaacagtcacacttaggggcacttgtaagtgacatgag

SEQ ID NO: 122322 - DNA, 103 bp, Homo sapiens
acatccccagctctgtgactcttccaatccattctccagactacagccaaggccaaggtaatttgtccaaagtgcaaatctcattccaccagtccctttgccc

SEQ ID NO: 122323 - DNA, 301 bp, Homo sapiens
agtgaaagtggaagccaggatttgggtgtgtgtgtgttgaggagtaaaaggccaatggagaagaagaaggagtaaatataaacaactatcttaagaattggcaatgaagggaaggtgatacagggaagcacatacaagttttagaagatggtagagagcttaggaagatcttgtatgactgaaaaccaagagcaagaaaattaatgggggtggggagaggagaggagaggagggagtgataccttacataaagatacgtaagagaagtgttcccatttaggatttgcttcctggcatttct

SEQ ID NO: 122324 - DNA, 397 bp, Homo sapiens
tgagatcgcaccattacactccagcctgggcaacaagagcaagactccattgcaaaaaaataaaataaaataaaaatcacatccctggttcaagaactcaaagaagagaggtttaaagaagaaaagaaaaaagaagagagatccagactctctaagcaacaagaagggctggcagagacgttatctatgctggagtccctggaagaggccatgggagtcaccccatcacaaggagcttttccacaccagccaggcagccaagagccaagccctgctgctcccttccccaggagggcttgggtcttagggcagcgctgttctctcccctccactcaggcctccagagctgccaggccaggttctcccatgttgactccatccgagggtccctgaggcc

SEQ ID NO: 122325 - DNA, 452 bp, Homo sapiens
agaacacattgaaactgttgctgggtcaagttcaaaaggattccaaaacagtaaaaaaaaagaggaagggcccaccaagagcacagaggtcttcatcgctccagactcccagatacagcacagggaacaagaaatggcagaaccatcatttcatagacaagtggtcaagatgtcctcaaagccgtacagctctttggtggcagaaccaggaccaaaaaccaggtctcctgccctgctggagaagtcctctttccggtgggccgtgggctgcctccactgccacccaccatgttggaggaaacgtaggtggggaggcacattcacaccaattagggttatacaggatgcccagttacattggcaattcaaatagtaagtaatttttcatagtaagcatttcccagatatttcatgggtcacacttattctaaaaaatcttactataccagaaa

SEQ ID NO: 122326 - DNA, 183 bp, Homo sapiens
cacctggcgcactcctctgtcttaaagagaagaggccagttcctgagagggctgtgggtggcccgtgcacactggactgctgtccccagctgtggacagagccacagaggggctgggcttccagctgtcctccctgtgctcccgcagggctgagtcccagcagcagagaacaaagcctgcctc

SEQ ID NO: 122327 - DNA, 838 bp, Homo sapiens
tttttgtgattgggggcccggagggaggaagacaggttggttgctcagcagtaaggtttgaattaaactctcttcctcagacacctaagtcaaaaagatgaatagaaagcaagggacatttttcactcactggcatccttaagctgaccctgagaagttattagtcctctgtgcttccgttttctcatctgtgcaatgaaaataataacagttcctcttccataacatcgagggtgcaaggtttaaatgagataatatgtgaaaaagcccgaggcactgcagtgcaaggcatacagcaagtgctcaatacatgtttagctgtggctgctgctgtggctgttttgtgaaaaaacaagaaatcactttggcctgaggaggacttggtgtccctgcttcactgcctctcacaacacctctgggactcgaaacccgaggtctgcaatcaggcagcagagttagaagctggaaggcttcctggaggagtccacagatatgagatgacccaacccaaatggttcccaccacagctttggcctcagagcttggggcctcggccagtgttctgactttgctgggcttcagttgtcccatctataaaatgggcacaacaaaaatatctccctgacaggactgttatgcacattaagtgagatgaaatacatatcgggccaggcgctatggcttatgcctataatcccagcactttgggaggcgagaggatcacctgatgtcaggagtttgagaccagccaggccaacatggtgaaactctgtctttactaaaaatacaaaacttagccgggcgtggtgacctatgcctgtaatcccatctactcaag

SEQ ID NO: 122328 - DNA, 486 bp, Homo sapiens
aggagccccgtccagtaaggtgtgcccagcctagtttttcttttcattcacttaatagtgtcttttgcaaagcagaagtctttaattttgatgaagtcaaatttaatcagtcttttcttttatgaattgtgttttggtgtcgtatctaagaaatctttgctacagtcacaaagattttcttctatgtgtaattttagaagttttatagttttaggttttacggtttaggcctatgattcattctgggttagtttttatgggataagatatggattaaggtttatttctttgcatatggctacccaattggtacagtactatttgttcaaaagactattctttctccgttgaattgccattgcatctgtgttgaaaattaattggccaaagtaaatgtgagtctacttcggaactgtatattttgtaccactgatttatgtgtctatcctttatttaatactatacagtcttaagtattgcagcttt

SEQ ID NO: 122329 - DNA, 493 bp, Homo sapiens
atgagaatacagtctggctgacaccttgatcgcagccttgtgagtccctgagcagagaaatcaactgtgaaataaatgtgtatacagggcaatttagaaagccactccacatacctagagaaatatgcaggctcagaagagacctgggaagactttaagctttcacctcaagctgatcctgagataccctcaacagttggtgtggggagacgagtaaatgcttgggggggaaaaaaggagaatctgatttccagagttataagattcaaatgtccagttttgaacaagaaacaatcacaagaccctcaaagaaatagaaaagtatggcacgttcaaagaaacaaatcaacagaaaccatcactgaggaagcgctgacagcagacttactagacagtaactttaaaacaactgtttgaaagatgctgaaggagctaaaggaaaacaaagacaggagaacagtatatgaacaaaatgagaatatcaataaataga

SEQ ID NO: 122330 - DNA, 767 bp, Homo sapiens
agattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccaga

SEQ ID NO: 122331 - DNA, 236 bp, Homo sapiens
ttttggtgggggagggcagcagcgaaatagtttggcagccttctttagatttccttatggtttgagtcatgttaaattcttcaacagaagaatttagctctgccttatgttgtcttgaataccttacttgggatttgggagaactgctttcccagttcctgagagaacctagggcaagttagaagaaaacttaactcctatgctgctgaaagaaaaccataagtttcaagagatcc

SEQ ID NO: 122332 - DNA, 167 bp, Homo sapiens
ggtcgactactactactaaattcgcggccgcgtcgaccaagcctgtgggggcggaactgtcactcccagtccacaggtgaggagactgggttccctcagagttgagccgcttcccacatgcacacagccacatgtgatagatccaggattcagatcttcacctcagg

SEQ ID NO: 122333 - DNA, 285 bp, Homo sapiens
  misc_feature (15)..(15): n is a, c, g, or t
tagaggatccgggtnatcgatgccaccgaagctgtgtgcactctcatggatccgaagccaagcgtggactagggtgtttatcgacgccatgcatgttgttttctaccgagagccctgacatatttatctctgtgtggtctcctgtcaactctttgttggccgggatcaatatgtgtatcggaagacaggtggggtgaatactgtttaaaacaacatcaactctcacctgctggagtcagaactcgccaccagcacgtgttgttcaccagctgggttcccccacca

SEQ ID NO: 122334 - DNA, 251 bp, Homo sapiens
ggggaaaaagagctatggaggggaagttagctttaaagaacccagaacccatgcggaagccagacaggcagcgtggccactctcctgtgcatccagatctagagatgattataaggaagagctggagggcagaagaaagaggtcaggaggcatcaccaggtcagagaatggctggggtgtaattgagaagttctttggtggtggtgaccacgagctatgtttaagggggcaaaggaagcagtgaagtaaat

SEQ ID NO: 122335 - DNA, 201 bp, Homo sapiens
aaaaatccaaaaagttacgagttctaagaaaacctgagaagcttggacaaagtttttatcgtgacattagacaaattaagtttttttcactgtattatcagttccaagataataaagtatcagaaaattccaggtgataaaaggaaaacacacatcacatgctaagaagtctcagaagtgaaataattaaaactaacaaaa

SEQ ID NO: 122336 - DNA, 450 bp, Homo sapiens
tttagataaggtggttcaggaaaacagcaaaaatctgaaggaagacatagaatcagagatcagggaatgtgacccagagggggccaaatacaaaggccctgaggcaggagggctgaactgggtgatgtagatggagattggtgggagatgagatcagaaagggggcaggaaccagatcaaagaaggtcttggagagctttggggagaaccttggtgctatggttcgaatgtccctgccacaactcatgttgaaataaaaaattcaattgctactgtcttaagagatgggactttttttctctttgagacagggtctcactcttgtcccccaggctggagtgcagtgggttgatcatggctcacagcagcctcaactgcccgtctctactaaaaatacaaaaaaaaactagccgggcatggtggcagacgcccgtagtcccagctactcgt

SEQ ID NO: 122337 - DNA, 436 bp, Homo sapiens
tttagataaggtggttcaggaaaacagcaaaaatctgaaggaagacatagaatcagagatcagggaatgtgacccagagggggccaaatacaaaggccctgaggcaggagggctgaactgggtgatgtagatggagattggtgggagatgagatcagaaagggggcaggaaccagatcaaagaaggtcttggagagctttggggagaaccttggtgctatggttcgaatgtccctgccacaactcatgttgaaataaaaaattcaattgctactgtcttaagagatgggactttttttctctttgagacagggtctcactcttgtcccccaggctggagtgcagtgggttgatcatggctcacagcagcctcaactgcctgggctcaagcagtcctctgccttggcctcctgagcagctggaactacagatgtgtg

SEQ ID NO: 122338 - DNA, 548 bp, Homo sapiens
ttcggatcggcaactgctgctgatgccatcaaaagaataggtttatttctcagaatcttgcagcctaggatcctttcgtaaggtaatttgacaatacgtccaaaaacttacaactcggactaaggagtttccacttctagaaaggtatctggaaatagtcacacaagtaactaaatgtaaaaaattaagtatgttcctcaccttaatatttataacagaaaaatttggaaataacttgtcaataggtacatacttcatataaatccctataatgggatacaatacaatccttatagttaaaatttataagacaaaagtgcccaaaagaaactagtaaagaaaaaagaaggctagaaaaaagcatgtataatattgtcccatttagtagttaatcaaacatcagtaaatagaccacagagagataaattagtcagccagctagtcattgggaaggatacacaaaactgctaacaatcataatctgggtgccgagagtatgaaatttacttcattccttacatcttatggtactctgaattatgtgtccc

SEQ ID NO: 122339 - DNA, 376 bp, Homo sapiens
gtttccagggtctgacatgagggtactgactctaagatatacgcttccactgggaaacctatcaatccaggccgtgagggaaggccttaaccctcctcagcgctggagctgatttagggaagagtggtgagtatatgaggagtggcattgggatgtgctttgaatctccagcacattcccagtttctggtagaatggagggaagccattgctgattctacctcagacaggacctcctagaagtctgccaggtaactcagatggttgtcacaggttgagacaacctcccaaatgaaatgtgtgatataatcttgactggggacaaactccccaggccagaactgagagtgagtgggaagtgtgctgcagcagcaagc

SEQ ID NO: 122340 - DNA, 346 bp, Homo sapiens
cctatcctctttgggacccaccccccacttcatttggaacaggcagcacgctcagtgtttactagaactgaggcttaaagtgccatctggtgccaaaaaggaagcaatgacgtagtgggaagaaaggaaaaagaaagaatatcaacatgcaaattgcaaattacaaagaatctctaggcaaacatatctaataaccaaaaaaaagcaaagcagagaagactggaacaaataactaatccttcaatacaaagatgtacatttacatccacaagacacagtagcaaagaccccaaaagagcaaagaccccaaaagagcaaagacccaaaagagcaaagaccccaaaag

SEQ ID NO: 122341 - DNA, 397 bp, Homo sapiens
tctttctttgattgtaatgacatttatgtttttggagagtataggtcagctgttttgtaggcgttctctccattttggtttgtacagtgtttcctcatgattagctttaggttgtgccattcgggcggggctttcacacaggctgagttctctgcaatgcagcatctggaggcatctgctgtcactcacttccattactggccaatgttgactttgattatttgatttgttgaaataatcaaagtcaacatcctgccatgtttgtccatggttaagctactatatactttgtatttcataaatatcttgtataaagatactttgaggctttgtaaatatctggctactactcagaacttcacccacaagataaagcatttcattggtgatttgtgct

SEQ ID NO: 122342 - DNA, 617 bp, Homo sapiens
acttctggagctctcttctagtgcaaagtttttcaagcttgattttaacagcaggatcttctttttttcccaaagaaatccttacatgaactccaaattgttaattagttaaaggagttccagttgaaggtggtggggaaggggcaggagcaaattgaagtatttcccttcatcttctctgtcccactttgcagcccctgggacaccaagagactgatgcctaaaggtaaagtcacttgttcaaagtcacccagcaagctgatgaaaaagcctgcagaactgtgaatcgaatgtaggtttcttaattccagatacgttgttctttccacactgagcttttttctatataaaaggaagtactatatatcatgggtttaagtaaaggaatacacacacacacacaaataaacataaatgcgaggggaaatgtctaaacagaacacaccacctgattaatatgaacattataggggaatagaattagaagggaaccagcaattttaacgactgacaatgatcctatgtggatgaacctatttgagaaataacaatatttgttttgttttgttctgttttttgagacagagttttgctcttgttgctcaggctggagtgca

SEQ ID NO: 122343 - DNA, 989 bp, Homo sapiens
tcccagctactcaggaggctgtggcaggagaatggtgtgaacccaggagacagagcttgcagtgagccaagatcacgccactgcactccagcctgagtgacagagcaagacgctgtctcgaaaaaaaaaaaaaaatagattaaaccaactaaaaagaaaataataaatccagcagagagagctgaataaattatcatggcataaactacccagaatgcagtagagagagataaaaacatgaaatgctagttaaaacacaaagacaaggccgggcgcggtggctcacgcctgtaatcccagcactttgggaggccgaagcaggcagatcatgaggtcaggagatcgcgatcatcctggctaacatggtgaaaccccgtctctactaaaaatacaaaaaattagccgggcgtggtggtgggtgcttgtagtcccagctacttgggaagctgaggcaggagaatggcatgaacctgggaggtagagcttacagtaagccaagatggcgctactgcactccagcctgggcgacggagcgagactccatctcttaaaaaaaacaaaaacaaaaacaaaacacacacaaagacaaaaaaactaaagtctgtctacttggaattctagaagaagagaacagaaagaatatagataagatagtatttaaagagataatggtagaaaaatttccaaaattaaaatgcatggaagttcagattcaggaaacaaagaattccaagccaaacaaagcacatttgagggcttcttaacaatgtgtttcaaggaggaaaattccaaaaggaaagtctgaggtacaataaagaatgatgaaaaatgaaaatggtatacataaatgccagtctaaattaaagaaaagggctgggcacagtggctcacaccggtaatttgagcactttgggaggcagacggactacttgagctcaggagatcgagaccagcctgggcaacatggcgaaaggccgtctttactaaaa

SEQ ID NO: 122344 - DNA, 278 bp, Homo sapiens
gtgctgagattacaggtgtgagctactgcacccagcccacttttttaagtacagaaaagtaaaaataagaaagctacaatgtctcataatctcttcacctgtataaatctctttgatgttttatgtgattagaacattcaaatagcacaaaaaggtttaagataaaaaagcaagtacttcccttctcccaagtattaatctgcaaagtttaactaacctcaaacaattctatgtgtaaacatcttgtcatttatttagatagaattagttatatggac

SEQ ID NO: 122345 - DNA, 153 bp, Homo sapiens
ttttggggtggtttgctatgcagcaacagctaactgacacaggacctactctctactgagaactggaataggcatggaggaagcagtggtgagtgagacactgctcacaaccttcaggagctcactatctgtaggggaaacaacaccaaaaaa

SEQ ID NO: 122346 - DNA, 275 bp, Homo sapiens
cccggtctctataaaatacaaaaaaattagccaggcgtggtggggcgcacctgtaatcacagccactcggcaggctgaggcaggagaatcacttgaacccggaaggaggagattgcatgagccaagattgcaccactgcactacatcctgggctcaagcaatcctcccatcttgcccacccaaagtgtacaggcctgagccactgtggctgacctactttcattttttatattcagggtttcatttgtttgtttattttgagacagagtctcgct

SEQ ID NO: 122347 - DNA, 734 bp, Homo sapiens
ctcccaccctggcctcccaaagtgtgggattataggtgtgagacaccatacctagcagaacctaactcttagatgaagaaactaagatccaaagggaagacacagctcacctcttacaggcctatgcagtgaacgctatttgtgccctgtactctgttatgggctcttattacttcatctaaatcccatgacaatcccatgagtgagatattaccagctctgttttagagatgggaaagcagattaactcatccacagtcacacagctagtaaatggtaaaactgggattcatgcctaagtttttttgaccaagttttattaaggactactttaatgtattcctgataagaatcctccatataacttttttaaataatcaggtcacataaaataaatcaagtgcattgactgaataaactgaaatcttgtcacatatcaactaatgatggaaaccttgcaactcaggaagagaaaaaagaaaacaggaaggagaaaaaagaagaaagggagggaaaaaaataaaagagaggcaaggtctgagaattagaggaaatttaatttgatggtaagagcttgggtttgattgtctgttcttcagtctgctggttacattaaccagaacattgggaacattaatttctgcaaggtcttagtttcttgaaaatggggataactttgattgtctgacaatacaattgctgtctatctccccaactagactataagtaccaca

SEQ ID NO: 122348 - DNA, 333 bp, Homo sapiens
acttaatgtgtttagatgctaaacaggcagtaacggaagaaggaatggctgggggagccctgatgagaggtcgcagcacatgtaggaaggagaaaaaagaagaaagggagggaaaaaaataaaagagaggcaaggtctgagaattagaggaaatttaatttgatggtaagagcttgggtttgattgtctgttcttcagtctgctggttacattaaccagaacattgggaacattaatttctgcaaggtcttagtttcttgaaaatggggataactttgattgtctgacaatacaattgctgtctatctccccaactagactataagtaccaca

SEQ ID NO: 122349 - DNA, 473 bp, Homo sapiens
  misc_feature (394)..(394): n is a, c, g, or t
aattagtgcagagatatgtgaatgaagggacagatctctccatgcagtgccccaggcgctggggagccatattgttcgtgctgggtgatatttttccaaacaatactccgcagtgcagcaccagccaagcaacagcccagcaaccacatgcaacctgttcctgccagtggggatcaccacattccgtacaaaaataaagagctgtgtttactggccaattcactcatcaagaacactctgatcccagagcaagcatagggaaccattatattcctccttcacagcccttccaggggaattaggaatacagctctgctgtcattttattttctgcccagagccctatgaaagtgaactctgattattaatattttaagcatgtaaacagcaaaancccatccatgtcctcggtcttggtatcaggatccggcaccgtgtgggaggacccagaagctgaggggcaggctgtggtt

SEQ ID NO: 122350 - DNA, 377 bp, Homo sapiens
tgatgtgaaaatccctgcgttcatcaacataacccagttagggtcgcactcatcacggggcccccattgcctctgggcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccagggtgccactc

SEQ ID NO: 122351 - DNA, 617 bp, Homo sapiens
gcaagtgtaccaagaaaggggctggagaaagagatgagaaaaacagctaaaagaaaaggctgactttgtttatttcttccaattattctgcatgcccgtgttctacgtcaccatgaaaagctgagtgactgccacgagctttctgatactggcaatgaaggtgaagtgcattcgcttgggctgagctgtcatactctcttctctaagctcccttaggaaagggaggagaaaaggacttgctcgctgccttggccccgactccctgagcagccaatactggggaaattttttgatcagaggtaactgacagtctaggccttccacaaactgaagctgttagctactgtcattcagacgatgacaaagttgaaaagaaagcatccctgtcttgtgccagttttcaaagggaatgcttccagtttgtgcccattcagtatgatatgggcggtgggttggtcatagatagctcttattattttgaaatacgtcccatcaatacctaatgtatggagagtttttagcatgaagggttgttgaatctggtcaaaggcttgttctgcatctatggagataatcatgtggtttgtgtctgaggctctgtttatacgctggaatgg

SEQ ID NO: 122352 - DNA, 337 bp, Homo sapiens
ttggtgagcagaaagaaaagaatattaataaagaaagcagctgaaaatctgtataattcgcttgtagaaaaagtactagaaagtaatagtagaaagaatagaaattgacctaataaagaattatgggtacaagaatctaaaagaaagagcttgagaggcaagggagatggaggagtccaggaaaactctaagtatgtgtaacagcagacttcaaaggagctgttgacatagtttaattggggagtactctcatgatcagtgtcttggaagagtaagggaaaagtagattggggcatagccctaagttcaactactgctatgcaaacaaaggccccag

SEQ ID NO: 122353 - DNA, 374 bp, Homo sapiens
aaggcagaacaactgtgtggctatggcagagactgctaattgtttaccccatatcgattcacccttccttccttagaaacaaaaccaagattttattcaagggtccaacgcattaaccatgagaatacatttccctgtttccctgggtacagatatggtcaatgagagacaagtggataggttgtatcttctaggaagactccttaaaggcgaccgactcaactcagcaatgtgctcccttcagcctccctgattccccttctggttggagatttagtgatcagtttgcaccatgaaatgacactgagaatgaaagtcccctgctgaggatggtagagcagaacgataaaggaatcccagttctctactgaccc

SEQ ID NO: 122354 - DNA, 389 bp, Homo sapiens
tcttgatctcctgacctcatgatccacccgcctcagccacccaaagtgctgggattacaggcgttgcccaccgcgcctggctgaaaaaatacaattcttgttccattatattttaactcttgtctaaatcagttttgtggaaatcatctaacttgaaccctagtgttccattattggaacgctgagcatgtgggagttattcatatcctactgctcaaggtcatcgccaagatctaatttttccactcatgcaaaaattaaaaaaattgcagcctccggcataaatgggttaatagcagagaaatacctcagtatttagagactacagaaggtgactttaagttgttttttaaaaattgtggagttattcaggaagatgatgatgttga

SEQ ID NO: 122355 - DNA, 304 bp, Homo sapiens
aaaaaccgtgaagagccctaaattctgtgcctgtaatcctggcggggtttcattttacaggttacaaataacccagaatagtaactattgatggtttaattacttgaaagtgccttataatcacgaagtcattaagggtgttatgagatctaaaaactacaagtcatgagggggttgtgcatcaagttatttggcaactcattgatacaatatgaggtggaatgaaagtattttggactaaagcattctaaatacttcaaatcaaaattgagcacacgagtgccaatccatgtccatccctaac

SEQ ID NO: 122356 - DNA, 467 bp, Homo sapiens
acaatcttacaagtaccttccctaactccccttttttgagacattcttgagattttgttgcaggactactcttccttgcttatcatatttaataaatccagcttagtaagataaccagtgttccctggtggtggttgcttcaacaggaggcaaccacaggagccaggagagcaggaagtagggtgaggcattgctttccatgcctcactctgtttcagtactgactctggctgtagctgtacctgcccaacccccaacagtagcttctgcttgggggccccttctttatgagctccaacaacatatcttcctcctcttgtcccttcaacttgggggcagtaatagagtttgaaattgctagcttctgccgcttcaatattcctcatttgttcccttatccttgcccattttctacacaacttcccctcattaaagagttttttggggggttttttgtttgtttttgt

SEQ ID NO: 122357 - DNA, 382 bp, Homo sapiens
agaacattcattctagagtcagggtccagaaccgtggtattcattctttcttcaccggtctgtgtggagccaggcattccctttcctaaccagtcatttttttgatgcggagaaatccagaactaacactagatcttggggtgtggtcaagtcctcaaaaagaaaacattgaaggtatgggaaataactagatggtgcctgtcctcatgggtctcattttctccagaggaatgataaatagcatgaaatttgtcaacagataaagaaaacaacagagggtaattggtgaagaatgacgtggtggggccgggtgccgtggctcacgcctataatcccagcacttcaggaggctgaggcaggcggatcacctgaggttgggagt

SEQ ID NO: 122358 - DNA, 326 bp, Homo sapiens
ttgtaatcaccacgtgcaagctcattcacacagtcttacggactaagtctatttgtctctgtatcctctacaactatcacgtgtcgagcacatggcaggtgctcagtaaaaagttctaaatgggctgggtgtggtggctcatgcctgtaattccagcactttgggagtctgaggtgggtggatcaggaggtcaagaggttgagaccatcctggctaacacagtgagacaccttctccactaaaaatacaaaatattagccgggtgtggtggtgggcgcctgcagtcccagccacttgggaggctgaggcaggagaatggcagggag

SEQ ID NO: 122359 - DNA, 471 bp, Homo sapiens
cagggactaagaccaaatacagttatggtcccttagctacagggagatacttggaagaatgatgcatccttaggtgatttccttgctctgtgatcatcatagagtgtccttacaaaaccgaaatggcttagcttactgcacacctaggctctgtgctatagcctgttgctcctagaatacaagcctgtacagcacagtactgtgttgaatactgtaggcagttgtaacaccatggttaagtatttgtgtatctgaacatatctaaatatagaaaagatacaataaaaatgctgcattataatcttacgggagcatcatagtatatgtggtctgtggttgactgaaatggcattatgcggtgcacaactgtatttatttgtggtaaatctttactttgaggccatactaaaatttttaggaggaaatcagttctagccagattgtgtgaccaagttcaccaggaccattttt

SEQ ID NO: 122360 - DNA, 440 bp, Homo sapiens
gtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatcaggaagtcctaagtctgaatgtcagctccaccttctctttttctcttatattgtggtaaaacatacataacataaaatttaccatttcaaccatttgaagtgtacagttcagtgacatttaggaaacccacattgttattgggtaaccatcatcaccatccatctccagaacttttttcatcttcctaaaatgaaactctgtacccactaaatagtaactgcctactacccccaacccctggccg

SEQ ID NO: 122361 - DNA, 524 bp, Homo sapiens
taatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaacc

SEQ ID NO: 122362 - DNA, 665 bp, Homo sapiens
actggaactctctgatcaaggtacagatataagacggtgagaaatccctgtgtactcttcaacacaaccctggccctttagggaaagcaggtgttctgtgcagggaagttcccatgactgtcagataagatgtgttgaataccaggattttcacattttccatcctggctgctttagtgaactcctatcttaaacacatgtgcctagctccatctccatggagacggctgttttaactgactaggacattccacttgtgactcacaccctctggggcacaccagtgagctccattttccacacctgcagccaaggagtactgtgggtcacaaaccaaccaattcaaataggtttgaaactgggagagaagagaagaatgcttctgagcttcatctcagctggagaaatggggtagaaaatggggctcaggcccaaacagcctttggcgtgagggtcctagaaaggaaggggaaggtcctcaggcccccagaagtaatggaagagtgtctgattcacagctctgagttcagactctgctggggactagcctggaagcattctgtaccccagcagggctagcctagaaccacactgtgaaacctggcgtgcttttccctaagttacctggagtatgggaagaaaaccccatttccagacaccaggga

SEQ ID NO: 122363 - DNA, 493 bp, Homo sapiens
caaccgaatagccacatgcaaaagaatgaagttggaccccctgtctcacaccatatacaaaaattaactcaaagtggatcagagacctaaatgtaagagctaaaactatagaactcctagaagaaaacacaaaggtaaatcttggtgaataaagcaagatcagaatggcaggtcttagcatcctggcccggggacagcatgggatgcaagcaacaaaccagggctcctagctgagctgggcctctcgcaagggacaaaccccatgcaggctgatcactgagggctgcttcacatgctcctggctgacatggaactaaaaaggggagggctgctttggctagacaggcccttcaaatttcctaaccttgttcctggaggatttcccagcagtccctatccttcctccaaagtttcctgagattcagacgagagagtcacagaacaggtgcaaaatgagagagatacaagggaaatggcaaagaaagagaaagag

SEQ ID NO: 122364 - DNA, 417 bp, Homo sapiens
tccttcaggaccacatgatcattgtgagtggctgggtaacccaggccaggcactccccacagacctgaggaagaggaccccgggaagcagaggcaggttttcctccagggaggctggcagctgctggggtagccaaactgtccctccctgtctctctgagctccagctctcactctgttctctctcctctctctctgcccctttttgctcagctgtgactgtcactcagcctgagccagtctcgctgttctccagacaatgggatttgagagagtgtctctgctgtgtctatgctgcgacaaccttttctggcagtggagtaagcggatgtgaggcgggcagcagtgcagggaggaaaagccctgaagatgaattacgtccacttcagcaggctgaccctctcgggcaggagggctt

SEQ ID NO: 122365 - DNA, 353 bp, Homo sapiens
atctactccaaaaaattgttttggttgtacaggctaactattttctagcagtatattactctacacagttgttaagtttcagggctcaaagcctaacatgtggtttaacagaaactaggctgctcctaggaaagcatatgacagaattctgcttctatcattgttgtaacagaattttttgaactcagaaaacccccataaacccactaagttgcatcaactgtgtttgctacaatgctgttcaaatctgccccctcacccaatgccaaaaatctttcccttgaggtgtcctaaagatgttgccacagtttaaatatggtttttctgctccaatactcaggctgaaatttgat

SEQ ID NO: 122366 - DNA, 722 bp, Homo sapiens
caagaccattttgtggagctctttggcaatgcctagtaaagtttaagattctctctacctcatgatccagtaatttcattcataagtagataccccacagaaactcctgaatacatgcacaaggagaccgataaaagaatgatggctgtttgattgtttgaaatagtggaaaaactcaaaataacctaaacatccatcaactgaaaatggatcaatagattgatatataatggaataccatacaacagtaaaaatagctggatttcattgagtacaaacagcaaagtacaaaactgtactatgatgtttacagacaactatgtattgaatgtacaaaatgtgcatgggggtgataagtagtggtaacctctgggcacgaggaggaagcaaaatggggatagctttagtgcgggctacttatctgtaatgtcctatttaggtatgtggtgggtacataattgtaaatctctctgccagtgagtatattttggctcaagttttgtatcttgttgcagacttaacagtttttggagtggtagccagttcacaggccacacttggaggagtactgtactactatatatgactgaagtgtattgtaatacagaaagacatactgggagtcgggtgccgcggctcacacctgtaatcccagcattttgggaggtcaaggcgggcagagagttcgagagcaatctggccaacatggtgaaaccctgtct

SEQ ID NO: 122367 - DNA, 578 bp, Homo sapiens
ataaccacaggcctgacctcacgagtttggcacttagatgtacactagaattttcatgggaagagattaacttaaacatgttctgtgctggtaatatccattgggtacctggcagaagccattagaaaatatctctgaaaggtcatattcttccactgggttccccactgagattctacagcagatgagcttagatccaaaattataaaatgcatggggaacaaatgcactatgagaaacagtagtagaagtagatcccagaaaccataacaatagatatcctctgatagacatgagaaaacatcatgtgttaatgattaaagatataaagaatgaactgaaaatataggaaaagatgagactggtttggaaaacagaacttttagaaatgtcaaaatataataattaatagtaaaaatcaatagatgggttaaacaggaacttagactcaccttaagagaaaattagtgaaccatataaaagaaaattattgagaatgcagtctaaagaaataaggagataggaaatatataggagagtttaactgtacataagatcaggtcatctgcaaacaggaa

SEQ ID NO: 122368 - DNA, 542 bp, Homo sapiens
cttttctcttttattataataggttatttggatttagtaaggatatcataactcaggcagggaagaaggtgaattaaaaacagctttaaccttaagagatagcattaggagatatacctaatgttaaatgtgagtcaatgggtgcagcacaccgacatggcacatgtatacatatgtaacaaacctgcacgttgtgcacatgtaccctaaaacttaaagtataataataataattaaaaaaaagaaaagacctacaatcagacaaagcaggttagagaatttctttatggccatctccaagacagaaaggtaggggaagactcctgccttcaggagagaaagaaggaggtgaaagggcaggagaaggtcacagagagagattgttttctgaggcctgcttctgagccctgaggcaccccaatattagaacaaaaggctataacaagtgttatgggagttatgttgcaggaactgtggatgaaaacatatacgtattacagtaagtacgatgaataaaaattatttgcataatatagctaaca

SEQ ID NO: 122369 - DNA, 441 bp, Homo sapiens
taaaataagtataccagcccattggtaaacaaagaatagaaggtctctatgatttcagaaaatgcccttttctcatatccaagtcagaatgacttgggcaagaatgggagaagacgtgaagataaaagggaagtgatgactggtctgtctctgtcagttgcttctttttctccctaattttaaaaccgtaatgtctgcaaatgaaaggatttagtgttcaaagggataatacatctttttagagggaatgaacagtatggttactgaccaagtgtaaatttacttaagtgcacatttaggggcttctcaggggttctagtattatggttgcatatcacctgaaattgaattttgtcctgccctaatgtttcatgttgcaaagggggaaatgaagataaactgaaatgaatgactaaatctaggctttttaataattatttt

SEQ ID NO: 122370 - DNA, 758 bp, Homo sapiens
aggctggtctcaaactcctgacctcaagtgatctgcccgcctcggcctcccaaagtactgggattatagctgtgagccactgcaccctcccggaaatgctttttaacggtcacctcctaggggagatgaagagagttaccgcataatcagttttaactgtatttgtaatgtttgtttctttacctgggaggatatgttgtagatacgtgagatagaatacctaagtgacacaatggtgtgcaggctatggctgcaaagtagaaagtttctaaatagcatgcttggatttttatttgaattggatgaagtttttgtgtcctagagaaattcacaaaatgttcctagtttcagataaaaggttatgatttaacatctttgcttttgttctttcttgtctttgaatagaacagtgggggacggtaaggtctgtttgcaaagtacctatgaccatcttacattatttttatgggtggggggcattgactgtggaatgtgggcagtaacttgcacagtcagtaaccgtttgagtaacttcttgttggcatccccattctggcactcctcctctaggtctccacctcacacgctggtttgtgggcggaggggcaggttggtgcgtggggtgtccgggcactggctgtgcatgccttcttcctcttctgtctcttggccaccttttccaaaaagtcaccagtgaccaattctcccagtgtttctttgggactcaatgccttgggcttggcattgggtaaagccaa

SEQ ID NO: 122371 - DNA, 593 bp, Homo sapiens
agggcgccttttttgatttttagtagagacggggtttcatcgtgttagccaggatggtctcgatctcctgacctcgtgatccgcccgcctcgcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacagg

SEQ ID NO: 122372 - DNA, 832 bp, Homo sapiens
tggacccactacttgtctttgtaaataaagttttattggaacacaaccatgatcatttgtgtattgtctgtggctgctttcacaccacaacagcactgctgacagttgtgagacagggcatatggcccacaaagcctgaagaattttctctctggccctttacagaaaatgtttgctaagctctgatttagagttatagcagattcaaatcctggcttcattaataactagcagcatcacttaagaaaagttatttctcttctgtgggcctcagttttctcatctataaaatgggatcataatggtacccctggcatgggtcattcgtggggagatgtctttgagcagttgacccagtatctggcacacatgaggtctttaatcaagtcacattactctggacaccagctaaggtgccagatagagatgtaaggtgctattttaaggaactcacaacacaaacagctggagacagtgcacagaaggtactggggttgaggcgtgtcccgggcttgtgagaacccagaggcagagtgcccttctttccatactggcatctgggggaggagcactacttagcgattcaaagacaaatgagctgcaggtgcacacagccacatggatgaagctctcagacatcatactggccaaaacaagccagacacaaatgtgcatctgctgtgtgattgcatttataacatgttgaggaacaggcagagctaatctgtagagatggaggtcaacactccggaccttctgggctgggaaggggagcaggggagcccccagggcatggagatgctccccatcttggcctggctggcaggtgcac

SEQ ID NO: 122373 - DNA, 599 bp, Homo sapiens
attcttactgaagtgtcctttcagtcttttcttggtctttattacaatatgttatggaaaactgtagtgaagaagtatcctgtcagccatcactgctgtgtctcaacacctgatgctatggttccagccctgcacgtttttctgagtgactattataaaactggtaatatatgttagcccggggttgacacactatggccatatctgtttttctgcctgttctgtatggcctaagagcatttaaaatgtaaaatgttaaatgccttttatgttttttaatggttgaaaaaaacaagaatatttcataacccatgaatattaaattcaattctcagtgtatataaattaagtgtatctatgcttctataaaacattttcatttcagttttttcaatagctgctttcataccataatgtcagcattgagctggtgtgacagaaaccctatggccagcaaaatatcagctggccctttacagaaaatatttgaccactgttagtctgtggctgtgctctcattttggacacagccttccagaccccatctaactcttcttctcaggaccttccctgtggtttctaaaatctccagtggaaga

SEQ ID NO: 122374 - DNA, 354 bp, Homo sapiens
cactgccaatatcatactatatcagaatcttgcctaagtatgaaagaagaatgttccagaaatcacttaaggtgataaactcgtccccaaagagatttagaattgattcctcagctaagtatttctccacctctttcattatgcctcctgaaaataagaatgcagataagggaccattctacacagaaatgctcctcagcagaaagctgtggtttgggctctaggatcttgatatctcactggcttgagatttctgctgcaccccttactagctgcaagaacttcagcaagtttatctttgtctctgtacctcagcttctccatgtttaaatagaaacaatttcagtacctcgg

SEQ ID NO: 122375 - DNA, 849 bp, Homo sapiens
gctaagccagatgacacaggtttgtcaggtaccaggcataaagccaagctcctggttagccataggcagagcaagaataaatgtaattcagccagaaccccgacctttgtgctaaagtggatgcatctcagcaccacctggagtgggtctgggctttagcatttcacaagcatttatcagccgctgccatatgctgagcaccatgctcctgcctccgtgccaccatatgtgcgtgtatacacacgtgcgtgtgacagtggtgagagattggggaccaggatctatttggagaagaaggacgggctctaatggaggtgtcaggggacaagcagagtggcctgagagctctctagagcagtggctcaggtgccagttccaaaatctcacttgggattattgtttattattgatgattatttatgagggtattattggcactgaatattaataattctttccctgggcgtgactgtgtttggataagaatgagggtgaactgaggatcatgccaaatgaactctttcaggattgataactggctctgtattagggtaacacctgactcgaatgttacacccgactgagtagtgttacggaggaaaacgacccagaagaacctgcaatatgtaatttggtgtgggaaatgctataatcacaaaattttggactctggttatctttatatataaatctttaatgctagaaggaacttaagcagatgttatgtgcaatctctgcatttaacaggccacaaactgaggtccagaaagctgaagagagtggcattactgggatttggactctatttactggtttgctcttatattcttttgtttatttgctcattag

SEQ ID NO: 122376 - DNA, 531 bp, Homo sapiens
agatacttgtatcacatctatagtccagaggcaaaccataaaagatcagaaagcttaactgacctgcccagatcacaagtcccacttcccatgatgcttccccctcccttcatctcaatttttatgataatccgaattaaggaagaagcaatccccttgctctcatcccaccatcttgtatgcctcaccaaattaatattcctaaaactttttgttgaacatgttacttccatatgtacagaccttcaggaaaataagtaagtaaataaataaaaacaggcacaatgatactcatactcttccaaagtctggtcccaacctgtatttctggtcttaattcctactctcccagtgaaaatcctttggtctagatgcagctgaatggtcattatctcttggaaagacttccatcttccactttatatctttacctaagctatcctttactttgagaaccttcttctctcctctctgcctgccttatacatcttagtccaggcaccttttcctacatgaatcttttctagtgta

SEQ ID NO: 122377 - DNA, 332 bp, Homo sapiens
atctaaacctgattacctcccaaaagtcctatctccaaatagcatcacactggaggttagggcttcaacatatgaattttggggagatacaaacactcagtccttagcaacccaggccaataacgatttgctgagtaaataatcatggctggcactcttaatagctctttgaatgggacaggacctaaatgttttgcatatagtcattaaaattcattctcaaacaatctcactaggtatggccattatttattatccccggtttacagatgaggaaacccaggccctgaagaatttaagtgatttgctaattaagtgtgaagctgggattc

SEQ ID NO: 122378 - DNA, 834 bp, Homo sapiens
aaaactagagtattgtaatctcaggaacataagattatccaagaagcctgaaccttgctcttttcatgataaatgacatccaaatttcctttgtctaggagataagcatagatcccttttatcatgcttctctgagattttcacagaacaaccctgcaatttgattttgtttgataattttgctttttggcttttcagtgaggactctattttccattggaactgactcctttggggataataagctttcacttaaaagaacattccattagatagttctaacttcaatgaacctaaaagtggcttcttaatttgaataatctggataacttttgcaaatgggtcaaaacagcacaagtatcaacaatcacgtatgtactgagtaatatttgccctccagttagcaaagtcaagaaatgtctaactctggcacacagcactggttttaactactctttagttcatctttgccttccaaattggttgaaaatggcaagcttagaatggaatgcatattaataacagaaccacttaatgttttaaaatattcataccttgagattctttttgagagaaaaaagaaatcttaacatccaattctagttgttttggcttttcacatatgctagacatgaaaaaggcagttacaaaagtgaaatccgattggaagtcagtggtgtccgccattgagccgtgctaaatgtcgtgtcacaaaaggagtttgtgaaaacaggatgagtagaaaatgttatactgttgtttctatcgtggcaccgctttcttataaattccatttgctttttgtcatctgaactgttacaaccatgggaaacc

SEQ ID NO: 122379 - DNA, 846 bp, Homo sapiens
agcacaggggccttggtccttccattgattcataagtacaacaccctacttcttggatacagagccatcgcggaatgttcgctggagtgaggcagcgtatggagcacatgggacatgcagacccagatggacatcttacaaactttcagaggagctgaagccagattgttcttacaaatggtcaccagaaggaggacaatcacaaactgtctcatcctcctctgcaaatccaacagaaaggacacagtagagtgggcaagaatgcaaagaaggtctgtggtttggaactggcccaagccgaactaaacttttctaaatatacattaaactgtcaacaaagagcaccgtgacccacagcctgaataaagggagagccccaaggccctctgaagccactagttctgtgagttgttttagggagaagacagacaaccaagaattatttaccttattagactgtgcccatccaagcccaggtaaaactttttgatcagcagaaaactggaattatttccctttctctatcctggattgagtgtgaattccccagagaaacttggctttgagagcactagctggacatataggggtccatttccaatctgctctgagaagggccctgtcttcatcctaaaggaaggctttagaaaactgttatctaagatctaggattgaagatggtgagaacctgaggctgagcaattggccccaattcttcctgaagcattatctgagagagagagcctagcctgtggtttttgacccctggcagaagggtggagagagggaagaagaaagaaggaagatgaagacaacttcctgctcaagaccaacccatctcccctc

SEQ ID NO: 122380 - DNA, 453 bp, Homo sapiens
tgtgttagccactattctagatacctgggatacaccagcgaataaaacaggaaaatccctattcttcccttctgggacaccagaatttaaataataggaagttttggtacagtttaaacaagaataaaataaagtagaaaaaagaaaagcaggtaaggagaagggaaaggtgggggaatctctgtttaatgagagcacaggagcttttctggtgattgcaaaccaaatgaacaaaactgtatctagagtctccaagccatcatagaaactactttctgcaagtaatggttctggaagtacaaggcctcatactgccatcagagtgagcaaagcatgctgggaggcctcatctctttgcactgtcaggggagaacgttcagtgttattgacaaaatagtgaatgatttcttaatagaatacagtcagcagagacaggggttatggcataattaa

SEQ ID NO: 122381 - DNA, 332 bp, Homo sapiens
tcctgggttcaagcgattctcccgcctcagcctccagagtacgagtagctgggattacaggcatgcaccatgcccagctgattttgtatttttagtagagacagggtttcaccatgttggccaggctgatctcaaactcctgacatctggtgacccgcccccctcagcctcctgaagtgctgggattacaggcatgagccactgccagccagtgtccagcgttttttagtggggcttgatcccttactgccagtgtggctgacctttcatctccagtctctcctgagctaactcttgtgtatccagctcatctggaggttggaactgataca

SEQ ID NO: 122382 - DNA, 699 bp, Homo sapiens
atctttagcacacagtaggtctcaacagattaggacattgggtgaatgaatgaataaacacattctgttggtaagaaggtaagggtaatagaataataatgttcatatatctaatgcaggactggtgatataatttgggagactgaatacaaaatgaaaatgcagggctccttgttcaaaaattattaagagcccaagcaacgtaatgagacattgtctctagaaaaaaaatttgtttaaattggctgggcatgatggtgcatgcctgtagtcctagctactcaggaggccgagttgtgaggatcacttgaacctaggaagtcgaggctgcagtgagccatgatcaccccactgcactccagcctgggcaatggagtgagaccctgtctcaaaaaaaattattaagaatttcaagatgatgacagcagaacaagtgtgaccctctggagctgcacgggtcagaaatcatgaagccactcttttgtaatgcagaaaaaagccagagatttgaattcccattttttatttttgcttgtgaagtaagcatactttattctttgttttccagttaatagtatgaaagctttgcttctttgcttcctagtgaaatagggagaacagctatttaatactagtacctgtcacaccacaaattggaactaatgcttaatttaccatctttgatgtcagcctccacca

SEQ ID NO: 122383 - DNA, 282 bp, Homo sapiens
caaacttctatcaggcttcctcagggtacatgttttcagggagtacagaattaatggggaccacatagccaacataaacaatgtgggagacgattaaaggccaccaggaaaatgtggacagagtgctgtggggcacgagtgccaggcagaggctcagagagttttacggtgaacagctaatgttttcatgaaaggcagtggcgttcctatttcattcttcccagcagtttaatgtctccccatacactggacacccgggataaaacatacttcgctcccatc

SEQ ID NO: 122384 - DNA, 723 bp, Homo sapiens
ggtgactcttcattctaccaccccaaggtggttctctccaacccccctcctcttagattgttctcacacagaggccatcatttcataacattgtgctgggccagaagaaccataagcaggtcccttcccataccaaagccgtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaatgtgtataacttgcataaattgtaataatttcctggaacaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtcccttctcttgccacactccactgtagaaataaaagaggacggggaggccagagctgctcaaaaccttataacccacaattctcatagctattctcaacttagagagggctgctttctagacacaccccctccaggcccccagactgccaggctccaggaataagtagctctaag

SEQ ID NO: 122385 - DNA, 238 bp, Homo sapiens
gcttctcctagaaacctcagggacaaccaggcaggccccacaaatgcctgcagctctcagcacgtgtgaacctcagattcctggcctcacacatcacagtggcaggcaagcccctaaacctgtactgcagacagtgcccggaacccagcagaaagggagcaccattggatgccaagaagaatctggcacctgggccacgggggtgtacaaaagcagcaactaggagatggctcctcaa

SEQ ID NO: 122386 - DNA, 376 bp, Homo sapiens
actaaaatcagaggttgcttgcagtgagccaagatcataccattgcactgcagcctgggcaacagagcgagactctgtctcaaaaaaaaaaaaaaaggaatttacatagttgaacaactattctttggacatcttttagtccagtagacggtgttaaacttgaagacaaataacgatttgacctgtgatatttgtttttccctcttatcttctaagcccattcatccagatcattcatcacctttaaaggcatccccagagggaggcaggtctggacagagctgaagattgcacaggccatttgcaggctggattagttctgtggtgacccacctgtctgactcgagttatttttttcccatgtctggacaagact

SEQ ID NO: 122387 - DNA, 330 bp, Homo sapiens
accaccatgggttcactaagtgatcgtgagtcccaaggcctgtcttgtttccagtgacactgctgcaaggaagggtcccatgctagagatggctgggcccctccttcatgagatcactcctttgctcaagatccttgcagtggctcccccacttccttcgaagtaaagccaaagctggtgagtggtaataaaaggacttgacatgatgcagtgctcccatcatctctctctgctcctccgactcctcctcgtgttcatctgctctgggcatattggtctctttgctgttccttaacgtgcgtggcgcacacccccccacatctccttgaa

SEQ ID NO: 122388 - DNA, 161 bp, Homo sapiens
aaacattccacatggaacagtaacatttaacatcgagagaaaggggataacagagcataagtgtggctttgaaaaaaaaaagagtgagaaggggatagaagaaagggttaatgagccaatccaatgagagcaacgtggatgagagtgtcctggcctgttcc

SEQ ID NO: 122389 - DNA, 396 bp, Homo sapiens
agatcctttagagggaggtggctgaaattcaggggtgtgatgttcttgggttattattgtactgctcttaatttaagatgaggcagaagcaaggaagaatcttgaaaggggagaattttatttaaatcaatttatgccgagtgtcaccagcttgcttgagaaaccccacatctacagtagcttgcataatgtgttcctgtttataaaaggaagaaatagggaatagccttcataggaaaaggggagggctggaatgacttcagcctcaggctgtgggtgctgtccattttcttctcgtggtgtgtctgattctatataagttttgtttgcaatgatgttggtgaagggagtgaaacaagaaaaagcaggtactgctgttgaaagtggttgtgtgtg

SEQ ID NO: 122390 - DNA, 411 bp, Homo sapiens
agaagctctgtatgccacatcactgatgccgccacagtgagacagaattcgaagtacagccagatgcttttagtaaggttctctttggcctgaccttttttccactccattcgccttgctttctgtgggaataattctctcaacttaaaattaccaaatagcattaaaaattctgcaatatttctgaaatcatattgacacataatggaggatttttcagaataaaattagatgactcttgtaattgttttattaaggaactgcaaacttgtttccattcttcctgaaattaagtattcatttccactgtaaggcaagaaaaaccagctaacattatacagtcaaagggtgacacctattaaacctgatcgaggtttttggaatttatttaaaatacagaactaaattaca

SEQ ID NO: 122391 - DNA, 360 bp, Homo sapiens
aagaaatgaaggtattggactggataagccattcaaggtaattgaatcatgggcagtcagggtcatgtggacagtacctggcagctctcccaactttgccagagtctctcagaacaggagagagtctgttgagttcaaaacagttcccctggagattttgattaggtatcataacatcctctgacattgagaaccactgaagtaaaggacctctaagatccttttggttttaattttctagaattctatagtcagggaagaaaaaactttaaataggaaatgaagaagaaatacttgaacttaagcaaaaacaaaaattatttaaaaaaaaatacttgaacttaaggactgttcaaaaaa

SEQ ID NO: 122392 - DNA, 427 bp, Homo sapiens
tgtgaatttattttttacacaaatctgagtgctcactctgtgctggccctggacggatctctgtggatgtctggtgagcaggatggacacagcccggtcattgcaacgctaaaagcttgaatgacaccagtcaggctggggaactgggagagcccttgacatgcagagtgactcagccagcgtgagcaggggttgtcagcatgcctagaggagcaagagactgtgagagatgtgtgtgtatacttgtgtgcctgtgtgtgtccgtgtgtacacatgtgtgcgccgacacagccaggtgttggccaatgcaggtgtggtgtcctcaagagcacagtgcatcctgattcttcaccctcccaggcctcccctgcccctgttgtgtgccagctgggcctgccccatgttatgcctgacgcccacgcaaaag

SEQ ID NO: 122393 - DNA, 110 bp, Homo sapiens
aggaggggaggacaatgggagatgagatctcagaaataccaggagttagatcatgtgaggacttgtgagtcttagcaaggatttttggcttttactctgagcaacatgag

SEQ ID NO: 122394 - DNA, 187 bp, Homo sapiens
atcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgc

SEQ ID NO: 122395 - DNA, 610 bp, Homo sapiens
gcccccacaaaactatggactgagcttagtgcaaaagagaaagcccttcttacccttaaagttcactgcacgggccattgtgggattagtcaccccagatgataaaacataatactggttttcctaagtaggggtgattcagctttctcttagattggaatatgaacttaatgtatataatacatacagtcacttcctgaacttgtagttttttgcatgttttatttaatattctagccaggtttaagtttttatggcaggaagtatgtgaatggttatgacaggagtaaataacagttgattttatgattacagtacaggaagtaacttttcacaccaaataaatctttgggaaaaaagtgctggcttataaatttaacgtacataaattttccagaatcttgcatacagtcgcctgtgctctcttaaatggaactaaatacctggctggtcttttttcttttaacttttttttgtcaacgaatgtctttgttttagaaagaggcattttcaagtgttttgatgtgacccaacgtgacctaaaaccattaaaagattctaagcaaaaataataaggccaaactttagtgtaaatagcatgaaaggcttg

SEQ ID NO: 122396 - DNA, 397 bp, Homo sapiens
tgaataaaaaggcacgtgggcctccatatcaagcagatgtactatcgatctcatagaagagatgccttggcctgatcaaggataagaatatgtaactgaaccattttattcctaacccttctccactgacacaaggaggcttatttcctggagcactctagttatcatggcatcatctcgctgtgcttttcccccagtgttctggactagtcaagttccctgatggcattcagttaaccaggtccttcataaccagttcatcctctgggaacctcaagggaagtatcagccaggtgtttctgaatcatttacactacccctaccaggctggcgtttgcaaagagctcttttcatgtcctgttggccagctgcacctctattttatgagccgaacttc

SEQ ID NO: 122397 - DNA, 674 bp, Homo sapiens
atgatgcggataattcttaacctctctcactataggatttgtaagaatatcatatacttcatacagttcttactcatgtttccagtcaatggaagctattgctatgccaacagtatcattatctctaaagaataaaagcaaagtggaagtatgtattttggaacttcatgtttgtttttactttaaaaaaaagattttttgtagcttttttccccctgaaagtaggtatcatggagttttatataaatataaaattttcatgttgcccactatgatattaaaattcatgagagcagacagttttattattttgtattttattcccaaagttaagaaaatgcctggtacctaactagattctcaggtgatatttttattgaatgaatgaatttattgacctgtgttcacacccctggctaagtttacttttgttttggtttactaagtttgttcctttagacaagtttaatctgaattgtaatttctcatctgcaaatggaaaccctaatgatatgaatgtattacatgtaatgataaatgaagtcatgcatgtaaagctacttagcattatgagtggtatacaatgaataactcaataagtattagcaatgattatgattatgattttatgtgccatttacttaggacatgtggaggaaagaagagcatttgtg

SEQ ID NO: 122398 - DNA, 333 bp, Homo sapiens
gaacagtttaaatttttttgcaaatgataaagtaactctcagcttctggatgtagtatctagcacagattcccactcttgaaaagcagtttggccacttgtcctcaccacccccgactatcaaacagcctagaatagggcttgcatactggaggttaaaaacaagtcacaaaggtaacacctcctcttcctgcctagtcctccaaccacccaatacctcctggcccatgcatatacacacactcagcctctgtgatggcctgaattgtatgggggagggggagggcgcaagaattgggctgaatctaccaccatatgcttagccgcagatcaa

SEQ ID NO: 122399 - DNA, 275 bp, Homo sapiens
tacagatgcctaggtccttcccccagatattctaattgctgtcatgaggatatcagtgtgttttaaaactttaaccactactttcaactcataggtgttattaccaagttcctgaattctatggcttgaggaactgagatgggagttataaagagtttgcaaaacaatattcctggatgatgtgtaatttgtctcatctttcagttcctttaaaatctaccccctggatcaagccatccaaaagctgggtaccttggctatgttgtactatgttc

SEQ ID NO: 122400 - DNA, 230 bp, Homo sapiens
ttggccaggttggtctcaaactcctggcctcaagtgatttgcccgactcggcctcccaaagtgctgggattacaggtgtgggccaccacgtctggcctccagattctttttttttttttttgcctttgtttgtcacatatctgtgacccagctggaaaggttatccacttttaagagctcatgtaattagattggacccactcagaaaagcaagaataatccccctatct

SEQ ID NO: 122401 - DNA, 327 bp, Homo sapiens
ctggctgatgctgactttggtgggcctgaagttctttggaacctgcactccatctctgaacactgtggactctgcaggtttccaagacattccaacatggcagaggggccactcacctctctcagcactcacctgttgttatgttcccaaagcccagagtgatgagccattccttgtgctcattgagttggtgctttgactcattgaggacgccgttggcccacagaagcaggttggtgaacaccaagtggatcaccccaaacctgaaaaacacaaggactcagttctcaagcagccctgggagagcctcaggcaccatagggtgag

SEQ ID NO: 122402 - DNA, 478 bp, Homo sapiens
ttcccaacacatagaaatgatcaatactctaggtaacagataccctaaataccctgacttgatcattacacattgtatgcatgttataaaatatcacatataccccataaatatgtacaaatattatgtatcaatgaaaaattttaaaattccattcatgaattttgcctgttttaaagtctgactctttttcactattgagttatatgagttccttatatattttggattttaaccccttatcagataaatggtttgcaaatattagaaacgatactgattattcttttctttcacttattactgtcaatatcaggaaacgaggcagcaaaaaatatatcagttttctaaaacagagctgcacacactaaatggggaaattatgaaacatagtttagaaatctaatttgctcgtttgtccaatgatatacttagcaatttataaattgttctcacatggattatctcatgccatcct

SEQ ID NO: 122403 - DNA, 793 bp, Homo sapiens
agtagtaaaatagtatataccaggttcggtttgagcaggtccttcaggcacaagtaagtttcaagagcaagtggctgtgacttccatagcatctattcttgctgcaattttaattcaccatcagtccacatctgtgacctcttaggattgactgttgacagactaagaaaacatttgggcctggttcgcagatggtcccttgcagtttgcaggcaccaggtagatgtggactgctgaagcattgcagcccaaatcaggaacgtggtaagaggagctctctcaggaccaaacactgagcatgttatctggagggagagatggccagaagtcgagatatataccaattgatgggtcattaatggttttattagcatactggtgacaacgaagtctaggaaaaaggtttgcagatggacctttccctatgggcactatcacatatgaattctcattagagggcatccactgatgaggccctcagcagtccactgacaggatagcctgttctgtggatgtcagtcagtccatttccagcaaccccgaggcttgcttaataggctcatgaagagcatggccattgtggcagggagagaagccagacatgagttcaacaatgtggacttcccctcatcaaactggtctggctcctgtcactgataaatgactaacttgctgacaggggctctaccatctctgagtctctgatgtggagtcattccccagggggaccagtcagccatcagattattgcatggaacttctattatgaaggacatgattttgtcctctagaa

SEQ ID NO: 122404 - DNA, 660 bp, Homo sapiens
cacattattattaactaaagtccatgctttattcagacttcctttgcttttacccgatgtcctttctctgttccaggatcccattcaggataccacattacatttatttgtcgtatcctctggctcttcttggctgtgatggtttctcagactttccttttttgaggagtattggttggaacttatccactattttgtagactgttcctcaactgcgatttgtctgatgtttttctcatgatcagactgaggttatggatttgggggaggaaaaccataaagtactgacctgtatccagggtcggtactatttacaggagttatcactgcttatgttaaccatggctgagatggcatctgtcagatatctgccctgtaaaattacttcacttccctctctttctgtttcttactttttggaaggaagtcaccatatgcagtagagcctgctttttttgtgttgctgttgttgttttggagacgggatctcactctgtcatccagggtgaagtgcagtggcacaatcacaactcactgcagcctcgacctcccaggctcaagtgatccttcccacctcagactcccaaatagctgggactgcaggcacatgccaccacacctggcgaagtttttgtatggatggggccaggctggtctcaa

SEQ ID NO: 122405 - DNA, 292 bp, Homo sapiens
caaaaaaaactcaaagtacttcttaaaaggaaaaaaaaaaccaagaggcaactgaaaactaatacagtaatacctcagttatgactgcccttcagagggtaagagataaggcagtgagttgcttatctcagtaccataggaggtggggtttcagtgctcacacaggaatgagagatgaggccttggaccacacaaggataggaaatggatctgagatcatctatatagagctgagatgcttgtggggctacttaatagctagatgaaatagaaaagtaaacacccactagca

SEQ ID NO: 122406 - DNA, 245 bp, Homo sapiens
agtgggtgactaaattcatcttcatcaaatttatttatggaaggcaaagtctttataacagctttctatgaatagcctcaattttcaatacaaaatttctactttgccttatgctacaaggtggatggcgaagagaagtctcctcattttgcagatgaaggcataaggcactagatgaaatttcagaagttaggattttgtaggagagcactttcttttcttttcttttcttttttttttttttt

SEQ ID NO: 122407 - DNA, 787 bp, Homo sapiens
cgcggtggctcatgcctgtaatcccagcactttgggaggccgaggcaggtggatcacctgaggtcaggagttcaagaccagcctgaccaacatggagaaacctcatctttaccaaaaataaaaaaattagccgagtatggtggcgcatggctataatcccagctactcaggaggctgaggcaggagaatcgcttgaacccaggagacggaggttgcagagagccgagattgtgccatttgcactccagcttgggcaacaagagcgaaacttcatctcaaaaaacaaacaaacaaacaaaaaaaacccaaaaaaacagaggatatcaaattgtagtgcagtacaacttcaacctcaacaaggatttaaaaaaggcattgaaaaacgaccagaaggagatatgccaaagcataatgaaaaataataatttactcttattcaccaaaatgaagatttatgattgaatgtaatttagaaccattttatccataaataaagtaggtcccaacaaacactttaattgggttaccttcattgaaaacatgccataagtcaaatatctaattttatttttccaaagaaattacgtttaaggatcataggaccaacctttatttttatcaccataagcagcacgttttaccaactggcactttttaactatcacataaagccaaacaaataaaagaatacaatcattacacaaaagttttaatatgttgtatgttgcaaccatcagaatcttcttttcagtttctatgcatttcttcaggattctcccattgcatt

SEQ ID NO: 122408 - DNA, 165 bp, Homo sapiens
cttaataattgagacggaagggacagaaagctaagagttttctggagagtgttttccagtagacttttttttcgttttctttttttaaaccatcataagcaagtggaagaattccaggactagttgtctggggttttttgttttttttttttttgaagacttttt

SEQ ID NO: 122409 - DNA, 684 bp, Homo sapiens
ttgtatattattttttatatatcaagtttaaaatttttttattgcacatgtatgctcatataaaccttcagaatgttacagatgtatacaggatagacagtaaaaatctttagtgattctgcctactagatataattaatggtttggtgtgtattactccagattttttgtgctatgatataacagtgtttcatattattggttattgttttattattgttatgatcatcattattatatatattttccttttacaaaaacagggctatattatatataattgtacaacttttttttgctttgtaatgtatgttgtgcatttttttcatgctaggaaaaggtatatatcttcttttttttttctttttaatatggtgtttcagtatatggttatttattatatttaacttactatcttttgatgatcatttgagttgtttccttttcctcctcatctcccccattacagacatttctacagtctttgtgcatatcgtttgagatacttgaacataagatagatttcaagaaatagatttggatcaaaggatatgaatatttaaaagttgaataaatattgccaacttatgtactaaaatgtaccaatttatactacagtaacattttatttcggtgcctgattttctatgctattatcagcattaattattaatttaaaatttt

SEQ ID NO: 122410 - DNA, 265 bp, Homo sapiens
agccaagatcgcgccatcgcattctagcctgggcaacaagagggaaactccatctcaaaaaggaaactaggaaatatttttcataatagctaaaaagtacaaacagtccaaatgaccatcacttgatgaatggataagatactatgtatccatacagtagaatgttatttggccttaaaaaggaatgaagtggccgggcgcggtcgctcacacctgtaatcccagcactttgggaggccgaggcgggcagatcacaaggtcagga

SEQ ID NO: 122411 - DNA, 596 bp, Homo sapiens
ggctcaaggtcagaaaggacagtgtaggtaactctcaccttcctgccagagctagccatttgtgatgcacagaggtgccttcagaaggaaccaggctcttaggtttaaatttctttcagctgctttaaggagacccagaagttgcttgagagagagctatttttagcagctctgaataccctgagatgtcatctgtccaggatgcagggaaacatttcactcttttcattggttctgaaagcaatgtgggtatttggagctttttcccaagctcttaatgatttcagggatcttatttaagaactctttggccccacaagaggtaggagccaatcaagacttggctttcagaatcgagggacctattaatggtaatctggcttgaaaataaatgaagggacggataaacaggttaactaatacagataaaaataaaataacctcctcatgagaatcttttgacaaaacattttcccctattgtctcatttgatttcactgcatccctataaagtacaaatacattattcccattttacatacaacaaacttggagaagggtagggaaaaggaatttgtgctttctgaaccctgccc

SEQ ID NO: 122412 - DNA, 300 bp, Homo sapiens
taataacctttaacccctgggtgctgataagctaatatctctgaattaatgctataaagaaaattaaaacccaaaagactctgacagactctgacttctaagcccttgcatcaagaacaaataatgctatagggagtgaatgcaaatgtagcatttttgaaatctaaatacagccagagggagaaaatcgccaatacatcaacaataacaaaaacaacaaaaaaacagccatttatactaagccaaatctctgagatctttctgaaaatatatatttaactctaaccaggttcccaggct

SEQ ID NO: 122413 - DNA, 716 bp, Homo sapiens
  misc_feature (112)..(112): n is a, c, g, or t
gacaccgagagtttcagaggcaggaaaagatctggaaaaagttaagcagcgattaatagagatgctaatcacgttgacaagttttacagaccactgaacattcggatcgtgntggtaggcgtggaagtgtggaatgacatggacaaatgctctgcaaggaacccacgcgcgtgggttccttgcagagcaggtgtcagattctcaaagggttaaatttaagaggtttagactttaagagtctgggaagccctgctctggaagtcatacttctctgatatctttttggtcatctgtttcttggcttaagaaatgtggtggaaaagaggtacagaaccctggggtaagcagtggaacataaaaccagatgttccaaggatgagaaacttataacacacttgagaagtctcctgctagcctactgctcccctagcacaggtatactagactatctctttgcagaacagtttgtagttaagtaaaaaccgatgtgtataggcccatagtacttccatccacaggccttacagttacacttattgccttacagtgacccagatgctgatttcccaaggtcaaggatgtctgaagacaatgtgccaatgtgcccagattcttctagttaaggatctacttgagtctcagcccttatgctgtttttgttttccaagctgggatatgaaaaagcagaaaacccaatagggtaacattaatccaag

SEQ ID NO: 122414 - DNA, 226 bp, Homo sapiens
aagatcgcaccactggactccagtggaaaaaaaagtatcacaagctcagttcctcagtcacatgagccacattccaagtggctgctggaggcagccatggtgggacatctcagccactggaaagatcccgtgggcagggctgtggtgggcgtggccacatttggaccgcagcattcccacaaccaggctgtgtgacttggggaagtagctcccacctctctacgcc

SEQ ID NO: 122415 - DNA, 172 bp, Homo sapiens
acgcctggcctataaaatttattttcataaagtgatcttatacgctgcaaccatgctaaactgatatatcagttcttagtagcttcttttaagattccatagaatttgctagctagacaatcatgtcattttcagattaggaaagtttaacttcctttccatttagatgcct

SEQ ID NO: 122416 - DNA, 485 bp, Homo sapiens
tgtctgagaatgtctctgccttctaatccagccagcatatcttctggctcgccctgaactgaggagaaaccccagatccctttgggaaggtccaggaagggcaggagtggacaggcacagctctgctgtcagcactgctgtgggggtgactgtagccccagtctgccctggtgtttttctctcgctcttctccatgccggcctttgcctctagactgagaaaccggggttgactcaagtggcacctgcaaaagtgatcatggcagttcacttagcctgcaggtgacagggactgtgaatctagtccctggcgagcctggaaagaggggcaaggtagaggctctggctgccggggtttctttggtgagtccgttcactcggctggacacagacggatcaggaaagattcctgttgctactcggctggtggccagagggagagaggacgtgtccgtaactgaagcaaggtggataagcttcgggaac

SEQ ID NO: 122417 - DNA, 447 bp, Homo sapiens
gggcgtggtggctcatgcctataatcccagcacgttgggaggctgaggcgggcggatcggttgagctcaggcgttcgggacccagccctggcccaacatgatgaaaccccgtctctacccaaaaatagaaaaaaatatagccgggccctggtggcgcacgcctgtagtcccagctactcgggaggctgaggtaggaggatcgcttgagccctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaaggcgtgtgtgtata

SEQ ID NO: 122418 - DNA, 415 bp, Homo sapiens
cagggagccagtcatgtggaggtgagggtaggagagccggtccgttgctttccagggtttccagaattcttgccccatctcccccagggcagaagtccccatggcacctccccagcttatttcccacaaggagtgggggacttaaaagaatgtatctctgatacttactgatattaactttgcctatgttttccctttcccaggttccttctccttggataaccatgtgcaattgacaatgtagttattatcacctctgttctaggcagtgataagctcctacctggtctccctaaccccagactcttttgttccaatccacctcctccctgatgaaagatccatctttctttttgttttttgaggtggagtcttgctcttgtcgcccaggctgtagtacaatggcacaatctca

SEQ ID NO: 122419 - DNA, 267 bp, Homo sapiens
aggaaagggaggagaggtgatatggtgtttctttttgaggtgatgaaaatattctaacactgactattgtggtggttgcacaactgaatatactaaaagccacatcgaactaattattttctggtttttgtaacagctttattgagataatttacataccacacatttcacatatttaaagtgtttgatttgaggcttttagggccgagtatggtggcttatgcctgtaatcccagcactttggaaggctgagatgggaggatggct

SEQ ID NO: 122420 - DNA, 591 bp, Homo sapiens
cagatgaaacagagattacaaacttacaaagattactagagttgtgtcaataggactcggggcaatttgaaaagactctgacaggacaaaaatggaaccattttagcagtaataagcatcataatagcaatgcattgtaatacatcaaatatatttaaatctatgaattcataataataccaaattaactcatcacctttggattggtaaggaaataattcattaaattcattgaaaactagttaataaaggcaaagaatctatcattaatcttacctttcctatgtgacttgcactgttagataagcagataatagacaaagaaatatttctcttggtagcattttctactaataaatgaataaggaataagattacattagaactcaccattctgcaggctctaatgtatttaggcatcaaatatcagtcactgatgacatcacaataaggaggataaccagactctacgtgcctcctaatgagaacacacaaccacttatgaagcagtcttggaaaaaccaataataaataaaatcagagttaagtctctagatcagtgctgtccaacagaaatacaatgccagccac

SEQ ID NO: 122421 - DNA, 123 bp, Homo sapiens
actgtattaaagggaaactcagctgtcattgacatttcaaccccaaactcctgaagccagccagcacacatttgattggctgtttttgacaaagtgtggaatactgtatctgaaatatgttgg

SEQ ID NO: 122422 - DNA, 366 bp, Homo sapiens
atgatttccttttctactttgaaaatatttataatggtttatctgaagtctttttctgttaaatttaatgtgtgagccctcgcaaaggcagtttcttttacccacctttttcttgtgtgtaggtcacactttcctgtttctttacagtcataattttttgttgaaaactagatgttttagggaatatattgtagcaattttggagaatattgattctcctcctctggggcttgtttttattgttgtgtgcttgtttatttgtttagtgacttggctaaactcatgtaatgaagtctgtcttttgcaacatgaagccttcctccctcttcagagagctcatccttggctgtgcccacagtttacttg

SEQ ID NO: 122423 - DNA, 214 bp, Homo sapiens
tggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatg

SEQ ID NO: 122424 - DNA, 991 bp, Homo sapiens
gaaagacatctcatcagcagataagtgtctgtacttctgccctgcaaagccagctgccattacactgtctgaaattggggatgtggacttcttgggaagaggacactttcatgcttgttgaaatttagggagttaatgatagttatttcattctctttcttctctgctccaagtgccctactcctctggtatttagcccttgtagtttagctgaaatcatgtcagtgtattacaggctgatccagtcaagtgcattctgcagagaaatgacaagtggcctggtggtggtaaaagctatcctaatggcaggtggcggcatggtgcattagtgcttcttgatggacagctagggattcaatgtcagtttccaggttctgtgtcaccatggttctagaaaataatttgtattaactatcaccaaggagaagctaccctggcagagagctgctgttttgtaaggtggcctggacacctgcataggtaaactgaggtattttgacccttctgttaataacccctactggccatttggcttgaattgaagccccacatttggcttgaattgaagcctcacatttccaagtggctcaaggccacttggaaccaagactgtacaggagtaactatttctgagttaaaatggtaccattaagtgttcctgcaacgttactattaaatgttcatgggcagagctctcaatttgtgtaggattagaataaagatgttttgcattccaatctgtggatcatctgagattttctttctgtgttctgatcaggcccagatatggactactgctgcagggctgcaggctccctcacaatcactgggaatcatgaaacaaaacagcaggcaaacatcttgtgttctgtaattctctagtactcttcttgttaactctgaatgcttgaattgtgggttctgtctctcgcccagtttctctcactttagttagtcccagcaggataccaagaacatcttgagttagaaa

SEQ ID NO: 122425 - DNA, 351 bp, Homo sapiens
actcaccaagtgactgacatgataaaaaagcaaagttcttttagataaaaatggccactttctccttgatatttttctatgggttgagatttagatgaaaatcccttgtggcaaattttaatgactatttctttaatgtaataactgaattcatctagatgatcccacgtccctcaacagagaaaggtgagagtctgttatttgttaggtttccttgtccatatttcttggtgggtcccacaaaagtctcatgaatctctacaagtgggaaaataaattgcccatttcttggcacaccgaactttccatgtcatattttaaaactgtaagtccatactttacatagctaaa

SEQ ID NO: 122426 - DNA, 374 bp, Homo sapiens
tcctctatagcggccgcctactactactaaattcgcggccgcgtcgacctttccactcttgctttccactcattaaatacattctctccacccattactgacctctggcacagattgccacctatatgtgtcctctctccttagattccaggctttgcaatgccaactaaatcttctttcagttgccgtacctggtacagtataccaggcaccacttcctctctacagggtatttctaaactatagccctattcaggcagctccaacctgctcctactaatcagattatgccaatacacctcctcagatcggacaaccaaccccagggccttggcacttgctgccccctctacatgggctgtcgacgcttcccc

SEQ ID NO: 122427 - DNA, 422 bp, Homo sapiens
tcagaggatcaccgatatgcggtctcatcagaattaggtaagtagataaatctcgtaataagtcacggcagccgtgcagtaattgcagaacaagatgctcactaaataaaaaataggccaggcatggtggctcacgcctgaaatcccaacactttgaggaggacaacacgggaggatctcttaaagccaggtgttcgtgccagcaagacataaaaatttcttcacccataaaagagattagaagccacttggtgggaacaaatgcattaatcaggttttcacaaaggcctatcaatctctgtgcaccctatgcatttcctgcatagcatgaactagctgattaatggaccagactttcatggttcctcccatctcttctgcagacaaagggaggcccaatactttccaacaaatcaatagat

SEQ ID NO: 122428 - DNA, 401 bp, Homo sapiens
cccaaacgatttgctgttgaagcataagcaaatacatatatagcatacatgtgtcaagagctagctcaagtgtctccaaaacatgaatccttatatttctatcattacattacatgcaggtgctaggaatcactaggagaaaaatgattagtcatatagaaagtaattgacatattgtgcatcctgcaaataaatgttacacggcagttggtagctttactttgaaatgtaatctatccaagtttctgtgtagctataaagaaagtttgactacaagaatgaattcacatcagttggctgtccctctttcacatggaatttaataaggcttcttagagttttctgtgcttgaaagagaggcaaaaaaacgatctaaaggccttaaacatgtaaggaagaag

SEQ ID NO: 122429 - DNA, 469 bp, Homo sapiens
agacatttgacttcagggccacatggaatgcatcgtttctttggaacaaagaaaactggactatgaagagccacagagaagtcagcaaaccccagagaatccaaacttctcaaggatcaaggcagtctctcacaggctctgaaaacaggaggcggcagtcatgtcccttctaattaccagcacaaccacctgcaccccacggtaaatggacggttactgcacgtccccagctgccctctgtggacatggagctaataagatgtgaattcatggaggaaaatctacgaaaagtggactttgcaagtagttacaatctgatactacctgcacaattattaaaataagccacccaagactatttcagccatattagcaaagaactaatgaggaaacagacatcataaaagaatgaattacctacataataaacctgcatcttccagaatgaagccattagaaattgatcagt

SEQ ID NO: 122430 - DNA, 500 bp, Homo sapiens
tcccacttacagctgtcaccttaattttaaaaaatccccaatgccactataatctatgacttttaatgacaacctcaaactccttctgtgcatgtgcagatctagattaaactataatctctcaacatcccccaaaccactcaaagtttcctcctttcaactccttagggtatctgcttatgggggggttacctggtatcaaatacattgaaggggcatggccaaagaatctgctcaaaagagctttccctccactcggaaataaggccttcaaccaatacagttcccacttgtggaaacatttaatttaaatctagggccacaggtatacttcaggaagggagacaggaggagcaagtccaacattatgaaaaactgatagcctggcttgctacctaggctgtgtgcagaagtacaaacagagctcagcacaacttagaaaaccctccaaatgtaattgtgacagaaggccagagatcaccatcaagaattctaagaac

SEQ ID NO: 122431 - DNA, 281 bp, Homo sapiens
gtacatattttattgaatcacagacatagatgggaacaattatttaaaactttaagggagaaaaacttcaaactgaggaaactatactttaagtacttcctagaggttgagcataggcaaatgactcagtctcactgtgcctccattttctccgttttactataaggtgatgaggcagaaggcctgagactattatcaaggtttctggaatgtattacattctccagtaatgcctgttttccttccattttatttttttcctctaaagactggaagaatgt

SEQ ID NO: 122432 - DNA, 148 bp, Homo sapiens
aacaccgcctttagtttttctggagctgaagttttacacttggcatattactttttagttcctttaggataaaacccgcacaggtgaccttggtgacaaagcccctcacagcagtccctcctctacccttggaggggctgccgaccac

SEQ ID NO: 122433 - DNA, 215 bp, Homo sapiens
acactaagctctggctctgtgcccctcagggatgagagagagctctggcatgttactggactacagatgtctcagaagggaagcaggagaggcatagggcaacccagaatgctatctgctctcccttctccaggtgtcaccagattgaaataaacatctgaaaagagggatctatcatgtggcatctgggtggcaccagatgttgggagggaacg

SEQ ID NO: 122434 - DNA, 218 bp, Homo sapiens
agggctgagaatggggttggatcttctatggtgatgcaagtcagggatgaaggctgaattgagctgactttcctgctgctgccaagagaaggctaatcaatggaagggagttgggggtaggatctagaataaacatttgttgaaattctcatgtgttagaggatgggaggaaccatgccatagctaagataaagccaacatctccgatgtggttgtac

SEQ ID NO: 122435 - DNA, 345 bp, Homo sapiens
catgtcagcgaagagtagccataactgctctaaaagtttatcaaggcccgcaagagattttctacaaggaaaaaaaaaatcggaaaaaaaaaatcagtagtttaagtgtgcttttgttatttttaaatgctgcctcttttttgtgggaggggcaatgtttcaaagctctagatgtaacagctctcttattttcttgtcctatatctacttcaaagaaatgtagcaagaggctgggcgcagtggctcacgagtagctgggataacggatgcccactatcgtgcctgggctaattttggtattttaagtagagtgggggtttggccaggtctctactcgggaaagtg

SEQ ID NO: 122436 - DNA, 419 bp, Homo sapiens
aattcggcacgaggtggactgagacctacaggacacagcgactcttaaataggtggctcaccaggagaaaggcatagcagaacctggactgagacctacgggagacagcaggcagacacacaggaggttggacgtcgagaggagcacatcagtgcaagaacacatgggtggctgccacttctctccctttcctgagagggaaaaactctcgacgctgagaggaatccaccaacaggcaccagcactctggcaggccaccgaccaatggattgacatagagtttggctggggcagccagaggagagcctgggccgctgaataacccgacttcaggggaaaactattctcccttttggctcccccatctgctgagagctacttccactcaataaaaccttgcactcattctccaaaaaaaa

SEQ ID NO: 122437 - DNA, 450 bp, Homo sapiens
gggctccaaacctgggcttgtgcccctggacctagatgaggacaggcatttttgttttcctgaccaaatgttgcatttcccaagatcaccctggcccaccatgccctatcctgtgcctaaaaaaaccctgggaccctagcaggcagacacacaggaggttggacgtcgagaggagcacatcagtgcaagaacacatgggtggctgccacttctctccctttcctgagagggaaaaactctcgacgctgagaggaatccaccaacaggcaccagcactctggcaggccaccgaccaatggattgacatagagtttggctggggcagccagaggagagcctgggccgctgaataacccgacttcaggggaaaactattctcccttttggctcccccatctgctgagagctacttccactcaataaaaccttgcactcattctccaaaaaaaa

SEQ ID NO: 122438 - DNA, 491 bp, Homo sapiens
gttttaaattttatttatgtttttagatcaaatagttcagattgcattggtttttaatctgctgttgttggattaacatatgctttaagcgactcttaaataggtggctcaccaggagaaaggcatagcagaacctggactgagacctacgggagacaggtattgctttttctcttctaatcattttaaatttaatttaccatctttcatcaaatagctccgatcatatcattattttttcttttctgttttgttggtggttttattggtggagttttattttactattttagaaaagcagtcttttaaaaaagacttttaaaaagttttattactctttttttaaaaaaaattatgttttcccttgatgtgcttatttcctttataaagatcatcaccattaaattactaggagatactgcggctgattttgtcatgcgtgagataagaaattttttgccaaagcaattagtgatgagtgcaatggaaaa

SEQ ID NO: 122439 - DNA, 485 bp, Homo sapiens
gttttaaattttatttatgtttttagatcaaatagttcagattgcattggtttttaatctgctgttgttggattaacatatgctttaagcgactcttaaataggtggctcaccaggagaaaggcatagcagaacctggactgagacctacgggagacaggtaacaaccgcgggatacagaaagccctctgtctttgggttaaggaatgggtctaattgagctggttaccacaaagccacctatagatggcaaaactaaaagagcacatggtaccacatgtccactggggcttcagcagctgtaaacatctacccctagatgctgccatggggttgtagccccacaacttgccagtctgtatgcttccctagaggtttgagcagcggagtactaaagaagcaagccacacccccactccacctcctgtgagggggacaaggaaacttttcccatttcaactggtggctcgtctgggatctcggaag

SEQ ID NO: 122440 - DNA, 722 bp, Homo sapiens
aacaaagcccggtactttcagtcacctgatctttaacaaagcatataaaaacttccatctaagacctgaaagtctaaaaatgctacaagatagcatccaaaaagcttttctagacattggcttaggccaagtagtcatgactaatgccccaaaagcaaacgcaaaaatataaaaatagaataagatcaataggacctaatgaaaccgaaaatcttctgcaaggcagaagaaatatcagcagggtaaacacacaacccacagtataggaaacagtagtcacaaactaggcatctgacaaaggactaatgtccagactccaaaggaactgaaagaaatcagcaagaagaaaaggtgccatttacctgattatgggttgtactgaattaaaaaagatcaattgtacacttactcctcagacaggataaactgtcctggggtgtacagctttaacaccatcattaaaattgtttgcaaaaggaacagagaattaaaaaacaaaacacttttctttttggagtgaagagtctttcatttgctgttataaccagcaaatgccattcactaaatcaaaaatggaaggaagggcccccacaaacacagatctatctgagcaagctgaccagtacacattacagtcttaaaaatgaaggttatatactctatgttacaagtcccgactaggcagtgtcaaaacgacatctatttctttgcttgttccgctg

SEQ ID NO: 122441 - DNA, 861 bp, Homo sapiens
aacaaagcccggtactttcagtcacctgatctttaacaaagcatataaaaacttccatctaagacctgaaagtctaaaaatgctacaagatagcatccaaaaagcttttctagacattggcttaggccaagtagtcatgactaatgccccaaaagcaaacgcaaaaatataaaaatagaataagatcaataggacctaatgaaaccgaaaatcttctgcaaggcagaagaaatatcagcagggtaaacacacaacccacagtataggaaacagtagtcacaaactaggcatctgacaaaggactaatgtccagactccaaaggaactgaaagaaatcagcaagaagaaaaggtgccatttaccaccttcctgactcattggccagaaccaatgttagtggaattaacatatgccccaccccaagtgacttctaaagggctaactcaccacaagggagtcagagcagatcttggactgagacctacaggacacaggtggctcaccaggagaaaggcatagcagaacctggactgagacctacgggagacagcaggcagacacacaggaggttggacgtcgagaggagcacatcagtgcaagaacacatgggtggctgccacttctctccctttcctgagagggaaaaactctcgacgctgagaggaatccaccaacaggcaccagcactctggcaggccaccgaccaatggattgacatagagtttggctggggcagccagaggagagcctgggccgctgaataacccgacttcaggggaaaactattctcccttttggctcccccatctgctgagagctacttccactcaataaaaccttgcactcattctccaaaaaaaa

SEQ ID NO: 122442 - DNA, 250 bp, Homo sapiens
cctggataacagaacgagaccctgtctcaaaaaaaaataaaaataaaaataaaaaaagataaatgatagaagactgggaaagggttcatcaggttttataatgatgtcttccattgatggacatttgtaaatagcccctacaaaaggcagaatatgtccttctatcagtaatttatatgttgcaaaggataaattgaaaagggctggaagaaacatttggttttgggaatgtacgatgtataaaaacatc

SEQ ID NO: 122443 - DNA, 360 bp, Homo sapiens
tcaagatactagcccacccctttttcttccccagggaaagaaatcctcattttgtaaggtcatttactacataaaagtaaccacaagtaggaaagataacagaaggagaggaggacaggaaattctcatcacagctgaacaaacctctattattttaacataacatgggtggcatttatgcgcttatttgaactgatggaaatttccagtagggggaaaaatgcattaccaacattaaaaataaatgtccaactattaaaaaataaaataagatagctatgcccagctttaacattttatactctactccatgtagtagtcaaacatggaataaatttctgtaatgacctatcacaatag

SEQ ID NO: 122444 - DNA, 628 bp, Homo sapiens
tgcagcgcaccagcatggcacatgtatacatatgtaactaacctgcacaatgtgcacatgtaccctaaaacttaaagtataataataaaaaaaaattcctatattactaatcaagtatattttacaaaataccactgagtgtggtgcatccaagattctgaggatctaatataaattctggatctaacaattttgtttctgctcacagtatctccaaaatttattgagtttccatagattttagatctgatatgagccattttaccatgttaacttattaaccctcaccatatcctctgaactggatatcacaattctcatttctaaggtgaaacaccttaagctcagagaggtagcatcagttatttaaagtcacgcagcaaagaaagaacacaggtcatgcctgttagatttcaaaatcacaccatcttagctctctctgtaccagtaacctgaagttacattcctccaattgcagataacagtacaacataaaacggtagctcttcttattattatcttgccaggaatttaaaaaatgaataagatagaatttgaaactggaagacaatctcaccacattttggaaagattggtttccaaaatgtgactaaatagtttacttgag

SEQ ID NO: 122445 - DNA, 150 bp, Homo sapiens
atgtcccacctcttcctcctcaaggtagacacaaaacatcttctatatccttacccccagctttcaaccaactatcttattacaccctggaaatgtctacattgcggaaattatagccatgttgttttcgctcataaactgtaaatttct

SEQ ID NO: 122446 - DNA, 587 bp, Homo sapiens
ctttttctcaagaggtaatggtgtttaggcctgaaatctgatgcaatgacaacctaaccaacaataattaggctcatcagtcaaggaaattacaaggaccctttgactaaagtcttttgctgaaatgaataaaacgctcaggggttgaagaaaatatcctcagataaatagattttgagaaagatgaatagacccttagaaggatagatgatggtttgtaacaaggtctgtctgggtgtggtgaagtctcctttcccgcaatgagttaattttcagaggattaatgacaattgagtttcttttgtaaaagctatcttaaggcagatggagggaccctcagagagccttgcatcttgtgtttttcaagttcctgcagctcaaaataatcactataataaagcaatatatttttagggtagcattacctaaatttcttcaatgctggctttgtttaatgagcaatttaagcataattgtttagaatgagtaaattaggaggagtataaatgggatggaagtttgtggatgaacttgacatggtttctgagcccttttaaagtaaattaaaatgctgaaatatgctgctc

SEQ ID NO: 122447 - DNA, 121 bp, Homo sapiens
ggtctacaaatcccttggggatcatgacctgcctgaggactacctctgacatgtcatctcctactactcacccctttgctcatccatacatacaccctggcctctggcctcttctcaaaca

SEQ ID NO: 122448 - DNA, 159 bp, Homo sapiens
tctgtgctgagctcatttcagcctcacaactgtcatgtgaggcaggcagtattgttcttcccatttcacagacaatgagattgaagctcagagaagctaggcaaccagatagtgtgatggacccagagtctgcactcttaaccccaccgccaaaagaaa

SEQ ID NO: 122449 - DNA, 233 bp, Homo sapiens
gcagcagggatgagtgttgcagtaatccagatgaagtctgacaggggcaaggaccagcatagtagcaatggtggggagagcaagtaataaactgaatgatttgggggagcaggggaagaggttaggatgggtgctaggtgacataaccaaggctaattatccaatttctgccttaggcagaaacctattcatatgggataaggagtatgtgggggattatgggattatgagtt

SEQ ID NO: 122450 - DNA, 225 bp, Homo sapiens
caacagaatgcaaatgatgatgtgacatgcttgcaaagctaatttctccagtttcttatgtaagggcagatggataacaaaagttctctttctaaaacatatattgagaaaaataatagagaacaggctatcagctggcttctttaaaaactcactaacatttttagaattaaaaatgttttgaagaaaagtgcagtgtttttacaggtaacatctctcctttgt

SEQ ID NO: 122451 - DNA, 937 bp, Homo sapiens
agcaggatgacctagcttaatttgaagagacagtaacttgctggcatctggctactgaaaagaacaaaatggttgacctcctagtagtgccagggactatcttaaaagcaacaatgatcaatgggtcagaagttattaaaataaagagacaaagaagagggacattatgaagttaaaatggcaagatgtcatgattggttgctttagaaatggggcagaatgaatgaaaatggatgcgaatatttctcacccaggtaacggtcaacatgatagccacatatggaaggggcgtggagaagaaaggataggggaaaaagaagaaagcatcagattccttgccagaggaaaaaaatgccatccttgaaggcagctatagaatcatcatcatatggaattctagatacaggcctacaaaaatgtttatacttgtattcaaagatctagaggaaaaaggtttaatcgactcacagttcagcctggctggggaggccccaggaaacttacaattatggcaaaaggtgaaggaggcccgaggaaacttacagttgtggcaaaaggtgaagcaaacatccttcttcacatggtggcagaaaggagaagaatgagcaaaatggggaagagccccttataaaatcatcagatctcgtgagaactcactcactatcatgagaacaacatggaggtaactgcccctgtgattcaatgacctcccaccgggtcccttccacaacatgtaggaattacgggaactacaattcaagtattcttccttggatgaaaggactaggagaaagccctgcaaccccacgagtccgcccgtttgttgaaatcagttcaagatcatccaggtctgcaaaactcggctgaagcagcttgttgcataatttaccagagaaaagagggccatctggagagccaatctggagaactcgagcaa

SEQ ID NO: 122452 - DNA, 853 bp, Homo sapiens
aaaatagatgactgtattgtggaatgggatataagtatttcaaaaaatctgagtgcctataaaataaaacttcaaggacattttagaccattccatgggctgcctcagattgtgccttcaaatcctctggaatcatacatttactctcatattctaagttgactgtctctgtcatgaagattatagtcgtaaaaactgaagcagcattatttaagccaaggtatgttaaaaagactgtttctttaaaaattatctttttcttggtttctgtgcctagatactaactttgatatcactcttttctatagtacaggagagagaacagttagccatgaaaagatgtatagataggacaaaaacttcatataaataaatacctttcttcttataagccaaaaaatttatttttacatagaattggataaattttagaatacctattaggacaaagaaacaaatacaaacctctcaactctaaccaattagcttttcttaaaccctctcagttttggcttattctcagctaaataaacagcccagatcacaagattatagatacctctttgcttttttgtccaactgataccatgtgtctttttttttttttttaatttgcctgatatgactcttgtttcttagagcaaacagctatcattccacattttctcctggaatgatttcctcatctctggttttctgccttccttgtctctcccaattatcagaacactaactaatgccatggtgtctgctgtgactaccatagctttttaagattatgccctcccctggtaaaactgttggcatggcataacaatctgttatcttttgtgtttcggaagtggaggggaga

SEQ ID NO: 122453 - DNA, 128 bp, Homo sapiens
caggaggattgcctgagcccaagaagttgaggctgcaataagccatgatcacaccactactgcattccagcctaggtgacagagtgagacactatctaaaaataaaatgaaataaaaataaactagag

SEQ ID NO: 122454 - DNA, 221 bp, Homo sapiens
cccctccagttcggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcctgcttgtaatcccagcactttgggtggccaagggaggaagattgcctgaggccagcag

SEQ ID NO: 122455 - DNA, 417 bp, Homo sapiens
actgcctctctgaccccagacgtctcatctgtcgaatggggacatttgggaacagcacccactctacgaagccaccatggagacgaaagagccaatcgtctacacgggcagtgtagaacgggcgcctggtgagtgctcagggatgaccctcctcggtagctgccccacagaggccaacaccgcccgcaccgtagccactgcccccaagtccgcctggagggaagagagcaggtcacgctcacctgattctgatgaatcagctggcctgggtcatgcctctcagggagaaaacctttgagtccacagagctgctcacagataccactgcctgtgtgtaactgctgtagaccactgaggcagaccagagagcagataggtgctaagcaccagtgacattctgaggtcatggcacgaatc

SEQ ID NO: 122456 - DNA, 290 bp, Homo sapiens
aagggtggagtttgtgggggtggtaaaagagatattggaggcagtaccggagacagaaagctagtaatgatgaatgtgtggggcagaacagctacaatgtgcagccaaggttgtaaagcattgatctggtattatcagctgttgatctgtaaccgttaattgccaaagtctaccacaataaagcacagatgggctaagaccatctttcctgtaagggatagtaggatagctgtgcatgtgaaaggggatagacacctggaggtttcaagggatggcgctgcctgcacctg

SEQ ID NO: 122457 - DNA, 453 bp, Homo sapiens
caaagtgctgggattacaggcgtgaaccaccacacccagcagtctgtgcttctcaacttacagccatctctgaaccacctctcagagccaaagtcagaactcccctgatgtgaactgccacccacagggcctagtgtagaccccagggatgggtgtggagataaacaggccagattctaggtaccaggagatgcccaggcacccataaggagtgggtgtgtctatgtgggagagagagacttaccctcccagtgccttggttcctccccctccccttccatccccacattccaggtcaggcccagggcttggggacgctcttgtctgaagcagctgcaggcaaggagcctgttaactctaccatccatcaaagtgttttggcacatcctgtttcctctctgcttctcaggcactaattaaataccttcagcctttcaccagggtgggaccagg

SEQ ID NO: 122458 - DNA, 775 bp, Homo sapiens
caagatcggtcctcctctattggggatggtcgtcctctttcacccagtgtgcagctttggaagggatgcgcatggagcgatgagggaggaagtggacacccacctagccagccagatcagcccagttacccctggcgatcaatggggtgacagatgtcgcagccagatcaccctcacattctttcttttgaaataaaatttactacaatgaaatacataaatcttaagtatataaaatttgaaaactacatatccctttctaaccaaaatccccatgaagacatagtagaaatggtatcagcaccttaggaaagttccctcatgttctttcacagttagtccctacctcttccccctcaaatgtaaccattgttctgatttttcctagcatagattaattttacctgttctaggacttcatgtaaatggagtaatgcactatatactcttatgtgaggcttctttcattcaggatcttattttgagactcatccatcctggtgcttgcatcaatagtttgtttctttttaacattgcattgtatgagtataacaagttatttatcgattttcctgataatcgataatataaataatcgataaacaacacctgggttgtttccagtttttgtctattaagaataaagctgctatgaacattctttttatgaaggatctttttttaacttgattttttaaatgtcttctatttatatcgaacctgtatatagatcactcttacccagtaatatcttccatagtctccccttttgtgc

SEQ ID NO: 122459 - DNA, 427 bp, Homo sapiens
cattagtgtctctgctcaaactgctgaaacctccccagcaggagccacacacctagaacaccatggtaaaatgaggatgtgtgaaaaatactcaagtcaggtctgaacctatggtactgtttggatgcttggagtctctgcgtcactgagtaagtcttgcccctgcccacctccagtaaagttgcgtgggacaagcgagagtctccctgccgtgtgtgtgtgtgtgtgtgtgtgtgtgtgtgtgtgtgtgtattcctgtcagtgtagttctaagggtgatatatatttatatttaaccagagaggagggggggagatattcctgggctttcgctatttaaataatcaattcatgagagagactcagtgttataagaaaaaagtgcagtggtatttaaattcgaacatatacagaattctttgctctc

SEQ ID NO: 122460 - DNA, 854 bp, Homo sapiens
caaccaaagccgtctaagcctgagaaccttggagtaaaccgtttaatttgatttcatcgtgttaaaacaaacactcatttgttagtttttgttttcattcccatcaggattttgaaccttttggtgacatcacctgtttttccttttttgagaagaattcgtttttagttctcttcagcagttctagttcattaattcccatagttgctgctacatgggaattagcaatttccctgagcaatttccactctatatccaacacgtaagtgaacagatattttagatgtggtttcaccttttgaaatgaggcagcaattcaacagttcttatgcaatgaataagaaaatgttccgttctagaactctacagaagctgttgattttattttgatattagtaataatcatatctgaattcttttggctgtgaagagcagaaatcccaatttatagtagtatctgaatggtgtaaacagcagagaaagttacctctcgaagctggaagtcacgagacaaggcacctcattttcattaattcaacagctcagtgttgatgagggcgtcaaaacaccaagttctgttttttattttgccatctcagcatattgactttgtcctcaggctagctccttgtaagctaaagatggaccctgcacatgtagacgtgccaacagcaagtgtcacactaagagtaagaaaggcctttccaaaagctctgtgtcatgcttcatcaaccagacctaagttttctgcctcccataaaccagtcagttgcaaggagggtgagatgacagtgatggggataccatagccaggatccctggaatagtacgtccaccttttagaagtgagagaa

SEQ ID NO: 122461 - DNA, 209 bp, Homo sapiens
aaaacatttaaaagttaatatactttaacaaccatacatacacattaagtgtgggctgtttttcaaatttctaattacactgttttgaaacctacttatcttaggaagggatggaacactaagggagcagtaatcgaatgtcttcaggagggacacagagcccgccaggagtctgcaccaaaggctcagctcctgaagtctgcagtgaa

SEQ ID NO: 122462 - DNA, 791 bp, Homo sapiens
agtttgagtgcacaaaaaaggccatataggggcccagggagaaggcagccatctacaactcaagacctcatcagacactaactcttctggcactgttatcttagacttctgactttcagaagtgtgaaaagataaatttctgtcgtttaggttaccaagtttgtggcattttgtgatggcagcctgaggagactattaggtagacattttgatgggtgcttaccatgaatggagcttgaaggactggaagttgctctggacatgaatctgaaatcactctaccccaaaacaacaataacaacaacaacaacaacaacaacagtctttgtttaagctagagtagcagtggaaaagttcactctattcttgggaagacataaaacttcacttgctatgctccatgaagtatccagaataattctatgcatagccattaaagaactctataaaaggcactgaatgttgagaccactcaagcaatctgattgcttaattaaatgtctagaaatgctcaatatgtgccaattgaaactgtatcacccataaaaaacagcgacatgctttctctttttcttttaatttttggtttataatagcaataacaacgttggctgtgggcatttcctggagattaatgactggttaggctttatggcccggactgcttctcctgtggacaatcaactcctccccacttgtcgttcatccactgaaaagcaccacacagctccctctggtttgttaaggaatgtcagtatttgtcaaagctggtggggattggtttgtgaata

SEQ ID NO: 122463 - DNA, 275 bp, Homo sapiens
gagatcaccccactacactccagcctgggcgacagagcgagactccgaaaaaaaaaaaatggagaaaaaagaactcaaaagatttgtcaaacaaggcaatttctggtccttgcttagatcctgattaacggggactacaacggtgccctaccacgcccagctaattttttttctttttggtagaggcagggtctccctgtgtggtctaggctggtctcaaactcctgggctcaggccatcttcccaccccagcactttgggaggccgaggtgggt

SEQ ID NO: 122464 - DNA, 570 bp, Homo sapiens
gggcagtgcagcttgcttctgcggtcgatctaaggatccccttttccacagggtgtagaaatgttctaaaattagagtagggcgatggttgtacaactctatacatatacaaaagcccattaaatgtcacactttaaattggtgaattttatagtaatgtatataaattgtacgtcaataatgttagaaaagaaggaaagaaagagagaaagaaagaaaaaaccctgccatggagagggaacaagcagtaaaagagcatgagttcctgtcctggagagatttgggtagtcagtgattgaatgggtgtgtaccgaggcccggtaccatatggcgcaccagccagtgtgaacacaacacaattctgtcctatggagcttacattctggtgggaaggactgacgctaagcaaataaatgtacagactacaggttgtgataaggggaacgaagaaaagtagagtgaggggacatggaactggggatgccttttttgatggtgtcgatggccatctggtcgttcacacccctggctcagcgtagggagagtccagacacatcgtgggaggaacag

SEQ ID NO: 122465 - DNA, 316 bp, Homo sapiens
aagggcaggcagtaaattcaatgattaaatattctaagtttggaaacatgcatttgatatcaatctctcttgtagattcacaatgcctagtaacattctaacagctatgagaagtcccgtgataagaagctatttaacttatttagcccagagttctcaaaatccatttggtcacagaattcttttggttcggttgtatctacttatatctcataggactttttttccccccacagaacagaatttggggatatagaaaataccattattttaagtttatgataccatatgaacaataccagttctttttattgac

SEQ ID NO: 122466 - DNA, 394 bp, Homo sapiens
tcagctcaggtcaggaacacagatcttatcccggctcttgcactaattatctgagggggagtcatgtgatatgggccagtgagacttcctaggcctcagtttccttgtttattcgataaatatgtttgactagttaatacaataggtgtatgtgtgtgatgcggaggtgaggagcggcttaactattttgcaagaaaaaccagtaactagtttcattgtcttctacagtgagcctctcaccctatcctagtcattaaactctgccagtgtggtcaagaagtcctagccagggtgaaatggaagatctgaaaagtcctcattgcaatgtgtaagaaatcaaagtaattgtcctttgcaaggctcagtaataccttttcatacccagcaggatggg

SEQ ID NO: 122467 - DNA, 756 bp, Homo sapiens
gctattttaaactatatattattgttaactatagtcatcctacagtgttagagaatactagaacttattcctccttaaggtaatgttgactttttagaatgagttaggaagtgttctctctgcttcagtttttctggaagagattgtggagaattaatatcatttcttcctgacatgtttggtagaattcaccatctgggcctagtgctttcgttgtagaaggttattaattatttattcaatttatcttatagatataaatgtattcagattatctgtttctcctttgtgaaatatgatagtttgtgtctttaaggaattggtacatttcatctaagttatcaagtttgtgggcataaaatttttcataacattcctttattgtccttttaatttccatggcattaatagtgacaattcttaccatttttaaatggacttctaaattttatcattagtagttgtaaagaattaactttctatatattgtaaaatgtattgcttttgctgaaaaattaaatgattatatattttcttaaaatgtatctaatgggccaggcgcggtggctcacgtctgtaatcccagcacttttggaggccagggcgggcaggtcacaaggtcaggagatctagaccatcctggccaatggtgaaaccccgtgtctactaaaaatacaaaaattagctaggcgtggtggcatgtgcctgtagtcccagctactcaggaggctgaggcaagagaatcccttgaaccca

SEQ ID NO: 122468 - DNA, 153 bp, Homo sapiens
ctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagc

SEQ ID NO: 122469 - DNA, 758 bp, Homo sapiens
ggatttctgacacggtaggactggggaaagacctgagaatttgcatttttaacaagtcatcagtgtatgtcatcagtggatactgatggctttggtctgtgaccacagtttgagaaccagtgctatagaaataatggggttaatttggctttcttcacatgtgcagttaagcatatctttgtgggtttttttggatgctagctctccaaatactgacaaagtctgcttagtggtagaaaatgtcagttttaagtggtaatgcgtaaacatttttctttatcccagaatgcaaatctaccctcaaaagcactgttatttgaagtgaagcaaattgtaaccatagagtagatatcaaaacttgtgtgcctttctaaccaaagaagcgcatctgaacaagattcatagggagattttggttgtttcccatctttgttcagtcagtttagctggctatttttcagttttgaaaattgtaaaaatggaatggttttccatctgattgtgttactgcttcacaaatcaagtgtcttttaataatactgtcctgaagttactaaatgtagtgccattttttgccacatgacatttatgcagtgcaaagatacttcattattatataaggcatgaaaaacaaagtgttaaattaataatattgtttgacacatccttgaaattgtccttgaattatggtagtatgaaatacctaacaatttgcatcatgtttaaactcagattgctttgatataggaatctagaat

SEQ ID NO: 122470 - DNA, 853 bp, Homo sapiens
agagcatttgaggccaggagttcaagattggccaggccaacatggcaaaaccccatctctattaaaaatataaaggttagatggccatggtggtgcacacctgtaatcccagcactttgggaggctgaggtgggcggagcacttgaggccaggagtttgacatcagccaggccaacatggcgaaaccccatctctattaaaaatacaaaagctagatggccatggtggtgcacacctggaatcccagctacttggattgctgaggcatgagaatcgattgaacccggggcagaggttgcagtgtgctgagatggtgccactgcagttgcgcctgggtgacaaagtgagactttgtctcaaaaaaaacttttttttaagtagtataataatcaagatgaaaaaatcactagaaagactcagcagtagatatgaactggcagaagaaagactcagcaaaataggttgatagagattaaacattctaaagaacagagggaagaaagaataaagaaaacagggccttaaaataatgtggggcactattaagcacaccaagatatgcataatgggagtaccagaaggagataaagtaacagaaaaattatcaaagaaataatgctgaaaatctcccaaatgtaatgtaaatcattaatgcacacattcaagaagcccaaagaatccaagtcggaatactcagatccacatgcagacacatggtaataaaaacgctgaggcctggcatgttggcgcacacctgtaatccctgcactttaggaagccaagaagggtggattgcttgagctcaggagttcaagaccagcctggggaatgtggcaaaaccccatctctttga

SEQ ID NO: 122471 - DNA, 433 bp, Homo sapiens
gttactatccccattttacagataaggaaacaggttcagaggacattactgcattgctggaggacacatagcccgtaagtagcagagccagaattggaacgcaggcctcctgatgccaaagtaatacggcctttccattatgtctactatatgtaacctaagaggacaaaatggagagaggaagaaaagatcaatctgaaagctgcgtcctttggttgttctagctcaggtcaccacacatgctaactccctgttcccatcaaaaggcagctggccttgaagggctggagcagggtcgagtatacaggagactcagttgacaggtgaactctgtcccagtccactgtcttccatgtgtgcgtcccagtgaaggcagagtcctgggaagaaaccatccgtctcatgcgcctgggtcgagagagggaatccgggt

SEQ ID NO: 122472 - DNA, 1538 bp, Homo sapiens
cttctgctcctttgctctggggaagagtcctgtaatgaataatcctgtgtcgtttcacatgaatgtctgtaggataaatgcttaggagcagcttttgaggtcagagggtttgtgtatccatcattttgagaaatgcagctgctcggctgtccctaggagttgttgtgacccacactcctaccaggccagaggggagttcctgggtgctccacatgcctgtcctaggcttttggacatgctggcccccagatctgcccctccatggctcctcactgccctcagcagagagactccagggcccttgtgacccacctgtcagctctccagctcctggttccctcagaaccatcccttggggcccgggtgttcaggtcccgcctcctgcacaggggaggaagagttagcacatgagtggccgtgagagggtcactccatggggaggaaaccgcaagggctgtttgagaggagggagtggctgggctgaggctggagggtcttcagagcagtgcggggcgggggggaaaggggcgcctgcatcttagtcctgaggacagagagaatccacgggggtcaggggacagtttgagacaggggagtaatagctttgtgttttgtgaaaagatcatttttctgtcgtcagtttctctaggagaacactgcagcccctgccaagctgtatctgactccctccaaatcccacttatcacagttgtaattatgggattaattcactgtggttttgtttcagagggagtttccattcaattttatttaatgagataaaatttgcacaacataaaattgaccattttaaccatttattcgtttttaaacttgagatatggtgcacatagaaaacatttgctatggtagatggattatgttcaaagaataataggccaggcgcggtggctcacgcttgtaatcccagcatgttgcaaggctgaggcgggaggttcgcttgaacccaggagttcgagaccagcctgggcaacataggaagaccctgtctctaaaaatataaaaatacaaaaattagccaggtgtggtggcatacacctgtagctctagctacttgggaggctgaggtgggatgatcacttgagcccaggaggttaaggatgcagtgagctatgattgcgccactgtactccaacctgggtgacactatgagaccctgtctcaaaaagaaaaaatagtacagggaggccaaggcaggagggttgcttgaggccaggacgagagagagaaagaaagacaaggaacaacagtgtcctaactacccagctttgaaaatagcagctcaaggccaggtgcggtggctcacacctgtaatcaccagcactttgggagactgaggcgggtggatcacgaggtcaggagttcaagaccagcctggccaacatggtgaaaccccatctctactaaaaatacaaaaattagccaggcatggtggcacaagcctgtaatcccagctacttgggagactgaggcaggagaatccttgaacctgggaggcagagcttgcagtgagccaa

SEQ ID NO: 122473 - DNA, 318 bp, Homo sapiens
aaaagatccaaataaatctcatcaaccccgtctaatggctttccatttgcatcatgattccttttctgcctatctctccttttcttttctgcctcatcttttaccatagccctgtggtgacattatgctaagccactagtgaccctgcagccacagtggacttctttcagcttttcaggtttttgttgttgttgttgttattgttgaaaaaaagtcttgctctgtcgcccaggctggagtgcagtgttgcaatctggactcactgcaacctgtacctcccaggtgcaagtgattctggtgcctcagcttcccaagtag

SEQ ID NO: 122474 - DNA, 460 bp, Homo sapiens
cgcctgagaaggcagagcgcggtgcggacctgtgctccgcgcgccggctggcagggcagggccgcggctgccaggaggcccgggaacagtcccgacggagcggcgcggagagggcgctccccggaagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctggggaggcacctacaaagccagcagactgacacccgtgtcctagccgtcggcggcctgcgaagcgatagtcaaaggaaccaggacccaggaccccggcgctctgcttacccg

SEQ ID NO: 122475 - DNA, 755 bp, Homo sapiens
agtttgcatttagattacctgcaaaaatggaacaatttactactctgcctctaaccatctctttcctcctttttcccttagtttgacttcttgtaactaattatttaaattctgccctgagttaaaattagtcatagcttacatgtttcacatgtatgtaaatgcacttaagtcctacctcaagctgtatgatgagtccatctagacagaagtgacaggaagggaagggaatgtggattgtttgataggcagaagccacagtttataatagtttcacgattgaaaggcatatttgaactttttcctggcagtgtttaacctttaaaaacaaaatcaggtggagagaatgaactcagtagctttttgatgataacatattgtagcaagaaaggtaaaacacaaagtgttaagtaaatgatggtttggggatttgattcctatagatgtcttatctgtaattttttaaacctgacagtttcctctatggtacacaagatgtaaatgaaaattacatcataacattttctgtcacgaacaaaagagtggtagtccttcttttccccccttcctctctacccaaaaccttttctgggtaagtttattttcaaaattattgagagccaggtaacattgactattctttaactgcttcaaattgttcatagtcaaatacttctcagtactttaatttttaatttagagcaaaatataagaaatcaattttaaagcataaaatgacactgaacagagatata

SEQ ID NO: 122476 - DNA, 530 bp, Homo sapiens
tctttagagaagactgtccaagtcagtgactctcagctgcatgtgagatgggataaaggacgtgggatggggagtagatcctgactcctgatggtgcatgtcacctttttaaagctatggacaaattattgcttgattctggttatgtgtcaggtagagaatcactactggagagagccactgatacagacagggaatgtccttttctttgggtgtgctatgtgttatcttgggtgttctaaaacagaagagaattgtgaggcaatgggctaacgaactgccacactagtacacaaccttatagagaaagaatgaagccttggctagtctcttcctaaagtcctacagggaagtgacccaagctagttcaaaaggtactggaaaaataaaaagccaaaaattctcaaaagaacgaagtcaatgttcccttacttttcaggttacaactttatctttaatatcatatcacttaattttttttcatttaaaggaccttacttttttctcttttcgtgattcattacataagt

SEQ ID NO: 122477 - DNA, 298 bp, Homo sapiens
gccatgtggaactgtatgtccaataaacctttttcttttgtaagttgtccagtcgtgggtatgtctttatcagcagtgttaaaatggactaatacaatcactctatcaaatgagataatatttattcctttaccactgacaactctctctcggctcttctattcaatcatgttactgatagacgctttgctttttgtttttgttgtttaacctgattgttatagcttattttatgaatttctgttcttcttttaattttacaacaattttactatttctccttacatgtttataagtc

SEQ ID NO: 122478 - DNA, 332 bp, Homo sapiens
ggttgtgtttgtatttgaagtcatgggcacagcgagattgaagaactcacctcgaacagctgagtaaaggaagatgagcctataaaggacccagaaaaagagcgacctgagaggggcccagaaagccaggacagagttgtatcccaggggccagggtgagtctgcttcgtgggatggagtggtcagcttggcatcgcggctgtggtgagtgatatggaggagatgtggctgccttcactgctttggtgggatgatgtgagcagaagcgaggttggagtgaatgggtgaggagtagcaggacgtgaggatctgatgatagacaggctctgaaa

SEQ ID NO: 122479 - DNA, 394 bp, Homo sapiens
tgggtacaagcaatcctcctacctcagccttctgagtagctgggactgtaggcacacgccatcccattcagctaatttttaattttttttgcagaagcaggatctcgctatgttgcccaggcttgaaattcatttttaataaactgggtagacatctaattttattttcttccaatcagataggtagttatgccatcaccatttattatgtaattgacacttttctcactgaactgaaattccacagagtatgagctctgttaattttagaaaagaggaaaatttacatttaacacaataaaatgataagaattatgatttaaaaatggattaaaatctacactctgttgaaatgttttcttgtgaactcaaaacctgaagaaataaaaaataa

SEQ ID NO: 122480 - DNA, 460 bp, Homo sapiens
cagaagacaaaggggagcctgcatgtgcagaaatcacatggtgagagaggaagggagagaatggcaggggaaggggtggcgctaggctgttttcaacaaccagctcttgagagaactaagagaggaagaacttgccgtggacccaggaaaggcattaacctattctgaatggctatacaagattacatcttctaaggtcacttcacgctctagaatgctttgattcctccagtcacccaggcccagaatattggacctaacttcatttcatccctgtcactcaccctgattgttctagattctcctcccatccaacatccccctctattccaccattcctttttcatcatgtgactccctcactctgaaatctgtgcctccagacttggttggcccttagaacagaatccttggtcttttgctggtggtgtggcacctccagtccactgcctggccctcc

SEQ ID NO: 122481 - DNA, 427 bp, Homo sapiens
tgcctctgaacaggcagcctctccttgaggtcctcaccctgccccagtcctttaaggccctttaaatcccttcatccatggcatccactgtaattccctaaatgcaggtgcagcttccggaagaggaggtgagtcatggagagcttagcgtgggcagggagattggagaagctactgcaagttcaaaggcaacataccccttccataaccctgaagcacttcttgcccctgtcacatgtgagttgatcacagtcctccctcgttttctcctctagcaccatcccccaccctatagatggagggtcctgagagcaggggtgccacatggctctgtgctgcagtggcttctaaggtgagtgtggctggatggggcgcaaaacagtcctgagtgaacgatgatgtttgtgtggacttggggagggaatgc

SEQ ID NO: 122482 - DNA, 297 bp, Homo sapiens
cgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcat

SEQ ID NO: 122483 - DNA, 262 bp, Homo sapiens
gtctgatgacacattgcaagcaacttagggggtggggtgactgtaagtatttatttcactatgggctcttctttcctggattttggcagatgaaaggaaggtaaagaactttagcttgtaaaggtactgcagttctacgaaggagtataggtaggagaggttggcaaagggaaaaccagaacatggctgtagggagaacccttgaagataaagatacaggctaaggggatgggcacggtggctcacgcctataatcccagca

SEQ ID NO: 122484 - DNA, 435 bp, Homo sapiens
aagcaatacaagtgcagaatcttcctagatctgttttctcttaccccctcctaattcaacagcagggatttttttgtttaacagcctgcttttactgattctttctgaaagattcatcatatttgctgtgggttgaatgtgtctcacaaagttcatgtggcgaaacttaatctccaatgcaaacactgggagatgggggtctaataagaggtgattgggtcatcaggttcctcgtgaatggattggtgtcattatgtagttaggttagttactgtgagaatgggcttgttataggagcaagttcagtcccctcttgctctcttgcccttctgccatgggatgacacagcatgaaggcccttgccagatgtgggcccctcaatcttgcacttcccagcctccaaactgtaagaaatctgttcttcataaattaacc

SEQ ID NO: 122485 - DNA, 146 bp, Homo sapiens
ggtagaaattgggttcaaatttgatcccatctttttaccagctgtgcaaccttggacttgttacttaacctctctgtgtctcttattccacatctttcacgtggggttgctgttatggttaattagaaaacacacgtaaagtgctt

SEQ ID NO: 122486 - DNA, 303 bp, Homo sapiens
gcggccgcctactactactaaattcgcggccgcgtcgacacctctagcccaccattcttagaggtatggaaaggaaggagaaggggcctctgtttattttctctgctgtgaaagctacttgtactcaggaaatatctactgcttccttctcagggctgggaatgccctagtctgttcttacccaagggtggtaacttttcctccaagtgtgcagctgtctgaaaatatatttgctcttgatgtgtcaccgggtcatgagtagttatctgagaaatactttacacatgggtgtctcctgagccc

SEQ ID NO: 122487 - DNA, 582 bp, Homo sapiens
gtgattttctgatattcatgaattctagagtcaatatatacttacatcccatcctcctttctttgccaaaattcgggacaaattttaactcagattatctagtgacattattttgtggacatttaaaaatattcttctaatttacaaaaaaagagaatatatcataatagtagtggaaatttaaaatatgagtggttaagagtaaaaacatccatgcccacttatcctaacaaaattctgtttttctagagttgtagtctaggagctaaaggcagagggcttagagtcagaacagatttgaatctcaacatctcctctgacttgctttttatgacactctcagcctcaattcctcatctgtgtgaccctcagagatagtttaaacattttgaaagattacatataacattttgacacacggtaattattcactaccataaattagattgcatagaatatttatgcatttggtttttatccctacttttaaaataatatttttgtatgttgtgaaagggagatttggcaagtcaaaggtaacagcatgtgtatagcttttaaagtatattgcccaattgattt

SEQ ID NO: 122488 - DNA, 373 bp, Homo sapiens
agccctgccctcgtgggtttatgatctcactgggaagcaaataaaatcacaaacctgagggcacaaccaggagaatcgccatgaactcgtgatggatcaggttttgcaccaaaatgtaagtcatttttgagtgtgaaaccaagaaccctctgggcgacacagtgcattggttagagcacgagatctggattcaggttctatttctgctgttcatttcctgtgtgaccttgaacaagtttcctcacctctctgagcttgggttttctcatgtatacaatgataaggaagtcttcctcatacagttttggagtttaagtaaactaatacagatcaagtcattgatgaaagagtgtgctaccatttatggtgctct

SEQ ID NO: 122489 - DNA, 318 bp, Homo sapiens
gtcagctgtaccttcatacaaattttcttttatttcctgttctcttgggatcttggaggaatatttatataaagctccactcattccacatttattggatgtctgagtggtaggtactggcctgtgcattagagacacagagatcagtaagtcatgggtccgtgcttgccagaaacctgtgttctgtccagggtttcttctttggaataaacaaacaaaacatctcttttttccaactttctttctgctaagaaaacataatttcttatataagaaatacctcacatattagccagatttgaaacttttcccagtatt

SEQ ID NO: 122490 - DNA, 512 bp, Homo sapiens
  misc_feature (63)..(63): n is a, c, g, or t
  misc_feature (70)..(70): n is a, c, g, or t
  misc_feature (74)..(74): n is a, c, g, or t
  misc_feature (84)..(84): n is a, c, g, or t
  misc_feature (90)..(90): n is a, c, g, or t
  misc_feature (103)..(104): n is a, c, g, or t
  misc_feature (109)..(109): n is a, c, g, or t
  misc_feature (116)..(117): n is a, c, g, or t
  misc_feature (121)..(121): n is a, c, g, or t
  misc_feature (141)..(141): n is a, c, g, or t
  misc_feature (174)..(174): n is a, c, g, or t
gggcgtcgttccatcagggaaggggacacagtgaatatggagtgctgtggcggctagtctaanagagggnccanattttagatntcaggngtcatattatacnnagtcnaaagtanntgtnaaagaagacacaaagtgtanaatatcagaatcagaatacttttccttcatttntaaaaaggaggctggccgtgagccaccgcgcccggccttcatatttctctttatacttaacttcctttttccttatctttcccatttgcaagttactttctagttcttatcgatcatttccttattactgttttttcctccttaatgagttggttgctagataataccttcggtgtttttgagaatctgagaatgatggaggagaaatggaaagataggaatagaaagagattacattaggaattaaatttcttgttcctctttttctgatatgaaaccaaattggaggttagatcatccagaaagagaattcagtgttttccagttttccaacctgc

SEQ ID NO: 122491 - DNA, 740 bp, Homo sapiens
aggacttgaatactctgcaataaggacagtaaacctttttttttttcattttataaaataactaacatatattatagtaggaggatctccatcttacagatgaggaactgaggcttacagaggtgaaattatctgtttaaggtcatatagctaggaagtggtatagctggggcttaaaccagggcacatagcatttccagtttttctaatgcttttgatcaactgtcctctggaaccttcttccactttacctgcttccaaaacttagaaccatgcctggccctagtgacctgtcttcttaatgcctgagcttagagtttctcctcttctagtttccctaacaagcagttagggatctgtaaacaaggtcaggaattacaccaggagaatgtcctgtttatttcagtggcctagatctgacaatggctcccctgtggagaattttttttttttttgtactctataccatcataatttaggatcttttactctggaaaatacacctgcatggagactagtggatgtgtgtattctttgggtaccggagccaggatgtagcaatcacaataaatctgcctgatttctctctctttttcactatccctttagggagatcccattaaacctttagaagctcttttattcgggtctttgggttaatatgcaaccaaaatttgttggtttgaattcttccacttaacccgttggttggttaaaatgcctggggtcaactttcgctg

SEQ ID NO: 122492 - DNA, 660 bp, Homo sapiens
tccctcttctttccccaatctttggtacccttataacggcacctaacacactgaagtatatccatatgtttgtttcctctactactgctcctccctgacccttaagaaacactgccatagagccctacagcttgatgggagaagtcctatcccttaggcatggaaagctattaagaatgtgagaactgtgtatgaggaaactaatttaataattccttagaatggaaccagttgaaaatttccagctccacaaactgaagtgaaatcattttttctccactccttactagtaaatttactgttctatgttaaaagaaaaaaaaaatcaaccagcatttaaattatggcaacctaaaatgtgtccagtatcttagaataatttccccactgacctattcctctgtaatagtaaaacatatacacaaatgtttatagctacattagtcataatagccgaaaggtaaaaacaacccaaatgcccatcaactagataaatgtatttaaaaaatatgacccaggcgaggtggctcaggcctgtaatcccagcactttaggaggctgaggtgggtggatgacccaggagttcaaggccaacctgtgcacctattttctacatactctcatctagttgtgacctggcgtgcgtgatcctctgaacgc

SEQ ID NO: 122493 - DNA, 251 bp, Homo sapiens
cttactcagcagctcccgccgtgctgtgacaccccagaatgtgtcatttcgaaacgtcacagctgccactaggtcatatgggagcgtggagctggctgggggagaggtgcaggtcagtgatggtttttttttcccacatgggatctttgaagaaaattttaaaatggcactcttattttcaatccaaatattcatatattgtattttccagaaacataatgagggaatgaaattgtggtttaagaggctgt

SEQ ID NO: 122494 - DNA, 405 bp, Homo sapiens
aattaaagtatgtgtgtggatatgtgtgtggatatacaaaattcttatttatgaacagagagaattgatatcctcggagttcaaggaatggtcatttttcctggcttaggtagccaactccacccactctgtaagatttctttaatgtcttctcagcttatcagtaaggtatgcatccattgaactttaaaaaataaaatttgttaataatacttggctgattatttgaaccttctaactttttcagttcaaacttttctgaggccatactgtatttttgtctatagagagctttttttttggggtgggggcacctaagagatttgtgggtcactttggccgggaagcagactaagtctaaatggagtattgtgtgtcaacaagtcagttaaatgtaaaaaaatg

SEQ ID NO: 122495 - DNA, 304 bp, Homo sapiens
agactctgcaggcctcataagcctatcccattaaatccaagctaaatatatacctaactcaatctccatttagctggatctttgttgttgttttttttttttatcttagaaatggggtctcactctgtcatccagaccagagtgcagtagctcaataatagcttaatgtaaccccaaatccctcggttcaagcaatcatcctgccccagtctctcaagtagctaggactacagatgtgtgccgctacacctggttaattttttaaattttcttgtagagaaggggtaacactatgttgcctcga

SEQ ID NO: 122496 - DNA, 673 bp, Homo sapiens
atctgtatgtttttctttgtgacagcaccataatgttttgattacagtggctttgtgtaataagttttgaaatcaggaagtgaaagacttccaactttactcttctttttcaatgttattttagctactcgggtcccttgagagtccatgaattttaggatagctttttctttttctgcaaaaattgcctttgggattttggtagggattgcactgaatctgtggatcacttttggtggtattgacatattaacaatattgttttccaatctatgaacatggggtgtctttctgtttatttgtgtatttaatttttttcagcagtgttttattattttcagtttacaagtctttcacctcctcaattacggttattcctgagtatttatttcttttcgatgctatcgtaaatggaattgttttcttaatttcctttctagattgttcattgttagtgtaaaagtgcaactgatttttgcgtattgattttctgttctgcaactgctgaatttgatttttagtaaaaactgtaaattttcttaaaatcattctttacaaatttcatgctttgttcagtccttatttataaaaaattttagatgagtatggaacttgtgattaggccatagttaattttttaaatctcttcacagagcctagtttttaagtatat

SEQ ID NO: 122497 - DNA, 216 bp, Homo sapiens
gtggccccaattccacagtgtggcctgttgtgttgggggtgaatttatgtgggagtgtggagagccctgtccactccctttgagatctggggccagcctcctgcagagaccacagatgctttcatgcgagaggccccttagatgagctgaaatgtctgagaaggaggagttacagctttgattctacatctgtctgaatagaagccatacagttgt

SEQ ID NO: 122498 - DNA, 395 bp, Homo sapiens
gactaaaatgttctttatttggtcgtttattgcctatctcctcctactacaatataaacaccctgaaggcggacagtcttgccaccattatgtcccagtgcccagaacagtctctagcacagagtagaaacctgatgtgcaaataggcccaacagttctactttgaagatttcatcccagtgaaatgatttgaaagccatgcaaaggtttcgggtcaaggaatgctgtggcagcactgtttataatataaaaatttagaacaacctaaatgccaggaatagaagtttaattaagtaattccatgcaatggtatactacaaaacaatgtccatagaactttaagatcagtggttctcaaagtatactcctggaccagcagtattagtatcacctga

SEQ ID NO: 122499 - DNA, 300 bp, Homo sapiens
cacctgccaatcagagctcaccagcgcccactctgctatcgccaattaactttctttgaaaacaacttacatcttctttctcctttcccaataaaactccagccctttcctttgttctttggacacactggaaactgccctggtctctgtgtgcatgtccttattgcaagcctactttctgtatattactctcaaataaaatcctcttgcttagagatttgtctctgcatatatatatatatatatatatatatatatatatatataaatttttttttagttttcacaaaagagaagaga

SEQ ID NO: 122500 - DNA, 320 bp, Homo sapiens
agcacacacgtgcaagcacacacacacaagcacactgctccactcttcccaccaaattgtatctttaatgactcctctctagatcataatatacctttcagaatccatctctgggtggcaccaagatctgcagaacctccatttcctcctctcttctcccaaaccttattacaaaagccccacatgggaccatgtcagggctgcaagtgaagccattcaacatttttcccccatcaaaaaaatttgagaactacaatgtgcgtaaagtgcacataacataaatgttgtttatatttaatttaatttaatttaatttaatt

SEQ ID NO: 122501 - DNA, 205 bp, Homo sapiens
gcagagccgcccagcagcaaccacattaggaaggaatcggaaaccaacgctccgctggctgtcaccccttacccacttgctgtcaggtgtccaaacagtgtcatccggtgtcctgacatgcggccccaatggactgatccagggtggaaaggaagagtgagaagaaatcagacagaagaattcaggagatgtggcaacagagtgg

SEQ ID NO: 122502 - DNA, 742 bp, Homo sapiens
ttcagagatcatttggacttctacctagagaatgaattgcaaaagaggaagtgggaaggaccaattcaaaggccatttaacagttcaggtgggagtttatggtggcttggaaagagagagagaaagtagacaaagtgaagataaattttaggttgggcatggtacctcacgcctgtaatcccagcattttaggaggccaaggtgggagaggtgcttgaggcccagagtttgagaccagcttgggtaacataccaagactccatctccacaaaaaatgttcaaaattagcccagtgtgctgatgtacacctgtagtcccagctacttgggagtctgaggcaggaggatcacttgagcccaggagttcgaggctgcagtgtgctatgatcatgccactgaactttcatcttggcaacagagtgagacccatttcaaaaaaaataaataaataaagatacattttggaggttgagccaacaagttatctgctaagtctgagaacagaaaaaggtgttttttttttttttttttttaatgtcactaggttctcctttgagtgttgggtatatgatgataaggtgggctgaggtagggttcaagagttcttttctggccacattaagtttaagtttatgcttccacatagagagtcacattagcagctggatattcagctgtgaagctcaaggaagaagtcagggctggagatatatgaatgagaaccatctgcataaagatgatct

SEQ ID NO: 122503 - DNA, 627 bp, Homo sapiens
ctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgata

SEQ ID NO: 122504 - DNA, 218 bp, Homo sapiens
tatcttaagagatgcagaagaaaacattgctaaaatttaactcatttaagacaaaaactcttagcaaactacagatatgagagagcctccttaaggtcataaagcataactaccaaacacagcaaatgtcataaacccagtaataagcagatatataaaggaaaacagatataaaaacatactggctgggcacagtggcttagcctgtaatcccagca

SEQ ID NO: 122505 - DNA, 146 bp, Homo sapiens
tgctaggattacaggcgtgagccacggcgcctggccagaatcaaatgtttcttatttgttcttttactataagttgattctctttaaaaataagagtttgaaaaaaaatgagcagctaaaccaatatttcattaactaagcaagat

SEQ ID NO: 122506 - DNA, 316 bp, Homo sapiens
tttcccagtaagacagagttgggcctgaattctgactcaatctttttctagttgtgtgaccctggaaacattacataataacatcaataatttattggctattttctatatgctagccattgtgctaagtgcttggcatactctgtctcgtaaaattaaatcttcataaaaaccctgagaaggagacaatattattcatattttagacagggtgggattattgctgagagaggataggtcaaatagccagcaagtgaatggcaacccaaaattgagttggaaggaggtgcagacagaatccccttgctggtaccag

SEQ ID NO: 122507 - DNA, 306 bp, Homo sapiens
ctggaatgagtgttctgccgtgacagctgcatcagggttattctgtttgtttctgaagggcaggaagaaatgaagggactggatggtatttcgacaatttaacattcctctcataaatgtttctgcaaccacttatctatattagaacctagtataagatggtatctgattaagcagagatgtgtttacttagttatttaaagttgactgtccatttttgtggggagttctgcaaacagtatcattatttccaggtacctgctggctgaacaaattaaagaaccagaacaccgtcgaattagctct

SEQ ID NO: 122508 - DNA, 293 bp, Homo sapiens
tgctgggattacaggcatgagtaaccgcacccggcccgaccagtatctttttcttatgcagtgaaacaactttagcaaaagaggcaatgaatgttatactgagtttgtacctctttaactccacctgcaatttctgtcaatctacaaatacaagtgtcgcctcgcagtgtttcgtatggacagaatatcttgtgtttgctttttgtcacttatttcacttgcacattttcttttgtttgtttgtttgtttgttttttgagacggagtctcgctctgtcgcccaggctggagtg

SEQ ID NO: 122509 - DNA, 281 bp, Homo sapiens
ctgcctcagcctcccaaagtgctgggattacaggcgtgacatgtgatcttgagcgaaatatttaatttttctatgtcttaatttgctcttgagtaaaacggtcacaacaagaacaactttagaggttcgggggattaaaggagatatgcaatgctcttgagacaacgtcaggtacattttaagcgtgcagtcagtgtacatgattatcatgataatgatgtaaatttttccccctcttcttgagttcttcttgagttggaagaaggaattcttttctttga

SEQ ID NO: 122510 - DNA, 403 bp, Homo sapiens
acagagggaaacatgggatacagaacaacttgctgcccacctcattggcttccaaagctgagcattcctggctgctggaatgaggcagggcaccagctggatatagagagcactgagaacagtggcctggatctcaggggaacagctggcaattgaaatccattggaatgtgctttgggttagcagagatggcctggatctcaggggaacagctggcaattgaaatctattggaatgtgctttgggttagcagagatggcctggatctcaggggaacagctggcaattgaaatccattggaatgtgctttgggttagcagagatgaccttgacactgcagtctggcagcagaaaactgcaatctgcatggcacttgaggttgtgacagggagacaggggaata

SEQ ID NO: 122511 - DNA, 565 bp, Homo sapiens
gacgctcacgctcatgtcacacacctggctaatttaaaaaatattttgtagaaatggggttttgccatgttgtccaggctggtctcaaactcctgggctcaagcaatcctcccacgttggcctcccaaagtgctgggattacaggcacgagccaccatatctttaaaaatgtaatagaatggaaaatggcaaagcgcgctgcttttcatagaagagactatcgcattggggttcttctgttgcccctgcctgtgctgcacgtcctgcttcacagtgtaaagcgcaactcttgctgtgccttattgtaacaggtatagggtggatgctgccatcatgaagagagaggagagctctttgcttataaaattccgtagagtggagaacagggtgtgccggcttaggagagggaagaggtacaggcccgctctgcccgagctgcagatgggacacacatttcccgactcagaggggagtcgtgtctttctccagggtcaccgagcagcaagcgcatccactgtgtgttcttattttctgagcttgtgacatgggacgtgagtaccgagtt

SEQ ID NO: 122512 - DNA, 340 bp, Homo sapiens
tttcataaggagcttgcaacctagatccctcgcatgtgcaattcacaatagggttcgggctcctatgagaatctaatgctgctgttgatgtgacaggaggcggagctcagccagtcatgcttatcgcccactgcttactttttgcactgtggccttggcacccgggggtgcaagacccctggtctaggagaccagtaagagccaaactaacaaactgagaatggagaggatgaacagataacaaaaatatggcagaaacagaacaaaaaggacttggaactttccaccaggaaacagaagattgaagtttgcatgtgtgcccagcagctaaaggtagctg

SEQ ID NO: 122513 - DNA, 454 bp, Homo sapiens
tttgacaagaactcatctaattttccacggagccatcttctgcctgctaccctcatcatcacttaaaaaaacagctccccaggccgggcgcagtggctcacacctgtaatcccaacactttgggaggccgagggcggatcacctgatgtcaggagttcgagaccagtctggctaacatggtgaaatcctgtttctactaaaaatacaaaaattagccgggcatggtggcgcacactcgtgatcccagctactcgggaggctgaggcaggagaatcacttgaatctgggaggcagaggttgcagtgagctgagatcatgccattgcactctagcttgggcaacaagagagaaactccatctcaaagaaaaccaaaaccaacaacaaaaacatagctccccacctccagcttgcctaccttccttcagggcacacaccgcagacaccctaggacag

SEQ ID NO: 122514 - DNA, 1027 bp, Homo sapiens
ttcacaacattagcatctcctggggatttgctttaaaatgaaaattcaagacttaataaatcagaaaccctgggaatgggactcagtggtcacaagccttcctggtgattctgatgcatgttcaagtttgaaatatactgggctggggtattctcaaaaaagtgcaaccaggatgataaagtaaactagagtggattaaaggaactgagaattggctcagagaagagaagaccttggatgtagacgagagttgtcttcagttacagtatttgggaaagaaggattatattttttccatgtcacttcagaaggtaggagtaagatcaatgggaaatgttaagaatgaaaattgcattcatcctacaaagaagtttcctaaatcattacgaattgttctaccttgagtgtagtgagttatctgacactggaggatttaaaccaatggtagatcattacatagtagagatatgaacatgagctaaagcatgagggcagcaaagaggggagaactttgtttcacctaaatggctcttcaaaccttttttagcattagtttctgctttgatatactctattaaaatttgggggataattgataaatcttccaggtggtttatggatggccagggaggaaatttgccattgttttaattatttaattttatttgcctctgtttttacacttggtaaaaatttggaagtgtttcagatagtgaagaaaaaaaagaattaagaaaaacattccaggccaggtacaggctcatgcctgtaatcccagcactttgggaggctgaggcaggcatatttcttgagctcaggaatttgacaccagcctggccaacatggtgaaactccagctctacaaaaatacaaaaattagccgggtgttggtggctcgcgcctgtagtctcagctacttgggaggccaaggcaagagaatggcttgtgcccgggaggcagaggttgcagtgagtcaagattgaaccactccactccagcctgggtgacagaacaagacgctctctca

SEQ ID NO: 122515 - DNA, 533 bp, Homo sapiens
aacaaaacaagattatgagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactgtggcacttttgcataatgggatatcaaggaataagaaaaaggaataaa

SEQ ID NO: 122516 - DNA, 456 bp, Homo sapiens
ttttcagtccatatctttttttgtgtgccaaagtggggaaccatatttctggtagataatcactggtttttctcatccggcaagtggacacctctgacgcagctggaatgggcctaggtgggagggactttgtctttactaccacgtggagccggcacatagtgggactcacagctcttcatggcatcgatgaatcgtgtcccgattagctgttggtggtgtgccatctgcggctctgctctggtgagttctgctgcgatcctgtggctcagcacgtggtaggtcctcagtgaggctgtgatgagcgtgggggcgtctggtgcctgggtgcacatccctggctgtcctccatggtgtctctctgtgcccagcctctggagggtcggctcggagggctgtgggcccgggactcggtgtgtccgatgaggaaaccagcttgggtggggagggggagtc

SEQ ID NO: 122517 - DNA, 502 bp, Homo sapiens
gtccgtaactcacgatggtcctcagctcaacgatggtcctcagctcaacgatggtcctcagctcaacgagggtcctcagctcaacgatggtcctcagctcaacgatggtcctcagctcaacgagggtcctcagctcaacgatggtcctcagctcaacgatggtcctcagctcaacgatggtcctcagctcaacgatggtcctcagctcaacgatggtcctcagctcaacgatggtcctcagctcaacgatggtcctcagctcacaagaacagcacaggaaagacccgcccccatgattcaattatctcccattggatccctcccacaacatgtgggaactgtgggagctacaagatgagatttgggtggggacacagagccatatcagtagtgtaaacctggagccagcaggaagaggcatttgacagagcaggagggtccatggtgctcagtcaaagtcttaggacaaatagtccccatggaacagaaggcaatgcacctg

SEQ ID NO: 122518 - DNA, 693 bp, Homo sapiens
aggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggcacttcagcaggcagcaaagattggaaaccactgctttatcccttcatttcttcccatgtgcatatcacaaa

SEQ ID NO: 122519 - DNA, 153 bp, Homo sapiens
cgtacatgcactaaactggcacactaccttatgtctaccttaagtcacataagcacccaggggacaggatctggggtaggaccttggtctccccacagtggcctggcttagaggtccagaggtacaacatagaacatcatcagggttggctta

SEQ ID NO: 122520 - DNA, 537 bp, Homo sapiens
agacgtcagccactgtgcccgaccagctcccatggtcttgagtcttggcacccacaaattttttttttgtgagacagagtctagctctgctccccaggatggagtgcagtggcatgatcatagctcactgcagcctctaattcctgggctcaagcaatcttctttcctcagcctcccgaggagctgggactaggcacatgccaccatgctcaactaatttttgaaatgtttgtagaaacagggtctcactatgttgcccaggttgttctcgaactgttgggctcacatgatcctcctgtctccacctctcaaaaagtactgggatcacaggcttgagccgccactcccggctattcttggtctttttatgatttgtcagcatctccctcaggattctgctggtctcttgcagagtgaatgagtggcccctgcctctcctatgggtcctttgggatctgagctctgggccacagtctggccgcagccctgaagctcctggcccctctactctcagctcttcgggacagttctctgcct

SEQ ID NO: 122521 - DNA, 282 bp, Homo sapiens
gtaaatgtaaacataaatggaaatttgaactcagttatttgactaatgtgtgtataccatctggctaactccatttcaaacaccttatgcatttacttgtagtttttatcttctctaaatataataacttgtagaggaggagtgtggaagagtcttccatttaccaaagtgatttctgtgtcattttcttgagtttgatttcagtcttgtgactggtaaattctaagtatctgcccttttgagcaaataaacttgtcaatcagatattttctaaaggggata

SEQ ID NO: 122522 - DNA, 328 bp, Homo sapiens
cccttattaccttctttattgagggaaggtgtaatatttaagaaaccactgcctaatccaaggtcatgaagattaacatctatgttattaaaatgaagttctgaagaagctggatttatgtggctatggtaaatgtatctttaaaaactcttgaaggaaaaagcaataaaatctacactaaattattgaagaagtcaaaataacaaatgcacttatggataatgttaaaagtctcaaaaatgtactagcttcattgcagtctgaaaaatccagtttgaaagtgagatttcagagcttcagcagaaacttagtcattactaaactgcat

SEQ ID NO: 122523 - DNA, 311 bp, Homo sapiens
acgtaacagtgcatggtactgaaaatgaaggaactatagctatatgcatcagtatgagctgtcataaataaaatactgagaaatgataataaagttgtcaaagaataaatgcagtatgattccatttgtataacgttgagaaatatgcaatatcatgtattattttcggaatgcatacacatgtggtaataatgaagaaaaggcatgaattgataaacacaaaattcaagattgttaagtattttctgttgataggaaagaggacagatttggaaagaggaacaaagatgctgcaaaggtattggcaaacg

SEQ ID NO: 122524 - DNA, 147 bp, Homo sapiens
agacaaacattttaaaagatgagtttatgttacaattactttaacaactttatcttcatagtagcattattcctgatagccacagtggaaaaaaacagtatgtctatcaagtcaggaatagataaagtgtaaataattcaaaaggct

SEQ ID NO: 122525 - DNA, 360 bp, Homo sapiens
gaagcaagggaggggaatgaggaaatgtttgggatgctggattatacactgccttgatcatggtgatgatttcacgggtatttacatatgtcaaaatattaaattgtgcaccttaaatatgttcagtttattgcatatcaattagacttcaatccaactttttctttaaaggtgctatgcttctggccaagatggactgaatttatcctactaattcaggcaacttagaaagcaagacaatatatacaaaacaatggttatcagactctggatgaacaggcagcataagagagagatccctgagagggagaagcacaaaggcagtggcccagtgattgctccagcttgctgtccagtgag

SEQ ID NO: 122526 - DNA, 699 bp, Homo sapiens
ctgaaaacttagtttgaggaattcttaaataccttacatttctatttccatttttaaaatactgttatttctgttgtctcatttgagtcttaattatattgtcatgtttgtagacttttttgaaatttaatatcctttccattgtgagtatcttgaaataagaaactatgtctcattcacattggatgaatgattgagctgaatgacttacccaaggttacaaagctaataaataatatacctaaaactcaaatccagatcttcttaccacatttctgaagatttagatctacatggatttctgtaatatagtcataaagaaaatataagcacctgaaatactgtctacaaggaagtagtactgagctaatcaaggataggtaggatttggatacaatgagaagagaagtgaagagtggtttattcaaataatacaaaacaccctaagccacagcaaagatgagaacataggagacatgtttggaaaaggaggaaatagaactaacagcctgactgggatagaggattcctgtgagaggatagaaaatgtgagattagaaagggaaaatggggttaaactgtcaatgccaagctaatgagaagctcagggtctctgtgacaacttgagtcaaatcaaaatggtaggctctacagacatttagttggaaactatttaatgatttggtatctgctcttgaa

SEQ ID NO: 122527 - DNA, 1061 bp, Homo sapiens
gtaccaaagactgaacatttttctcatccctaattctctcctacctcagtcatcccatacaacactgctcccacagctcagtacctagtgctgccagagaccatagtagcatgtcagcatatcagatgcttctgcatggcagcattagatccacaacataacattcccatacagacaaatgcatgaacagtcccagggacatcacacatgctcagcgaacatcactgcatcatcccaaaatttgcaacatggcacagtttaaccttttatctcattccaactctctcagagcaacaaacacattccaaagctccacagtccactttgggcattcaacaaacacacatctcaacaggccatttaaaagttctcacacgggcaactcaacagcaacatccacaattcattcaggtcccaacttggagtcccgcacgtttacaacaaccctcttaaggaaccacactacacatccccaagaacttattccttgcccagcactttcctccagttcaagcattcacgccacttgggcccagacaggcagtatcaaggactgccctaggatcccaggctggaagcatcacttccaaagaagcgctggcacccctgggaagctaaggcccacttacacacagaagcgggacatgccacacatacaccggtgcgacccacgaagggacaccaacagcaacagaacgagcacgacatctccggacatgtggcacacacttgcacaacgctccaagcaaacacaagctcacaaccacagcaaaaacatcacgccaacaaacggcctatggggcccccccgcaaagccaaaccaccatcgagcatacgaagaaacaaagaactaaatcttcccgagaggctacctccacagccccgacactccccaaaccccacaatctcgatgacccggccaatagaaccatacggataatgaacaccccgggagtccggaagtgccacagccgacagagaaagaccgagaggacaagagtacaacaaggctccaccaacattgaaatacacacccagacgatccatgctccgcacaagag

SEQ ID NO: 122528 - DNA, 557 bp, Homo sapiens
ccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcattttaaaaaaaa

SEQ ID NO: 122529 - DNA, 329 bp, Homo sapiens
gggtaagagaagagaagacaggagaaaagagaatgaataaaagaacaagagagaagagaagcagtgggtaaacagcctgttagatggtggcatagcttttacccactgaaaagatgttcacagcaaggtctatcaaaaccctaccacagtatagcagctctaccttgaaatagtatttctaatgataaaaataataacacaataaagtttagtaaacagtatgctaagagctttgcatatgttttctcctccatgatccttttgattgaaggcaaattttgtcatcctatgctcaaaattcttcagtcacctctcatcttactctgagt

SEQ ID NO: 122530 - DNA, 313 bp, Homo sapiens
ccacctcagcctcctgagtagctgggactgcaggcatgtgccaccatgcctggctaattttttatttttatttttatttttttgagactgggtctcactccgttgcctaggctttagtgcagtggcccaatcacggggtcaccacagtgtcgacgtctcaggctcaagagatcctcgcaccagagtctattaagtgctgggattacaggcgcgtgccatcatgcctggctaatttttgtattttttgtagagatagggtttcactatgttgcccaggctggtcgtcaactcctgagctcaggcaatccacttg

SEQ ID NO: 122531 - DNA, 757 bp, Homo sapiens
gaatgtcacccagttctatctttgttcaagagaatcaagcagaactgatctgtgtgtgcccaagtttctcacctcttaattaaaaagacctgtcttccgtccactttttatttctccaggagttttagatttcacacatagacgcattcagtgggaaataggatgttgagagtactagaagtaggggtcattcatatggttgggagaaggatgttgaaaggacagaatgtattttgggaaaccagcctatgttgtaaccattttcccatgaggtaaaaatgtaagactaaactaggttaagtttaaggataattttggaaagtcatgtgccatttgtgtaggattaatgaagctgggggaaaaaaacagcactgggatagtggattgttgcctttttaacacagaatattcttatgagagtacaggtaaatctagaatttggttttgagaggcaggagtttgtttccttttgttacaatgttttctcagatctttgtctcagagttctttctgtatgaggtgtggagtgataacaccatataatcaggaatattcccacaaagaatagtgaaaaggacaatattttctacttgagagtcttcaggccctgagactatgatgaattgtgtctgatggtttacacagagcacagagaaatgaaattgaataggattagtgcaggtaagacagaaatgaattgaggaaaccagtaagttttctcgataacactgactagttctaagtcatacattttaaa

SEQ ID NO: 122532 - DNA, 612 bp, Homo sapiens
gtcattactcagacttgacagttgatgaccaaggaagtaagactttcactagaagggctgcccaggttggaaagctgagagcaatcagggccacctcttacaagcaaataaaggtctgtagtaacttaattacaatctcagtctctaagccttcagggttgtgaagcagaaaggcaactctgttcagggactcgttaaacaccaggtttcctttgggcacaggctatgacatttgtgccactgtagaactgaataggaaatacaagcagtgccattcaacagcatgaccacttccaaggctcacagcaaagcagctgattattgtataagaatcatatttggccaatatgtcagtgccagaaatgagagctggaactgaattctcgattcgagaaacataatctaataaattcttcagcagagtttatttattcagagagaaaacaatcacaacaatagcatattttgtctgcttaccttgtaagtatagttctgagtttttacacttgtcatctcattttttcttacaatatcagcaataaggttgattggattactaaccccagtttgcagataaagattgcagcttagagatattaaatatcttcaaat

SEQ ID NO: 122533 - DNA, 260 bp, Homo sapiens
gagtcctccctgccatgggtggggtctgaagttggtgaggtagcatccaaggcttcccttttgactctgggtgcctgcactcccagcccactctgtttcctgaaaccaaccatgtccaggcccagtctagtgcctggaccagaagaggaagatgtggctttgccaactgacaagcacgaggaagaacagacttttgcctgctctaccttccagtcaagaggaaaagactcatgtgacatgagtcctcccgcggcactggg

SEQ ID NO: 122534 - DNA, 536 bp, Homo sapiens
cattgtaggcaccaaatatcttttatgaaatacctcattttagatagcggtatttatctcagatcaatagatctgaatgattcacaagcccctgctgtttcagctcatcttcatgcattagtattaaaatctctacttcagggttagtgaacactcctggtgctaggatgagggcagatacccctgtcaatcatggtgtcctttcatgccaagctctagagtgactgaggagccatctcaacctggactctaggcagtcccaggcaatcaatccgaatcggcagctaaattgacactgatgggctgacttcccaggccatactaggccggaaaggagcaagcttttgttttcatttttccacccttcagctcattttttttttttcagaccaagaaataagtctcaagtccggctccagcgcgaggtcttgattttcgcggggaagtcagtggggaggagagctggcgggcagtgagtcggagagagcgcgggtcagctttcctcctctcacttcctcctctggccttgctcccaa

SEQ ID NO: 122535 - DNA, 355 bp, Homo sapiens
gccatctcatctgctgtgagactgcagagcaccaaaagccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatggga

SEQ ID NO: 122536 - DNA, 131 bp, Homo sapiens
ggacattagggactattcaatccaaattttctcccaatacagtactccttgaagggtctgttggtcccacacctatcgggctgtgtccctttgcttcacaatcactgcccttagcaagaggttcctgcatg

SEQ ID NO: 122537 - DNA, 576 bp, Homo sapiens
acaggtggttgccaccacgcctggctaatttttgtatttttagtagagacaggttttcaccatgctggctaggctggtcttgaactcctgaccttgtgatctgcccaccttgacctcccaaagtgctaggattacaggcgtgagccaccacactgggtccaggttttgtttttaaaggaggcaggtattagcacagagcatcagggccagaaggagccccagaggtcacagagcatccatcatctgtacagtcatggagtctgagacccagagagggacactggcttgcccaagatgacacagcagaggcagaaccaggtccttctgggctgtgttccctcctacctgatacgagaatgggttccaggtagagtcccaacctgggcatttgtttcacaggtccagtgctcataaagtcagcaattttcaaacctggtttactgatcccagggtgtgtccggttattgcaaaggtcattgcaacattctcaatagtctttcaaaatgaagctaatttcaatttgccatacttagaaaaatactatcttttacatttgggggctgggaggagggagga

SEQ ID NO: 122538 - DNA, 320 bp, Homo sapiens
agtgacgctccgcagacgccgcatggaatgcggggccggctccactccttccgtaatgtggttttttatagtcgggggactcattgtcccgcggccactgccagctgtctgtaagctcaggattagagagcctggcctttcgtgagagctggggctgtgccggctgagcccttcacagggaggggtggaccacggggacagggagcgactgcctggcactgagtgagccagccagcagacagcatgacggccttctccttgcctgcccccagggcctggtgcaggctctcttctgcccaccctacccagcttgggggccc

SEQ ID NO: 122539 - DNA, 268 bp, Homo sapiens
tccttccttacagtagaagttggccctactgctaacagctattgtcaagggaggaaaaggaggcttcgaacaaaacccaagctagaaaatttggagtaatcaagaatttaatcctcattagactatattctgcttgctcttgtaggtgatctccagttagaaatcagatattgaaggattaactctgaattgcgtctttccagacagtggatcacttagcaagttgtcatttcagagatggtgggaaatgccattttaaatataaaaa

SEQ ID NO: 122540 - DNA, 574 bp, Homo sapiens
cgcagtggctcacacctgtaatcccagtactttaggaggccgaggcagcggatcacctgagttcaggaatttgagaccaatctgggtaacatggtgaaacttggtcacaactaaaaatacaaaaaattagtcaggcgaggtggcgtgtgcctgtggtcccagttactcaggaggctgaggcggaaggatggcatgagcctgggaggtggaggttgcagtgagctgagatcgcaccactgctctccagcctgggtgataaagcaagaccccatctcaaaacaaaaaacaaaaccaaaaacattctatcaggtacagtcaaagaactatgtacagcactgagttcgagaagaccaccacaagtctgttgctttggaagccctatcttgctacatactgaagtgattcatggaaagacaatagtgtagaaaataattaagtccacaaatcgctactaccaccttctctgaagatgacaaagccacggactctgtctcactctgccgtctgctttttcctcttacctggtatagacacacatgtcaaccaccagagttcctacggttcatggacagac

SEQ ID NO: 122541 - DNA, 340 bp, Homo sapiens
gctgggattacaggtgtcgccaccatacccagctaatttctgtactttcagtagagatgaggttttaccatattgcccaggctggtctcaaattcgtgagctcaagcgatctacctgccttagcctcccaaaatgccaggattacaggcctgagctaccctgcccggctgtgagacaatctctgaataacgtcaggagatagatatgcaccctcagctgcatggtaaggctagattgttatgagagaagagaaagagatttcagtattacttcggtcattgcattctttttttctttttttttttgagacggagtctcgctctgttggcaggctggagtg

SEQ ID NO: 122542 - DNA, 478 bp, Homo sapiens
tgctctgcgtgatgcgcggccatttctccccgtgggtttgtggatctggatcttctcccaggagctccgggaagactctgcctgctgtgttgtacccctctcctcccacaccatccccaaggcctgaagatgcatcttccctgtgcctgctgcctctgccctggctccatcctcatcacctcaacatggctgctgggctccaggcctccagccttatccttcacctatctgtcctcccagtcagtcgagaagtattagtgagcagctagcacaggccagccttatgggagccagaacccaccttccccttcaatctcctttcccaccagaccaggcctgctcactgtgctttccgtggcaggcaggctcctgctggagctcaaaattgcttctctctcagccagaaagatccccctagatcccatggggctctatccccccttcattccacaggggatccccttctcacaacccccac

SEQ ID NO: 122543 - DNA, 543 bp, Homo sapiens
tgtctgggttttggagagtggaaagacactaagcctgagagtacaatgagggagggaggaaggaagggagggagaggtcagataaaagtctataaaataacacccatcaccactgataacaagtataaaagagtccttttttcttctcgagaaagacaaagggaattttaagtaggattaagtagtagtagctttcagaactcagcagctctcagaagcaataataactacataaatagctaagtggatggtaggaattacctcacttggaatttggccagcaaatcaaaagttagcagtaatatcacatctttttgaaagctttcctgagattctagaggggaaaattatctcagaaaactgtttctactgagtaaatttcaggaagaaatgctcctcactgcttgaagatgttctatctctggaaaactggtaagacagaagtccctccctgctgggaagcactctctcatccaagtaaatacattgccaattttgcccccaatggaagcaaataattacgttcgcagatcaccgtcgcct

SEQ ID NO: 122544 - DNA, 334 bp, Homo sapiens
cccacaagttatttatcaatcacaaaaataaaagggttagttttacatttgagaagtctggtggacacaaccttaatcagatcaccaaatttaatatcacgaataatggcacaaaccgacatcatgtgccaccttttgtgatgttctgaaaaagatacagtgtcacttctgtagttttcatgctcaggtataacctggttccaagcatgaagacacaatcaggaaattagaattgagagacattttatgaaacaatttgtccaaagacttcaaaaatatcaatgtcatgaaggattacaaaaaagagagagagactaggaagcctcatctccac

SEQ ID NO: 122545 - DNA, 335 bp, Homo sapiens
ttcagaaggtaaagatcttctgttgggcccccagggtgacgggatgccctctgagtttatagtgcagaggaattgtagcttgatcagaaggctgctgggtctgcactagggtccgcctttagttggtttgttataagaggcttgggtagctgtaactcccattttatttttggacaaactgaatatccttcaggacttctatatataaggcagacactagggcaggtttctgcagtcgagtctgctaatggcagggcttatatcaggatgtggatgagtatggctttcactgaataccagagagcatttctctgggacactgtgtgggtttctgt

SEQ ID NO: 122546 - DNA, 293 bp, Homo sapiens
actatttttatacgattacaaatggacaaaaaaaagagtcttcttatttacttgttgtacctgaaggtcaatgactgttaaggcaggggtggattagactaaaatacagaaagcataaaggcaaattggaaaagatccatggtgacactatttagttctacccagttagaaacatgtaggaagatttaccctcgtaagactgtaaaaatggaactaaaatatcttccatgcttagtgaagtgataaagagtgttttgcagcttactaagtaagccgcatgaccctaggccttg

SEQ ID NO: 122547 - DNA, 449 bp, Homo sapiens
atggttattgaggggctactatgtgccaggctctgtatgtataccattttattgagtcatttatctttcataagctccaattttctcacttccctttgaaatgtagcagcctagatttctggttcccaaacaattggtactgggtacaagcttataggtattcctttctgccttcaggtagcacccacacttctgcactaaagcaacagactaggttttgataatatcctacaggcactttgggtagggcctttaggatagtgcacttagaatgtactttgggtatttatgagatggggaaaatgggtgaaaaagtttaagaaatgagccataaatttatttttggcaatgttggatgagcaaattttgaaatagagaacaatgggtcctgcctgccatggtacccattatatattgggaaatggagatattaagggtatcaagaaacg

SEQ ID NO: 122548 - DNA, 302 bp, Homo sapiens
cttcatgacagagcccatttctttgttgaatcactaattgttaattctcaactcgtagtttttttctattcctgtctttaaataatgagaatattcatttttatgaccagatatactgaatttattaattttcttccatcatttcacatcagcattccgttacatcagtatacagtcatgtattcatgtgcatgactgtatcttggacctaaatattatgtaatgttattctaaatgtttggaactttcttcatgttgcacaagaatcttaccatatcttcctccctttattcccaactatg

SEQ ID NO: 122549 - DNA, 308 bp, Homo sapiens
ggtctcccaaagtgctgggactacaggtgtgagccaccgctcctgggtgtgaaattttaatgagaaataaaatacctgcacaatctcaaggtatctccccacataatgcctcttaattgcgaaaggaaaagcaaaacagtgactttacagtgtagaaacccagcagataccagcttgaccaagtggtaaaagttaaccttgctgacagtggcacaaagagacatcgtgtccctccttgtatgatcaccaagaagggcacagcatcacctctagtcgacgcggccgcgaatttagtagtagtaggcggc

SEQ ID NO: 122550 - DNA, 499 bp, Homo sapiens
  misc_feature (340)..(340): n is a, c, g, or t
  misc_feature (349)..(349): n is a, c, g, or t
cttttggggtctttgctatgttgctcaaactcctgggctcaagtgatcctcctgccttgacttcccaaagtgctgggattacaggcgcgagccaccacaccagaatcaaatttatgacatacagcatgtaaccaccaccagagggcagtaaacagaatctcaaaatgcaatgggccaatcaaaataaagagaactcacaagagaagattcatttagaaaaataagtgggatgggggtagagggagaggaaactgcctcctttgtttattgaaatgtagttttaaaaatacatgataggaatgcctctgtcaaaatcaatgtgaagccaggcacagtatgnttttcttgnttcttttctttttttttcctggagacagagtcttacttcactgcccaggatggagggcaatggtgcgatctcggctcactgcaacctccgtctcccaggtgcaaacgattctcaagcctcagcctcccgagcaaagaccccaaaggtacc

SEQ ID NO: 122551 - DNA, 470 bp, Homo sapiens
gtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacac

SEQ ID NO: 122552 - DNA, 786 bp, Homo sapiens
tgacctgctatttccaatcacgtcagtcaatgtatgtttcttaacagtagccaccatttgaactattctgtcatacttgccacgttcagttgcttagcatttttaacatcaaattcaaaatgtatccttcaaaatactttcattgaatatcactaccaaactctgaacatgactttgcttaacttttattttctattttattaatttaatcaccttgtattttgcctctcagatctcttgtttcatgtgtttacagtatattcctaactagatgtgaatttcttgaaatcactggtatttgatttctccaagtatttagttgggtattaataataaaatactgagctggattccatttctaatcctaattaatgaggcaggaagccgatcaggtgcatcatttcacagctcagtcaatcatcaaatattaagtgcctcctgggggatattgtgggaacctataatgttccaaattctatgctttgtgctttaatacatggtctcatataattctcccaaaaactcagtggagaaaacaccattattatcattcccaattgacaaatgagatagctaatggccaagagtcttattcaaagtcacagtgctgatcaaggtgggatttaaatccaggcagtgtgaccccagctaaagctcatgcctttaatcactcctgtatcccaccttatatccagactttggcactgctttgccttgaggttgcagaactgggggctaggagaaagtacaggaataataatggggaaagtcatgagagtggaactg

SEQ ID NO: 122553 - DNA, 196 bp, Homo sapiens
gcagcagtcacaggaggaagaacggggtggcaggcactacaaaggtgctagtgtaacgggagagagggccggattcaggatgtgtctggggagccacgtggacctgccggcagactgaacgtgccgcttacaggaacacagagaagtcaagaaggactctcaggcctctggcccaagccacaggaggtcccacctg

SEQ ID NO: 122554 - DNA, 278 bp, Homo sapiens
taatttactattatcaagtcagtggaagtagaatgttagagctatatagtctagttacaatttgatttcattcaaagtgactggtatgttttttcaaaatgaaggccaaactgacgaacagcactcagcccctacttcacaggcacccagatctcaagaatgtaatgaaaccaaaagtggtgtttcccttcagttttgtttgcatctctggataaaatggacttggctgaaatgtgttgaaagcttaaaaaaatgtgtaataccaccatcagttttct

SEQ ID NO: 122555 - DNA, 128 bp, Homo sapiens
caattccacattgctagccttttcattagtaatagtttaattaattaataggtttaactaaacctataattaaacattaattaatacctaatttaatatttctggtttttaaagttttcataatagaa

SEQ ID NO: 122556 - DNA, 638 bp, Homo sapiens
agttgctgccgctggagactcaaagtactttgttttgtcacttctctaaaaatttactgttctttttgaagatgttatataaagtgcaattcagagtcacctctttgatagttactccttctctaggtatctcccacgtatgtatgaaatatacatgttaacaaaacttctgtttttccctcgttaatctgcttttttgttgttgttgctgttgttacaagtgtctgtttcaactaagaacatatgagggttaagcaaaaaattacttttttccctacatatctataaatcctcccttataatcctaaatactgtagagaaaagaaattacacatgtagacacaattactactcacaatgttattatccacctaatacaatttttatggaatcacattgtagtaattatgaagtcaaacaatgtgcattagtcacaatttctccccactgatctcaaatattttggccattttctgtcattaaattctccaccatgaggtaggttggagggaaatggaattcaaactggggtagtttactaattttgtttttatgtctggcaaataagtggggaaaagtagaaatgtatgatcactaagagcatcgaaaggagatggggggctttgtcttattatcag

SEQ ID NO: 122557 - DNA, 128 bp, Homo sapiens
ggaggagaagatgcagggccaggaggagaagatgcgggagcaggaggagaagatgcggggccaggaggagaagatgtggggccaggaggagaagatgtgggggcaggaggagaagatgtgggggcagg

SEQ ID NO: 122558 - DNA, 163 bp, Homo sapiens
cctttccctcaacccctagcaagctatgcctggaatcagagacttgggctgaaccatgattgcggttaaaatgcagactaaattgtaagttgttttcatcatctacacctcgatgtaactggagtaaccagatcctcttttgagaatggtttgctgggaggca

SEQ ID NO: 122559 - DNA, 823 bp, Homo sapiens
gcatgttgaattgcaatccccaatgctggaggtggggcctggtgggaggtgtttgggtcacaggggtggatccctcatggcttgatgctatcttcccagtaatgagttctggtgagatctggctgtttaaaagtgtatggcaccctcctgctcaacctaacttgctcctgctttacatgtgaagtgcctgctcccacttcaccttccaccataattgaaagctccccaaggtttcaccagaagctgagctgatacgagcaccgtgcttcctgtaaagcctgcagaaccatgagccagttaaacctcttttcattataaattacccagtctcagatatttctttatagcaatgcaagaatggcctaataccagagcctaacctgcctgggaaagggaaatacccaactccagcccattttagccatcctgcccaacttaaaggaggaaaaaactgagacatacttttgaagttaacagtccagaggcacaggctcagtgaaagactgagacttacccataggatttagaactctccccctccccaataccttctcatcatatcactaaaggcctgtttatagcagttccttttatctagtacattacatttggccatcaagagaaacttacaagacatattaaaaggcattaaacactgtttgaagaggtatggcaagcatgagaacagactcacatatggtagagaggttggaatggtcagaccaataatttaaagcaactatgattaaggtgctaaggactctaatggctaaagtagatgacagcatgcaaggacaaatggggaatgtaagcggagagatgg

SEQ ID NO: 122560 - DNA, 375 bp, Homo sapiens
gaaattgtgctactcaccactcatctgcagccccctgaccatggctgtctccatcagtgccactgaagtggagacagccccgctgaaagcaggctcagttatcaaagggagcagagactgggcgcggtggctcacgcctgtgatcccagcactttgggaggccgaggcgggtggatcacgaggtcacgagtttgagaccaacctgtctctagtaaaagtacaaaaataatctgggcatggtggcgtgcacctgtagtccgagctacacagaaggctgaagcaggagaattgcttgaacccaggaggcggagtttgtggtgaggcgagatcacgccactgcactttaacctgggcaacaaagcgagactccttctc

SEQ ID NO: 122561 - DNA, 416 bp, Homo sapiens
gtaacaaagcgagatgccagctctacaaaaaagaaaacaagaatttgagagcaccttgcaggtaagtcagtcagtcactcttgctggctagcacagttctttcataaaatagtgtgaaattgggtctccagaatagtgttgacatgcttatttggggtcaaacacaagatgagttcaggtctctgggctatcgacagtcctctaccaacccttggtcatgagccatgtgttggggaccttgtgctggccttcctttgtcagtgttctgactgtggaactgctggtggtccacagcacctgaagactacagagtggtagcagacatcttttattctgtgtatgactgcatgccatctcctttctgccccatcactcgcacccagggtagttaccccaccccggcagaagattccatg

SEQ ID NO: 122562 - DNA, 450 bp, Homo sapiens
atgaaaacagaatccctgcttttagtctaaataatgtattagtggtaataagtgatatgaagaaaagtaaggtgaagagctggaaaatgttagtggttggggaggtagtgtgctccttcataaactgtgatcaggaaaggccttttggatgaagtgacttttgatcagagacctaagttgagcgtgagaggagtgagccttgtgactgtctgggggaagaatcttccaggcaggaaaaatgcaaaagccccaggttggtgggagtgtgccagtgtggctggagcagagtgagcaagggaggggggcaggtgggatatgaggtcagaagggtagcaggagggcaggtcttgttcagccatggtaaagggtttggcttgactcctggtgaaatggaaagtcttgggtgtgggggcagtcgacgcggccgcgaatttagtagtagtaggcggc

SEQ ID NO: 122563 - DNA, 205 bp, Homo sapiens
gtatttttgtgtgtaatttttatagtttttctgttctttcctttgccgtcaggatacttgactttggtctcttcctgatctttcattttgctgcttaattcatattagaatgggaaaccagataaccaatcgtgttaagagttatattgaaaataaaagtaagcaggctctggggagcatagtatcaaaggatttcaatataatg

SEQ ID NO: 122564 - DNA, 287 bp, Homo sapiens
aaagaaagaaccttttaaaaatgactaaaatatagtgattaaagaatgtttaatgaggagaggtgcttatatttcagttatcagtggtctgtctgtcaaaataatcatctacatatcctatagctttggggcaagttgtttgctctctctggatctcagtagccaaaaaatggcgagatctggcagttggggtctagaagttcccttctatctgtgtttacatcccacagtcccatgggcagactgtatgcaaggtgatggcaggtctgtggctgagtttgaggggc

SEQ ID NO: 122565 - DNA, 599 bp, Homo sapiens
gagggcatgaggtgtgctctacctaggatacctccaaaagtttcattagcaacattactttctaattagtagaaataagggctaaggaatctttggatcactgaaatctaactattctttaattgaaatgtggttatgtttctgacttatagtaagaactaaaatgaattctatttattctcaagtgagagcaaagagaaaaattttaaatggcataataaagagcttataaaacaaaatatgaggattttggaaaatcatttattgaaatggtactaggatatttagaagtatttagaagcttaaattaatttggtttttctttatgacattatctctattacgataatattatattattttttaataaaggccctaatggaaatctcaaataggttggtaactatagaaagctaagctaaaggaattattagaaaaagaaggaaaatagtctcttaaggaaattataggccaggcgtggtggctcatgcctgtaatctcagcactttgggaggccgaggcgggtggatcacctgaggtcaggagtttgagactagcctggccaatatggtgaaacaccatctctactaaaaatacaa

SEQ ID NO: 122566 - DNA, 750 bp, Homo sapiens
ggtaggtaatagtagtactgtggaattcagtgagagtttagggccagggataaatatttaggagtaactgatgtatgtctgctagatttggtaagtgaccttgacaagtgtggtcttagtgggaatggaaactagattgtagagaagtatcaggtaaaggatggaatgagaatatgaagttggggaatggagacagtgacaatagactcctaagaaattttcctgtgaaaagggaagcagaaaaatggttgtgaccacaagtaaggcccagattcgaatcttacttttatacttgcctggatacagttattatttgagtgcattctaaagtttaagatattttatgtaccctacgcagtcctctctacaaatattgaggtagatgatacttttccttctgtgacatgagagtccttagtttagggaagttaagtgacagtccaggtagaacctgtatttggactcactcactttgactgtagatgcagagtatttttcattataccaaaatgctccttaaacttttattatcttggtcaaatccaatctaccttagagtttttggaaggattacaagatgagagatgtgaaaattctttgcaagctctaaattgttacacaaatatagaaattcctttctttaaaatgccccattatgtcttctttgtgcatgactttttaggatatagtaggtagtggccttgaagttcattttggatcatagcctatctcattagagcccagagaatg

SEQ ID NO: 122567 - DNA, 705 bp, Homo sapiens
gtataactggggaaaacgattaaaaaacaaaacaccgtggtcgggcgtggtggctcacacctgtaatcccagcactttgggaggcacaggtgggcagatcacttgaggtcaagaattcgagaccagcctagctaacatggcccaaaccccgtctctactaaaaatacaaaaattagctaggtgcggtggcatgagaatcacttgaacccgggaggtagaggttgcagggagccgagatcgtgccactgcagtccagcctgggtgaaggagtgagactctgtctcaaaaacaaaacaaaacaaaaaacactaaaagtctgaaaattattctaagggcacatagcaaatgaagaaacatttatttaagaaaatctgaaaacttcgtgtttctgtactattcttctgataacctgctttactttctccttatgaacattttttcaaagccttttcatatatctggaacgctttttttttttcatataaataagactcgaatggctcatgactacaatttcaggaatgtgaattttgcaatatcgttatatattaggactcactaaggaatgttgatttaacttatataaataaaaatagaatagttttttacaggtacatttacagacattcaaggagagtgcaaattattaaaattgtctatttttaagatgtgctaagaataaatttttgaagcagatgctagaaa

SEQ ID NO: 122568 - DNA, 108 bp, Homo sapiens
tgatgtgtaactctttagacgttgaatcttatttggacatgggatgtgaggcacagacgggaactttatgcctttccaagcccttagtcaatcatccctgcaccattg

SEQ ID NO: 122569 - DNA, 498 bp, Homo sapiens
aatgatgtaggaggaaaagcttgagtcgaggatctggaagacagttaaaatcaggaagaaatcaactgtcaagagtcactaacaggacaaagtgataagcaagtcactaacagaggtcaagtaaaagacctctagtaaaagaatggaccactgaatttagcaacaaaatcactgctaatcttgacaatgaaatgtcttggagtggtgttgggaggaaagcctaactgcagcaaattgaagaaaaataaaataaaaactaaaaaatgtggctgggcaccatggctcacacctatactcccagcactttggaggctgaggcaggaagatcccttgaggccaggaatttgagaccagtctggacataacagccaagaccctacaaagaacttaaaaactagcagattaggcctggtgcagtggctcacacctgtaatctcagcaatttgggaggccaaggcgggaggatcacttgaggccaggaattcaagacaagccttg

SEQ ID NO: 122570 - DNA, 112 bp, Homo sapiens
gaggcttgctccagaaaggtggtctgcaaaggggttggctgggggggaggaggaagtcattctccaagtgtttgtcctcatcgttatcccaaattgcttgcctggaataagg

SEQ ID NO: 122571 - DNA, 937 bp, Homo sapiens
gaatgactgtttctgcccatggggaaataaattggcatttttctgctttcgtttgttttttagttattgatgttctagaaatttcaacaaaataaggagtgtttttgtatttcaaatgtagtgcccgtttctttatttctttctggtactttccactggtttgtgttgataatatgatctggaaggtagcgataatgcatgggaatttataaatgatcacaaaatactttgtcacaggaaatctggagaaataatgactttggcatatgtataagagaagtatctctaactgttaagtctaaactaaaagcttgttacttttcggtttggtataaccaaaaaaaatttgaaaaataaaatagaagtaatgatttgttttctcaggtgtagttgtatttgactgactctattgtaggaggacacgtttaagactgaatggttggataacggtaaagacgtcctttcaatggagagttgaatctgataggttgaagttttggatattgaatgaaaagagaaaagagagccggacaagctgaaaattcctgtggttccaactactggggaggctgaggtgggaggatcacctgagcccaggagtttgagactgcagtgagctatgatcatgccactgcgttccagtctggatgacagagtgagaccctgtgtcaaaaaataagtaaataaaaagaggaaagagctaaaatgagaattcaatctgattcagaatataaaaatattctactgtcccatcattttttgttctttaataagctttaacattgaagtataatgtatataaagaaaagcacacaaattataatgtacaactcaatgattttcataaaattaacactcccctgtaaccgttggtcaaaacagatcaagatacagaacgttgcgcctggtgctgtggctcatgcctgtgatcccagca

SEQ ID NO: 122572 - DNA, 811 bp, Homo sapiens
cagtattcaagtataagagcatatagaacaccaagcagattcagcccaaagaagactaccttaaggcatttaataatgaaactcccaaatgtcaaggataaagaacagatcctaaaagcagcaagagaaaagaaacaaaaacacataatggagctccaatatgtccggcagcagggccaagcagtcgtcgacttttcggtttggtataaccaaaaaaaatttgaaaaataaaatagaagtaatgatttgttttctcaggtgtagttgtatttgactgactctattgtaggaggacacgtttaagactgaatggttggataacggtaaagacgtcctttcaatggagagttgaatctgataggttgaagttttggatattgaatgaaaagagaaaagagagccggacaagctgaaaattcctgtggttccaactactggggaggctgaggtgggaggatcacctgagcccaggagtttgagactgcagtgagctatgatcatgccactgcgttccagtctggatgacagagtgagaccctgtgtcaaaaaataagtaaataaaaagaggaaagagctaaaatgagaattcaatctgattcagaatataaaaatattctactgtcccatcattttttgttctttaataagctttaacattgaagtataatgtatataaagaaaagcacacaaattataatgtacaactcaatgattttcataaaattaacactcccctgtaaccgttggtcaaaacagatcaagatacagaacgttgcgcctggtgctgtggctcatgcctgtgatcccagca

SEQ ID NO: 122573 - DNA, 332 bp, Homo sapiens
cctagagatgtttcccttctagacgggtccatgactcatcttctcccgggctctgttactcagctactcagagtcatggaaaacggctcccaccaggccccagacttgaaagagacaagagacagggctgtttatccagggaactgccagagtgtgacatatctgctgcgtgatgtttagagcactgcctggggcacctcatcggctccatgaggtctgcaaacagactaaacaccaagtgccaagagtccttcctaggcaaggacgcgaaggctaaagtctacaaagatgctttgcccccagaatcaccctgagttgcaggggctcctcca

SEQ ID NO: 122574 - DNA, 361 bp, Homo sapiens
tccatgctttgcccattgtgggtggccattgtgatttcatggttttttgttgtttgtctgatcctgtttattagaaagtgaggagaggatgattatgttccttcatcctctcagtgtcttagtactccctacacctgcgttatgttatgacctacctttgcgatctgccagttttggggtcagcttaagtgagaattcatattctgcttcactggaatgagaaggctctcctcacatattatcatgcttctcaagttggtatatatgagccaacttgattatgtagtgtgtgtgtgtgtgtgtgtgtgtgtgtataggaagtcacagataaaaattgagccaactgtggaaagtgacagtt

SEQ ID NO: 122575 - DNA, 181 bp, Homo sapiens
ccctctttttcctcttgctacatctacatgtctggtaaatttctacatgtttcataaccaaggctaaatgctgaatctttgtgcagtttccctcagtcacttctccagtcaaaactaactgctccaggccaggcggggtggctcacgcttgtaatcccagaactttgggagacaaagacgg

SEQ ID NO: 122576 - DNA, 316 bp, Homo sapiens
acagcgctgagcaaaagcccatccctgaagctgcagcctaaactgtcaccttcagcagatgagctccacccggcacagaagccaggcagggctgcaaggagcctgcaggccgcaacctgcggctcggcatggctgggggattgactcagctgtcctgaatccatacttggacagggcaccctgggagatgcagggctgaccacaggtcccagcccatcagtgtgggctgcatgactgccctgtccccagggaacagacgccaacccgtgcccaggctcacaacagtgggtagagcctaccccatgcccaggtcccc

SEQ ID NO: 122577 - DNA, 513 bp, Homo sapiens
tgcggtggcccatgcctgtaatcccagcacataacggaggccaaggcaggtggatcacctgaggttgggagttcgagaccatcctgaccaacatggagaaaccccgtctctactaaaaatacaaaattagctgggcatggtggcgcacgcatgtaatcccagctactcaggaggctgaggcagaagaatcgcttgaacccgggaagtggaggttgcggtgagccgagattgcgccattgcattccaggcaacaagagcgaaactctgtctcaaattctagtagagtcaggttctcagtatgttgcccaggctggtctcaaactgctggtcccagcctcccaaagtgctgggcttgtaggcaggaggtaccatggccaaaatagatatttttaataaaatattatagccttgctttaaattggagaactgatgaaaaatactttgtctctttatctgggggaagttagcatcttaattatatatgacttgatgtttcatatatatatgacttga

SEQ ID NO: 122578 - DNA, 742 bp, Homo sapiens
agaatatactaatgtattgataagggagtccaaaattgacctctaaaatatttttgacatagcctgttatgctatcagtgttggtaagtttgttcagtatatttgtaggctacacacagtcctttcaaagaagtatttaacctttgagggaaatacttttgtaattgttcaaaatcaaaatgctttatttctgtgaacttggctgtgagataaatgttctgtccacttcataattttattcagcagtgcttaaaaaagagtatttttagttatctcatagtgtttatattcagtaagtgatccctcagtaacatggtcctagtaagactgttaacatttctctttaatattgatgtatttataaaacttacatgctacactttgatgctctgccaggcggtggaagtagtgaaaagagcacatcaggctttagagttacacaacccgattttgtatcccagctttgtttcctattagctttgtgatcttgagcttgtaattaactttcagattttagtttccttatcttttgaatgaagaaaatatgttagatgttattctttttttaaaagagaaaacttgagagagaactattaggcacactttgatttatccttttagttttagctgggcttctaatacctttctgaagcctttctgagctgtattccccacctcttccccttaactcccatcatgccatgtgcttaccagcatcatcattattgtgtcctatttttat

SEQ ID NO: 122579 - DNA, 565 bp, Homo sapiens
gcaggtttcatgtcctgggaagactgtattttcaacctgcatttggttgtggatgcagatacagaggaccaaccgtatttactgaaaaaatatctgtataagtggaccttgaagttcacttgtgttgttcaagtgtcaactgtatagtgctttctttgactttcatttttatatagtatgtgatttttagtttcaatcgactccttaatcgagaatttctaaggagagggttctctctcagtctgtgtgtgtctctctttatggaactattttgtattctcttggggattcttttaggatttctgattcccatgcttccttcttggtttacttccttattttattggagcaccttctctaattaatttctaggaaatagtgcatggatagtgaagtttttgaatcccagcatatttgaaaatgtctgtgtcgtagctttgtagttcttgatagtttggctgaagataggtatctgggtaaatagatgttttccttcagaattctgaaggcattcttcaatgtcttctagtttccattattgatgatgggtgataaggctgatgcc

SEQ ID NO: 122580 - DNA, 689 bp, Homo sapiens
tgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggaaaatcttttaaacacttagttgatgatatataataaaatttattatataatgtaggtttttgtgagatgtctttttttatgccaaagataatcaagtttcctattatttatactttgttagaaactgtctttttacatcacaaatgagcactaaacttttctgaattcttggtctgtacctgttacagtaattatacggattgcctcttaatctgctatgtggtaaattacattgatacattttctaaagttaaatctgtgcattcctggaataaaccatgcttagtcttatttaaaacctatttttctatgctgctaaatggaatttcctaatgttttacttagattttttttatgtcgatgtttacaagtgacttggcatgtcgttttcttttttatactgtctttactggttttgggattaaattatattgtctcataaaataagttgaatggctttgtctttgtctattatctggaacagcttgtataacatgggaattatcagttctttgactatagtaaaacagttgcaaatctc

SEQ ID NO: 122581 - DNA, 276 bp, Homo sapiens
gtcaggtccagcaggaaagaatgctctcctgtgtccccacttcctccagaagccacactcacccatcccacctggcttggtcctcatgtctatcccagaatccattactggggccaggggactatgacacaaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtg

SEQ ID NO: 122582 - DNA, 396 bp, Homo sapiens
tgggtggccattggaagagaggtcattttcagctggaaaagccagaaaagagctcactgatggtgaagcatctgacagggaccttgaaaacaaaataggggtttacacgcagagataaaagaggggaaatgagcattccagggttaaggaacaccctggggaaaggcatggaggtgggacagtaatggacacataacagaataatggacacgagaaaggtcattttggctggggacaaacacatacacatccatgcaaagacacgcaaatcacacacacacacacacacacacacacacacacacacacacacccatgctatgaccctggactcgccctctccctgttgttctccccctcagggtggatggtaggagagaccttcagacccaggca

SEQ ID NO: 122583 - DNA, 342 bp, Homo sapiens
agagcaaaatcatgtgttccttaatctttaattagaacaatctgcaagtggttcattaattagagaattttgtctttaaaacaggaacctcaggaagtaacaagcaagtaggaaaagatgacccttttaaaagaaattattcttctttagtctatacttattgcatgaccttaaaaaccaggggacagggaaacagcaatgtgttggatcccacaggagagctggttacatgcatcccttctcaaccccacgttcagtgatatcacattagtagctggaaattgaccatggtggaagtctttacaccagggtaactggcaaacatgataaagcaagcgtttt

SEQ ID NO: 122584 - DNA, 565 bp, Homo sapiens
cccacgcgtcgcccacgcgtccgggatgtttctgattttcagcagaacattctatgtctttcaccgaaaggagagattgaatatataatcttaggtttgctataattagttctgatgacagagttaaatacctcagccaagactgtaaatcagtacgtaaacaggtttctgcaactgatcataaatctcaaactgcatattttaaacacttatttttttaggatgacagataagggagcagcaggctaaggataggaataaaatgttatctgaacttttaagtcacaacttagaactcacattaaaatcttctgattttctttataccttttgtctaaaatattatcttttagcttattaataactttaataagacaagtttgaatttaattcacaaaaaatgaagatataatttataaaatgtccaaatttttgttaagacattactttttaagaaatgtgtgtcttgctaaatataaaacatattgtatgaggttgttgtttaaacaaaatgagagttgtacattattttttaagagatgataaagtttgaggaggcaagccg

SEQ ID NO: 122585 - DNA, 350 bp, Homo sapiens
atgataaaccaggagattagcagaagttttatatattccagaggtacttaccctattcaagtggtgtacagtattgttctcaggtgtggaaaaggcttcaagaagaatttagctggttccaggtagaagaggctattgttttagatagagattagcttgtgggaagataaagctggagaggatggatggtaccacattaggaaggacctcatatgtcctgctaaggagtgtatactatgtatgaggaatagagcagctgagaactcttgagtcttggccatgagatctgtgttcagagagagctgtttcgtaaagggccagtggactagagaggagacactatatagggc

SEQ ID NO: 122586 - DNA, 300 bp, Homo sapiens
cagcgtgaagctaggtcttttctgtagtctaaactgtcaggctctaaccggagtctgtgtccactaattgggacctgaacatgggtggggatcacttctcctccctcatctcatcagtaaccaagtggcaagtggggtcgcttcagccctgcctggggccccagctcctctaagaaaaccaattcttggctgggtgcagtggctcatgcctgtaatcccagcactttgggaggcagaggcaggagggtcccttgaggccagaagttcaagaccagcctgaacaacgcagacgcgcctaat

SEQ ID NO: 122587 - DNA, 135 bp, Homo sapiens
ccaatgagagacagaaagaggaagggccagaggctttcattcttctctgaggtcgagatcagacaccctcttctggcttttctcaacagcttttcattttacagcagcaccttatctgggcccaagtatcaaaag

SEQ ID NO: 122588 - DNA, 390 bp, Homo sapiens
gacaaaggaactcaccagcagaggtggccagaagaagaaatctttcctggcaattgaaagaaatcttagtgcagattgtggtctttgcactaggatgagacagaggttggagcttgtcttcctcagacatcaaagagcagggagaaccgaactgccaactggtttgcatgtggcttgtggtttgacagctgactctttcttaacttctaacccaaggatcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtcc

SEQ ID NO: 122589 - DNA, 365 bp, Homo sapiens
agcctccttttccccccaaaagaacaattttcaaaagccctactggcatagcacatttgacactggtatttctatgccattgctacctgcctgccacctctttagaacatctcctttctccccagtggcacctcccactcaaggcccatggcctgggcagctagaagcagtcaggagcacttcccctcccctcacgactcacactactcttagaaaaccatgggtgagaccacttctcaacttacagagtaccgcccatgtaagcatttgaatcagggcttggacatgtgaagctacaggagaaaaagtggttaaaagcagacctggggccaggtgtggtggctcacgcctgtaatcccagcact

SEQ ID NO: 122590 - DNA, 343 bp, Homo sapiens
ctgagccacccctgaattcctaaaccatagaaactgagaacactaaatgtttactgttgttttcaaccattaagttttgggataatttgtggggcagcaatagataccaagcacaccagccacagctctttggtggatacggagaattcagttgcctgatgtcctcagaccatcagagaatagctctgggatatttccctggccccacagcactctctctgattccttggcttttgactcacaggttgaaaattaccaaaccaaacatgctgcaggataaggtttagaaggcagaggaaacaaaaaattaatattaaaccattgtccctgctgttaagtccca

SEQ ID NO: 122591 - DNA, 391 bp, Homo sapiens
tttatttttaaaaattaactgcttcctcatttatctgcgttgtaaattaattcttcattcaacaagtgattattgagcatcaaccatgtgccaggcactgagtccgtaatacttatcaaggcagcatactcccattgtccaggagctagagtatacatggagagacgcacaagcaagtgactaagcaagttcatttaacaagcacaacgtgtgctgagtgttaccaaggaaataaacgtgacatgtggtggagaagagctggagacctatttcacactggataatcagggaaggcttctccaaggaagtggcatccaaactaagatctgacagtcaagaaggagctcatccatcacatagaaagagagcaaggatggccgggcgcggtggc

SEQ ID NO: 122592 - DNA, 375 bp, Homo sapiens
actatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtg

SEQ ID NO: 122593 - DNA, 185 bp, Homo sapiens
aggtgtgacacctttagtagggggcattctcagagaaccatcgggcaacttgccagggtctttgcgaggttacccgcatttgccagggggggagaagggagaatcattggcgaccctgctgtccctgaagaccatcagagtccgcgagcgttttctgggtgctttctggagcttctccagcgttg

SEQ ID NO: 122594 - DNA, 330 bp, Homo sapiens
tgccctcagcacgtgctctttccccacaagacgtcctaggactcccctaagaggatcaccccacgttgaaattcacagggaaggttgtgaagacatgaggccacttccttcccctgggttacaaaaaagtgatcagattttgatgccactccatgactccacaaaaatcaactttccctccttatccagcgcaagtttttcaaggtttcacctgataacgaggtaagcccccagactccctcggatcttctgctgaccatgcccataccaggggacctctcctccccggcactcctgagacagtcccctgagctacctcgctcccaccat

SEQ ID NO: 122595 - DNA, 371 bp, Homo sapiens
tcttcatcttcatactgaagagacaaatcaaaagaaaaataagctctgatgagatatcacacaaattcccatattttctctgcattttgtcaaccagagttgtcccaaatgacatttacagaggactgcacccaaggaggtgtttccaaagccaacctttttcatttgctagtcagaaagacttgttatgcccttatttcatattatacccaaaaatcaactgaaatggatcaggaaacctaaatgcaagagataacacttttcccccaaaaaattccgccaaatactcatatgggaggaagtgttcttgaccagtatcaggtcacaactttcatgaaatcctaaatctcaaatccaaacttgatttccag

SEQ ID NO: 122596 - DNA, 306 bp, Homo sapiens
cttaaaatctggaaatgagattggtagagacttaaatgattcatacaaatcctaaaagaaaagtcgggagaagtcctaagttggaaaatagtcagctcatagaaaaactcagtgaatgttttatgaaggggtgaatttatctagtcatttactccacaaacaagtactgaagctttacaatcaatgtatttagcattattcctattgctggagataataatggtaaaaattcaaagaccctgtcctcatggaacgtagattctaatgagagtagatagacaataaccatgtaaacaaataagcaaa

SEQ ID NO: 122597 - DNA, 589 bp, Homo sapiens
gcttttagatggctcctcttggaactatgcatctctcctgatacttggatgcttttcctctgactgatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacaggtgaggttgctgggggaactcttttacaacatctctctgaaagaatccgggctgccagtttcatttggtttgggtgtcagtagcatgatggaaagacaaaaaaacacaacttgacatctgcagaaatgggttcaaattttacctgcaactcaccaattctgtggccttggttcagcaattaaactccctaaaattcagttttttctttgtaaaatggggttatgaacagtacctacttcaaaatgtgtttgtgaagattaaaaaagttaacataaagagtttagaagagtgtctggcatattgtgctcaataagtgtttatttatttattgctgaataaaccagtaatttaattagtat

SEQ ID NO: 122598 - DNA, 658 bp, Homo sapiens
cagactgctgtgctagcaatcagcgagactccgtgggcgtaggaccctccgagccagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacagccatgtgaagtgctcactccccctttgccttctgccatgattgtgtgtttcctgaggcctccccagaagctgagaagatgcttcctgtacagcctgcagaactgtttgaatgagagaggcagaagcacatttccaatcactgggggaacctgagaccattctttccaacccattttgccaaatggatgtcctgaggaaggtgttccaagagaggcgatgtcaggatagtgtctgattggagggtgcccaaggcacatgggagaatgtggaagaactggaaagacttgggtgttgctgatgttaaattacttaggtatctctgtagaaacttagtgggtcattccttctcttcacaatccctttcttaaatttatgataaacgtgaaaggtaatcaaaacaaaagcagggcaaaatgggaaaataagttcccacttta

SEQ ID NO: 122599 - DNA, 565 bp, Homo sapiens
tagatggctcctcttggaactatgcatctctcctgatacttggatgcttttcctctgactggtgagacctccatctctgatcccatctgcagtcatttgggtgcagttcaactcacaggattagaaaaatctgtggccggaccagtgagatctggcctggagtgctggtcagtgacttctgtgactgaccatccccttgggacggacagaccctgggtctcttcaccctcccctctcttttcctggagaagccagctctttcaggttgggctgcttcctagaatttcttggtttacttagttccaagtgaggtgggaggtggaaaagggggcagcttccaagttctcctggggagagcaaactcagggccatatcatcatttcaccacagacaaccactcacggaatttttcctgatgtctgtgtggttctcaagtttcccaacctgttcaccctgaacacttggagttggcttctgagctcagagaaaatactcactgttgccaggccaccagtttagccttggggagtgatgattaaataaataaggggacccctcccccaat

SEQ ID NO: 122600 - DNA, 380 bp, Homo sapiens
ggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122601 - DNA, 2530 bp, Homo sapiens
ggtccgggctgctgtgctggcagcagtaggcgagggcgcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122602 - DNA, 2560 bp, Homo sapiens
ggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122603 - DNA, 3008 bp, Homo sapiens
caaggtgctggtacgcccggattacgggatggttcctggtgctgaggacggacgccattggagttcccgagaagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122604 - DNA, 2564 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122605 - DNA, 2543 bp, Homo sapiens
caaggtgctggtacgcccggattacgggatggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122606 - DNA, 2490 bp, Homo sapiens
tgctggtaccggtccgggaagtatgggatcgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122607 - DNA, 2432 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122608 - DNA, 2515 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122609 - DNA, 2412 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122610 - DNA, 883 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122611 - DNA, 515 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122612 - DNA, 331 bp, Homo sapiens
actgcatccaacgccgctgactgcatccaacgccgctgactgcatccaacgccgctgactgcatccaacgccgctgactgcatccaacgccgctgactgcatccaacgcgcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122613 - DNA, 2629 bp, Homo sapiens
ggtccgggctgctgtgctggcagcagtaggcgagggcgcggctgcggggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagaacccggagctcagagaggagacgcctctgagcatggctcccagctggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122614 - DNA, 5311 bp, Homo sapiens
  misc_feature (2859)..(2859): n is a, c, g, or t
  misc_feature (3011)..(3011): n is a, c, g, or t
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagnctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctcttnccacacctttagaaccaaggacactcccaggctgagtctcctcttggtgattctgggcgtcatcttcatgaatggcaaccgtgccagcgaggctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgcctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggaccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122615 - DNA, 2500 bp, Homo sapiens
caaggtgctggtacgcccggattacgggatggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccaccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122616 - DNA, 2421 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122617 - DNA, 2234 bp, Homo sapiens
caaggtgctggtacgcccggattacgggatggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggaccgaaggccagggcggtcttgggaaaagggagctcacgtcacctgagaacacggtgtggggtgtgaaaacggccgccatcaccttgagcacctgccctgtagactgacacaagaattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaaaaaaaaaaaa

SEQ ID NO: 122618 - DNA, 329 bp, Homo sapiens
ctatgattctgctggtcatggtgctttagaaagtagttggtctatggaatccttgtcaagcaatacagagagcacccagtgtcccaatatgcttgttgcccctggtagattataaactccttgaaggaaaaggttctgtctgcgtttcatgatctctcaagttgcaggctcagggcatggcatgtcagatgacagaaagtgagccctttaatctctctgggaagcttaataaagattttatcatcacttcctatcttccaaagcattctctacactgcatcattggtattttgccagagatgcaaaattcatcatgtccctcttccatt

SEQ ID NO: 122619 - DNA, 2593 bp, Homo sapiens
ataaaatggcaaaatccaacatgcaaaaacggcaattacttttgcactaacctgataataattttaataagaataaatggtacatatttaaactatataatttgatcagctttgatattcatattaacctgtaattgctcccaccatgccaattttgaaactgccaacatgttactgaatgtagaattgggaagagttgctgatagcatcctaatatattctgtttctaccatactgatacagtggccacgattacctcaagaatgtagaaaataaaatgtagtgaaatgattaggaagaagttgtttcttcacaatcatgacaatgaacgtgtcattccacaagttacctcattgtcctttaataattatctgcctataggcaactattgatttactttccattataatacattagttttcatttgctagaattttatatgattgaaaccataatgtatttactcttttttaatccctgggtatagtcacgtatttattttgagattcatcattatacctctatgagtagtttcttttttttgtattgctgagaagtatgatgttctgtggatataccagtattcgtttattcattcattcatttgttatggatattttgagtagttttttaaagtagtttgaggtataatggaacttaaagtgcttatatttaaaatgcatattttgatattttcatacatgcttacaccctggaacgcagtttccttctgtctttttagttcattctcaacatataaaattaattttcattgtgtaaaattactggtacaatgacatattttgtctcctgttacagctgtgttcaattacaaaaaaagatggaaaagactgttatgaagccagatgaacctttctccagtcttccttcactatttttttttccttcaccatttatcatttcatagtcatttatgtttcatcggtcctcatgtgtactagtgcgttattttacttatactcccggatatcatattatttaatgcatagcctcttcagaatgcaattttaaaatgtaaaggctcttttataaccccccaaaaaatcacacaaatatattttaaaatgtaaatattttatcgcttctgttttctcagttgtctaaaacaatgtgtttcttaaggaagatcatttttattcaggatccaaatgtatatttaatagctttcagtagttgtatctcataagtctgtaacctacaggttccatttacctttgttttcttatttcttgaagttgctgagtcattttttaattagaatttgctgtattctagatgtggcttattgaatctctaacattgtttaacttgtacactagatgttgatgaaatcggtgattgagattttgtcccagcagacaggtgtgtgatggcaacagtgaaataaatacaaaaccttctcccaacccagaaatcctctccacgaaggtagagacagaaaacgcttttattaagcattaaaccagaatgtgatgcacatcacagacaatccactaagaaattgcaaggtaagaaaaaagcctcactccttcatatggcctagcagatgtagcccattacacacgttttcaagataaacaacaacaagtcctcaaatacgaatttgacagcaccatttgtcacacatagttcatcctaacaggtgatgctctattaccttactggctttacctagaggaaaagcaaacatcatatctttatgacagaggataatgaggggagctgccttggggctgctggatgatacatcgggacaggacagtgcgagcttccagcaaggcagctctagttggagccctgatttctttccaaggtgaggagagggtgatgatagtatccttgggaaggggagtgaaaagtgctgagggactgtatttatagctgagggatttcctgggtgctgtgggtctcttgtctttgccactctgcctcaacactgaaactgtccattccctacttggaggctgcacccaaaacctccctctgccttcatgctctggcctccccctgcaagttaccaccctgggtcttggtgcttgcagcacttccggtgcctggctgccccaggccctctgctccctctgctgcctgggtttaatccctcctctgccactgcccagcatcaggactctgctggttttgcagcctcttggtacctcagttttatgtttgtggaataggagtgctcacagtactctctgggatcctggcaaaaggtgtggtaggcaggtggtaagcagggccgagcactatccccagcacctagtgagttgatgccttatcatttacctgatccaggcaggtcttaaggtacaagagaaagagaaatggggcttcttagaaccccctgaccccacagcttctacttggatggaatttttggaagaagcactggctgcagagtccagagatctcagtgtgaatttctgaaggactccttcccaaggaagtgaccttgagaaagtccccaacaacccctgtcaaggacttgactaacagcttctctaatgtttgtctccctttccaatttaagaacaaatggatgaaatcaagtatgtgtccctaaccaatg

SEQ ID NO: 122620 - DNA, 637 bp, Homo sapiens
tatcttattttgaaagccaaacatggaggcactcatataaaatgcagatatatatgtgtataaatatgtgtgtgtgtgtgtatatatatattatgtatatgccaatacataatacctatgtatgttttggcagtgagggagtaagttatatttgccaaataacttggtctcaagaaacatacaggtctcagtcctcaactgtatgaggttttaaagcattcagatagattcctcacattatctttttctttccaagatttaaagctgtcacagcaaatttattattagagaataaactttttcagtcagctctgtaaaaatgtagtaacagctctgtaataattcctgcagcatatttcctaaaagtaaaactatgaatatctattaactatttagaaggaattaaaaatcataatatcacaaattcatgtcaaaacccaattctttttgtttattttgagctggaaggtggacttcacttgtgcaactctgagtgagcacatttttattaacaccgtaaaccattgttccccggatgtggtcatcatttaagtggctggtctgtattatataaatttacagcagtagtcacttgattctcatgttgtcacgatagtcttaaaataatagtttattt

SEQ ID NO: 122621 - DNA, 380 bp, Homo sapiens
tgggattatgagcgtgaaccaccgtgcccggcccatgcacatcttttttaaatagaggattttttaaaacaagggaaaaaaaggctgggcgtggtggcttgctcatggggccgcacatggtggctcgtggttgtgatgaggtcgcatcactgcactccagcctgggtgacagagcgaggttctgcctcagaaaaaataaaaataaaaataataataatagaaagagagaaaatgcatcttcacacactgatgcttttccgttgctgcgtcagcaagcgtgcccccatccccgctgacaggtgcaacatcttcagcctgcagagctcccctttgtgaacaagctctagtttttttctattataaacaactccatgaagaat

SEQ ID NO: 122622 - DNA, 231 bp, Homo sapiens
aaaagtcatcatagacatgccaaggtcacgtaggaagatccatgcaccaagtctcttccataaaactcccaaacccaatgacaacaaataaacaagactactccaagttatcttagaatctgcaaagtggattcttggaatacagagaaagccaacaagcctaccagagacctaggtcttcaattgtctgcttactgcttcctgcccagaagaagagtgtattagtttcat

SEQ ID NO: 122623 - DNA, 186 bp, Homo sapiens
tcttgttccctcagcctttttcacaaagactctggctgattgggactcgcacagctagcggcaacggcaatcatgaagaccattctgtgtacatttacttgaagttatatttttatgaattaagcagaaactaaaagcttgaagagacagctttttaggaacttttaaaaacatagatagttgtct

SEQ ID NO: 122624 - DNA, 270 bp, Homo sapiens
ttataaagaagtatctgaggctgggtaatttattttaaaaagaggtttagggccaggcgcggtggcttaggcctgcaatctcagcactttgggaggtcaaggcaggcatatcacctgagcccagaagttcaagaccagcctgggcaacatggcaaaccccacctccacaaaaaatagaaaaaacattagccaggcatggggctttggattctgtctgattgaacttttttattatgggaagtttcctactcatatgagggtaccgagctc

SEQ ID NO: 122625 - DNA, 345 bp, Homo sapiens
gcccatgcccgcagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagagtcgtgtgccggaacatgcttcgcaggaacaacgaacccgctgaagacactgaacgaactcgcgtccgtggggatgctctagagtcagcacg

SEQ ID NO: 122626 - DNA, 122 bp, Homo sapiens
tgcatcagaacacagaaaataaaagacttggttaatacagtttgcttcatagctgctggtatcacacgtgcagatagcatctcacttgaatttctggttaagacgagtgatccacattttga

SEQ ID NO: 122627 - DNA, 284 bp, Homo sapiens
tctttttcagcatgactttcccctatctgttaaatctgaattggctctatgacctcttttgaccaatggaatgtggcagtgtaacatctaaggatttgtcttaagaaaactgcagctaccaattggtcacctataacacttctgtttagaatctaggtcccatgcagtgagacagcccaaacaatcatacaaagtccatgttcaagagaacatgtgaacattgtcaacagctccagctgagttctagctggcaacaagcaccaactgctaaccatgtgagtaag

SEQ ID NO: 122628 - DNA, 222 bp, Homo sapiens
atactcggctctgtgacaaggagtatacaaagactcaggacaaacatggcagatattcttggaaaatacatatcactgttactatatcaatatcaggaaatattacagaactgcctagaattttaatgaaaaagtacacaaatgtttggatgtctcaagccacatcctctttagattatacccctacgcgtctagggtttcctttgcctctaaaaggtacat

SEQ ID NO: 122629 - DNA, 661 bp, Homo sapiens
taagagacagtctcagttacataggctggaatgcagtatcatgatcatagttcacagcagccttcaactcctgggttcaagtgatcctagaacttgtggcctcaagcagtcctcctgcctcagcctgccaaagtgctgggattacaagcatgagccactgctcctaattcttaagagatatttttaaacctcatagtgtatactcttcagaattactttttgaaccataagtttaaatggcaaacactttctaaatgtattttactgaaaggccagttgagaagaagaggattccatcatcttttgaattagcatgaggacaggccattaaaattcatgattaagagcacaggatttaggtctgacaaacctgggtttggatttccattttgctgttctctacctgtgtgacttggggcaaattacttaatctccctgagcctcagctttcctctttataaaatgggaataacaacagtatttacctgagagaactggtattagaatgaagcgagagtaaagatttgcaaagtactcaacacaggcctgggatatagtaagtgctattttgattatttttaagggcaaagagattagatagttaacaaaaaaaggaaaaccaaatattggtcattggagggtttctgtggaaataagatat

SEQ ID NO: 122630 - DNA, 800 bp, Homo sapiens
acgcggccgcgtcgacggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggaaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggcc

SEQ ID NO: 122631 - DNA, 165 bp, Homo sapiens
atggtgctgcaaccctcaggtgaatcactaggcagagagtttttcccagggctgacggccagaggaggcccatcctctacacaaaattaggcagccacgaagccataaaagccaggaggtcagagacccttgaggggctcccagtggggagaggaaccagtggca

SEQ ID NO: 122632 - DNA, 335 bp, Homo sapiens
gcgaattccagctcggttcccccatttcacctgcactgagttttcctgcccttccagatctaaccaatgtaaatcttacgtgtattgattggtgtatatatcttccctaagatgtataaaagcaagctgtaccccaactatcttggggtacagcttctgaggctgtgtcatgggtgcgtccttaacgttggcaaaattaactttctaaactgactgagacctctctcagattttgagttcacaacgtttacaaaaggtctgtgttatagtgagaaaactttgctaaacaaaatgagttatccttcattggagtattagtcattgcagagaatgaa

SEQ ID NO: 122633 - DNA, 452 bp, Homo sapiens
tgataaaggaagggaaataaatacttcagagagtcatgcccagagtaagaatactcgagggtaatagggattcttagcttgatgaaaaaatatgaatacacaggacacctcattcccaagggatttcaggaatccaaaattctgctgcaacagaaaagattcctctaaaaaactgcagaagtcaagcttttcattaattctttccaggctctctcctttcttactgtctccctaccaatgtgtgttaatgaggttttactggaacccatcatgagccacaggtagagacttaaaccgctccaccctccctgtagagctgaagccagggatgacatcacttctagaaggctctgagcctgagcggaggcagctagtgcctcccccccataccctctctgccaggctgtgggaaaatgtctctactagcccccataattagggcaaaagggatt

SEQ ID NO: 122634 - DNA, 306 bp, Homo sapiens
tgttcctaggagtccactttgaggtgagccctgaatgccttggtgcaggacttaaattgcatcttctttcctgctgaggcacaatgttcaaatgttatttttctctaaggaacccagagagagttctttagagacatcacctaattcaacacttcctatattagacctaaagggtatgatcaacctgggtttgggagattgaatcactttcacaagaagagaaggtgaagaacagcttcacttttccaggtggtcctaatgactcacctgataatgacaacagattcagagccagcctccccatcc

SEQ ID NO: 122635 - DNA, 762 bp, Homo sapiens
gctattcttggtttaaactgagtaactacagtttcaactgattttcagaaacttaaaactaaagttagacatttctctaatgatatttctgtcagtattctatatttctaccttaaggactacccctaaaactttacaaacagaaggaaacagtacaccaaatagccttattctgttctctagcttaagtggatttaggcagaagtacacttggccctcggtatccacagggttcctcatctttcgatttaactaactggattgaaatattaggggaaaaaggaatgagaaataataaaacagaaaatacaaacttaaacacagtataacaactattcacatagcatttacattgtattaggtataagtattctagaggtgatttaaagtatatgggagtatatgcatgggttatacgcaaatactgtgccattttatataagggacttgagcatcctcagattttggtatctgcatgggtcctggaaccagtccccagtggagactgaggaacaactgtaagcacttagtttgaatgagatgtcatttgtatgagcagatggtgtgagctgaatgatagcatctgccttattattccatttctttttatctgttatgaatgaagaattggttaaaatgctttagaaattaacaaatatcttccagctgtaggtaaaacgtaggcctcttcagtcaaactattgatacataaaaatttgaacttaaaaactgctttaaaaaacgaacttaaatagaaaaatg

SEQ ID NO: 122636 - DNA, 685 bp, Homo sapiens
tgttatgtagtgccagggcagtaatagctagctaatataatcaccatccatttagtattccaagccagaaacccgggcatcatagctgttgagttttgtttataagaaaaatcatgctatgattttaaaaaatacattattattataaagaatgtatgtaataaagagaattttaaaaagaaaaacaagcataagatgccaatttcctactgcacaagaaacaactatcttcaacattaggtgagcatcattgtagacatacattttcttttctataagctttttaattttataatagtattaaatatacagaaaaattacaaaaataatactgagaattcctttatacccctcatcctgtctcctctatgttaatatcttagattatcatggtacgtttatcaaaacaaagaaaccaatattgacacattactagtaatgacactgaacaacttattcaacttatcactattttcctctaagattccagaatcccatgctggataccatattgcatttagtcatcacgtatccttagcctactctggtctgtgacaatttctcagactttcctgatttttttttttaatttaaccattttgaggattactgatcaagtattttgtagactgttcttcaattgggattggctgatcttttcctcaagggtagactagggtaatgg

SEQ ID NO: 122637 - DNA, 599 bp, Homo sapiens
aggtgaaaatgacaaatattcaggtggaagtgtccagcattcaagtaggataacttggaacagaaagcccaaattatgtcatggtgaaatgaggataatgtcttattaataaaaacacgtcttactagtctttcctggagaacatgaaagatagaatttcagaaatttagagaatgaaaaaggaaagattacaaggcaataagttgattaaaatagactaaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgac

SEQ ID NO: 122638 - DNA, 463 bp, Homo sapiens
ctcatacctgatttatcaaacctgagagcccacagcatgcctaatttagcacatagttcctgtccccaaaatctaataaactcagaagtaataaattttctgggtttttgtgggtttgccctctgagctagggtagttaaaagttgcatttggcatgttttgtttaccatagcggctacggaaagtgcccttttcctttcttctgtgtcttctcatgggtttatagtaacagggaactgattctaggacatgaatcgttcagcttttggtcgttaacgctagatgtttctcatacacgagtccttctcatgcatagttatttgaagttaatatttcgcattggtgaccatgtattcttatgtctgggagcgcagacatcagactgctggactgtgtgtgaaatagcctacttgagatgtcatccctggggactacctaccccactgccaggacaaaagacttt

SEQ ID NO: 122639 - DNA, 159 bp, Homo sapiens
gcacccagcctcccataaggttttgatgaggattaaacgagatgatgtacacccagcagaaacctctactgttaccgtgtcccccttgtgttttagtccttcattttcttcctctgaccctcgaaactgtaaggacaaggagcatgcatgactcagcat

SEQ ID NO: 122640 - DNA, 365 bp, Homo sapiens
tagcctattaatagggtgggttacattgatttttgactgttgaacccactttacattcctggaatgaaactacttggcaatgatgtggaattctttttatatattgtttaattctacttgctaataattcgctgtatatttttgtgtctctgtatatatattgttctgtactttgtactgtctttaggtacagtacctaatattagcttcttaaaatgttaatattagcttctaatattagcttcttaatattagcttctattagcttctaatattagcttcttaatattagcttctaatattagcttcttaatagtagcttcttaaaatgaattgggaagtttttcctcttctagtttccagaa

SEQ ID NO: 122641 - DNA, 392 bp, Homo sapiens
agtcaaataaacagatgcgctgtaaggacacaaaaccacaccatgattattagaagcaagcagcaactgtaacaaactgaaaagtaagtatctccttgtttctaggcagactgcttattgaaccacccaggagcaccactaacacaaggctatatagaaatgaacacacacagatcaatatccacaatatgacacccatgcagaaaaaagtccattctggctaaaagacaacgctaagtggctatctgctcctaacagaacaatattgctctagacatttggcacagagatgataatcaggctaaagatattcaccaagccaagcgattgaaattcacatcttagaaatgccagaatcatccgaagtggaggctcagaaatgttcaaaaccc

SEQ ID NO: 122642 - DNA, 652 bp, Homo sapiens
acacatcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtg

SEQ ID NO: 122643 - DNA, 528 bp, Homo sapiens
gtcctccctggactgcctgtctccagaattcttttatatataagagaaataaccttctgtcttgtttaagccaaacacaattcttgatggatccacgctcaaccttatgaatggctcacggataggttcaccccaacatttgcaggtttcaagctaggagtataggtggaagtccctagcctgtggttcaccccttttccttttccccttttgctctgtcccattaggtggatatctgacctcacactttaaaacttaagtccctgtgctaacactgccccttggccactcttcaggcctaggctctatgtatttcctgttgggagaacagatcccaggaggagactgctataggctctagaagagagctcagagcatttagggaggaatctaggaccctaggaatccagggcctggcccagaagtcaaggaagatttaggcaggtgccatgttcctttggccctgtgatctcctcactttgtggagagaagtgtggccctttaagtcataagacctaggacaggggc

SEQ ID NO: 122644 - DNA, 429 bp, Homo sapiens
gctcagctactttttgtatttttagtagagacggggtttcaccatattggccaggctggtctcgaactcctgacctcatgatcctcccgcctcggctcccaaagtgctgggattacaggcatgagccaccgtgcctggcgacaacttctatttctttacctgtttttttttcatagcacacaccgcttcttgacagaaaattacctatctatttgaaaaattgtattactattgtcttcttcagcagaatgtagttctatgaagactaagtaaggctcgttttttctgtttcccacaccctcagtaacctcagtttcccagcctctggtaaccatctttctacactctatctctatgagtttaattattctaatttttagctcctgtaaataagtgagaacatgcaaagtttgtctttctgggcctggc

SEQ ID NO: 122645 - DNA, 332 bp, Homo sapiens
accaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctgg

SEQ ID NO: 122646 - DNA, 418 bp, Homo sapiens
agagcagactttggcattagatgttggctgcagtctcttcctagtaggtacaggctttgtaggagttcctgaaaggggaacggggactatagccttatcttgaaaatcaaaacaaacaacccaaatgacaacaaactaacatttctagagcacttaatatgtgccaatcactctgcagagtatttctgagagaagtcatttattcttaagtcttgtttccttagcatgatgtatataccctgaggcctacacatggttttttaggatgccaggaatatgtgtggaaggagaagagggggagggagaaaatgaaataaagatggagtctacaattcatgcccatattcttaggtaaggactgcaacccagctgttgtcagtatgagctggtaattgaacttgagtcttaattcttaatt

SEQ ID NO: 122647 - DNA, 523 bp, Homo sapiens
atctttatgcatatcttttcatgtaactgtgaacagttaaacataaaatacattcgtagaagtagaattgctagattaagttatatacactttaatggttgttgttgttgttgttttgagacagggtctcactctgtcgcccaggctggagtgtagtgatatgatcacagctcactgcagcctcaacctcccaggctcaagcgatcctctcacctcagccttccaactacctgggaccccaggcatgcaccaccacacccagctatttttctattttttgtagagacagggtctccctatgttgcccaagctggtctcgaactcctggacttaagccatcctcccacctcggcctcccaaagtgctgggattgcaggtgtgtgccaccgtgcctggccctttaattgtttcatattaaaattttttttatttaaaaaattatttccagagctccttaggtttgaaagtgtggattaaacattaacagactttttttaaacaaactatccaacctcataatcaa

SEQ ID NO: 122648 - DNA, 1674 bp, Homo sapiens
ctactactactaaattcgcggccggtcgacgctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctgga

SEQ ID NO: 122649 - DNA, 1691 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctgga

SEQ ID NO: 122650 - DNA, 524 bp, Homo sapiens
ccacattttcatccatacatccatacatccattcacccacccatccacccattcatcatccatctgtccatccatccatccaatgtgtcttcttgcaggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagcta

SEQ ID NO: 122651 - DNA, 888 bp, Homo sapiens
taaatactaaaacttcagtcctttgcaaaggtaagggcagccatcacagggcaatagaagattgtggattcttggtccctctctgccttgatcatacttagtgaccttggggaagtgcctcacccttttctaggcctcagtaaacccctggcagtggggcttcccctctgtgacattcagtggctccaaccttttgggtttgttgatctttattgagttcagggaaataaaggcctatatttcacatgtagcaaagttggcccaattcaggcaccagtggatggcttggtccttctggtatgaatccatcattggagttctgcccagttctttaatttaagtcttaaaaaagacaagagaaatggttgagaaagactgagcgcatactgttaaatgagaactgtatcaagtttaataaggatacgcttaaacataattatcttcattgaaccataaataacaggcagtgccattttgatagcagcttcgtattccttctctccaggaactggagaaaacttgaggctaatctagccagagaagcagcatcccgtacagattgttcttgtctaagggaatttctgatgttgcagagggaccataaaggatgccaagtgaaacgtccttgcctatctcctgtatgggctccctgacccaatcatttcccccgcttgaatttgcagggaaaagagcatgacatttggcatcagaaggctggatgtggaatcccatcctctcccaccactgcacactgggcactttcggataagtcagttcttctcccaggctggaactcaatccttgcattcatgttataaagggaaacctacgccctgaaagatggcaaggtcaactgtaagcaaacaaaaatgcaaacatgctgtgttt

SEQ ID NO: 122652 - DNA, 1319 bp, Homo sapiens
ccacattttcatccatacatccatacatccattcacccacccatccacccattcatcatccatctgtccatccatccatccaatgtgtcttcttgcaggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctgga

SEQ ID NO: 122653 - DNA, 896 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccagcta

SEQ ID NO: 122654 - DNA, 868 bp, Homo sapiens
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggaaaagagcatgacatttggcatcagaaggctggatgtggaatcccatcctctcccaccactgcacactgggcactttcggataagtcagttcttctcccaggctggaactcaatccttgcattcatgttataaagggaaacctacgccctgaaagatggcaaggtcaactgtaagcaaacaaaaatgcaaacatgctgtgttt

SEQ ID NO: 122655 - DNA, 147 bp, Homo sapiens
cgctgcggctgctgcgctccctgcccccgcggtgcccccttcccgccgccccgctcctctctcaggcgctcaaagtggcctggaatttgtagaacgcccccctccaagcccgttggcagttgtcctagcccgctggcccttgccccc

SEQ ID NO: 122656 - DNA, 590 bp, Homo sapiens
tatctgggcaggtgtcactgagcatgacagctcacgcccgggactcggggttccgtcagcagagcaagggtcgattcttggagggttgctggaatgtgacacgatgatctcagtttgacagtttggacatttccatggcagcttcagcacagtgccatgccactgagagatccctcctgaagccctagagccgggttctcatccccgcagcacttcagaatcacctgtgggactttacagacctgctgctgcttgagacccagtgaaggagaatcactaggggtggggcccagttgagaagcacagtggtagatcctagctggagaactgaagagaaacagagctgctgagaataagaaataggtgttactcaggattctcctaaatgtcacctcctggtatggaaggcactcaaaaggcaggtcatgaggttaaattgtttatggtttattttgcttaaaaaagtaggagtagatgtaatacattttagtgagacttctataggtaatagttaaataagacttgtgcctttgtgttttactgttatctggcagaatggcctctaaagaatgccttgtttcccagcggca

SEQ ID NO: 122657 - DNA, 313 bp, Homo sapiens
caggtcacaccaccaaaccaggatttactgattaataatggagacaggataatttttggcctcattaggaagaatgaagatgagaaatgtagactatgccttcaggtatgtctgtcctacctcaattttaagtgtacaaggaatcttttagattagggtttcttcatgcctgcctgcctgcctgccaacataataagctgtaaaaccttgtttagttttccttaaatccagaaatgattctataccaaatccatacaaatcgaatcactcttaagggagtaagtgaaaacatgtgtatctgccttggctggac

SEQ ID NO: 122658 - DNA, 1700 bp, Homo sapiens
tctagagtgactttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgttccaaatcagttcctttagagaaacatggtaaatgcacttggaaatttgttttaatcccctgttataaaattagcctgaattctttttgtcttagcacatagagaccctacatctaggaaagtcttattctgggccctattgcactcagatgtggtgtgccttactgatcttgaaacattagttatatctgtgtgccctattttaaatttaaactcctctcctataagatttactacaaatacattttttgaagaccactgtaaaatcacatattctctaatattttaaataaatgaaaggctgctttatttctcttataaacattggtataagagaaatttggtgtgttcatgaacacgctaaatggcttggaaaatgggtgtggttcaaagcctgatgcttcaagatctctggtttgaatttggtcacaaccaggaagtattgcccctttttctgtctgggtcctccataggaacttttcataccagccataaacaatccagatggctgccacgtggtccttaccagtgagaggcgtcacacagcacacactgcatgaatggggatgaaatcattcctgaattaatatagggttatattacttggacctcagccatttgagcctcagtgtctgcatcatatgtgtttagtatatggacatctaactgaaattattaacgtggcaatttatgcgtgccttttttggaaatattctattttaatggaaagaattatgtagaaatactggatacatttttaaaaacatccataattcaccatcttgacataactagtatattcatttttgtgattagagttcaatgttttatatagatgtagctttagtgtatatattattttgtattctgctcttttcacttaaagtcatatgacctagtacattttactcatttcttggtatgcttttatatcatttctctcttagaaattggatttgtaaaaattaatttagaaaatcataaaatctgttcatattctgtatgaagaataaattaatcttcagatataagcagaaaagtgatgttaaaacaataatttaatcaataataatgttttttgatccaatgttgactgaagtgtttatattttggttgatttctaaaagtagcaaaaagctattctgttatttggagaattttctgctatgtttagaaccaaactatgttatgatttcacactttgaagcttgataggaaatattgttaaggaaataaaaaagaaaaacaagtgatccaaagcaaaggaaatgatagacttttgtgttatgaaaaattaactcactgttcttgttggtactattatgtcaagttagttatctcacatgtgacactcattaaaaggcatttctcttggttaattcttggaaca

SEQ ID NO: 122659 - DNA, 943 bp, Homo sapiens
  misc_feature (826)..(826): n is a, c, g, or t
tctagagtgactttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgttccaaatcagttcctttagagaaacatggtaaatgcacttggaaatttgttttaatcccctgttataaaattagcctgaattctttttgtcttagcacatagagaccctacatctaggaaagtcttattctgggccctattgcactcagatgtggtgtgccttactgatcttgaaacattagttatatctgtgtgccctattttaaatttaaactcctctcctataagatttactacaaatacattttttgaagaccactgtaaaatcacatattctctaatattttaaataaatgaaaggctgctttatttctcttataaacattggtataagagaaatttggtgtgttcatgaacacgctaaatggcttggaaaatgggtgtggttcaaagcctgatgcttcaagatctctggtttgaatttggtcacaaccaggaagtattgcccctttttaaatttaaactcctctcctataagatttactacaaatacattttttgaagaccactgtaaanatcacattattctcctaagtattttaaatacaactggaaaggctgctatattttctcttaataaacattggtataagagaaattgggtgtgttcatgatcagcctagatggtggaaa

SEQ ID NO: 122660 - DNA, 432 bp, Homo sapiens
gcctcccaagtagctgggactacaggtgcccgccatcacgcccggctaatttttttgtatttttagtagagacggggtttcactgtgttagccaggatagtcttgatctcctgatctcgtgatccacctgcctcggcctcccaaagtgctgggattacaggtgtgagccactgcgcccggccaagtcagatttttttattctctctcatgcctgcatctatctgcacatacattcctttaaacaaatggttaaatctctgaatcgtgtaaaagcagaatctattgctagatgatcccataggaaaatgaaaaggtcacttccccatcctcctgagccacaggaaggtacagctgaagcagcacaaaggttctcatgggtcttcataaattcatgatggcacattccctaatagacagtgaaggaggcacggg

SEQ ID NO: 122661 - DNA, 914 bp, Homo sapiens
aatgagtttctgcttctcttctttctccacccaggactcacttggaatgacaaagttagatgtgatctggcaatctaggcaggactttataatcttgctctgaaattgctttagcactgctccacttgcgaatgcacttgtagacagtaggcatggttgcagttggagagaatcccggaagcagcactcactggggtttgctttctcatagaccacctccatgcagatcccatacaccacgtccttgctgcgctgcacagcaagtgagagctccatgtccttctcatgggcctcaatgcacaattttatatgctgtgatctctgggcagcagccatgggatgcaggacctgcagtccacacatgtcacatgaatctccatggagaggcacacagttctccccatctcagcactctctcactgcagcacaggggcacagctgcttcttggtgttccacagcagtttttctctttctctgattcttccttggtcactgagtcagtattaaggtgcttcagtgcaggaaggcacagctgaaaattttcaagagggtggtaaaggtccaaactaataagacagatacatgaactacaagggaactgaaaatctaatatagccaaagtagggttgcccaggaacaaactcaatagcatgcacccagtcctctgaacctgctcctacaattgcaaagtttgaatttcttgactcagcttcacctgtattcatttcaacaagtggtccgactaacgacaagagacttgaggaagcagcaagggatgatattgtagttagctctgtagcagctgcttcttcctgtttcaatggcttgctatgttcatatctgcagcggtctccataaatacagtaccctcactgaaaatacttgcacactacaccacacggactgtcagaga

SEQ ID NO: 122662 - DNA, 901 bp, Homo sapiens
tcggtccccagcagttatacagactcacttggaatgacaaagttagatgtgatctggcaatctaggcaggactttataatcttgctctgaaattgctttagcactgctccacttgcgaatgcacttgtagacagtaggcatggttgcagttggagagaatcccggaagcagcactcactggggtttgctttctcatagaccacctccatgcagatcccatacaccacgtccttgctgcgctgcacagcaagtgagagctccatgtccttctcatgggcctcaatgcacaattttatatgctgtgatctctgggcagcagccatgggatgcaggacctgcagtccacacatgtcacatgaatctccatggagaggcacacagttctccccatctcagcactctctcactgcagcacaggggcacagctgcttcttggtgttccacagcagtttttctctttctctgattcttccttggtcactgagtcagtattaaggtgcttcagtgcaggaaggcacagctgaaaattttcaagagggtggtaaaggtccaaactaataagacagatacatgaactacaagggaactgaaaatctaatatagccaaagtagggttgcccaggaacaaactcaatagcatgcacccagtcctctgaacctgctcctacaattgcaaagtttgaatttcttgactcagcttcacctgtattcatttcaacaagtggtccgactaacgacaagagacttgaggaagcagcaagggatgatattgtagttagctctgtagcagctgcttcttcctgtttcaatggcttgctatgttcatatctgcagcggtctccataaatacagtaccctcactgaaaatacttgcacactacaccacacggactgtcagaga

SEQ ID NO: 122663 - DNA, 231 bp, Homo sapiens
ataggtgtgagaaattttatcatttagctacatgcttgttgacgtacaaggtgtggtcattacaccccagtgttcccctgtgtggctgcagccaggtaaaggggctgctgcgctcctctcgcccagcccagagggtcagccccagaggaagcactggtgacctttgttgccatagattgctttccagttcggatttttttaaaaaacagcaggacttgacgggggcatgag

SEQ ID NO: 122664 - DNA, 125 bp, Homo sapiens
ttcccatcagcaatatcggaagggtccactttctcctcacctcactaacacgttattatctatctcttttaagttacagctgtcccagtgtgcaggaactggtatcccattatagtttcactttg

SEQ ID NO: 122665 - DNA, 585 bp, Homo sapiens
cagttttctcagctgtaacgtgggtatatagcagtatctgtttcataggcttgttctgaggagttaatgagttaacatatataaagcctctagaacactgcctggctcatggtaaaactaggtcagtgtgagctattatgcattaaatcctggctctggcacttccttttttagtgaccttaagaaggttcttttacctgtttcctcaaatggtaaaatgcagaggttgaatttgactacctagaccaagtcaggaccagttcttaaattctattattgtacaagtataaaagcagaggacaaaagccatactacatgaacaaaacaatatcatttgctaaatgattgtctgaggtcattctttagtttctcttggaactcacacatggacctcaaggttagaaatcaatgtctaggccgggcgcggtggcccacgcctgtaatcccagcactttaggaggctgaggcaggtggatcacaaggtcaggagctcgagaccagcctggccaaggtggtgaaaccccgtctctactaaaaatataaaaattagctgggtgtgatggtgggcacctgtaatcctaaata

SEQ ID NO: 122666 - DNA, 405 bp, Homo sapiens
ggtatggcttatcacacacctaggccatatggtatagcccattgctcctaggctagaaacctgtacagcatgttactgtactgaatactgtagataattggaacataacggtaagtatttgtgtatgtaaacatgcacaaggtactgtagaaatatagtagtataatcttgtggaaccaccaccatatattctgtccatcattttccaaaatggttttaccaggtgtgtgactatatattagtcaaaatctttctgttcattttctcctctgatctgtttttttttctttttttttgtacttactgtcttccattctataagtaattctttgtcattttaatcccacccctactctaattttcactccagttatcagcaaaattggccattgtttaaatctgcca

SEQ ID NO: 122667 - DNA, 295 bp, Homo sapiens
tggcagatgtatcttcagaaaatggcaggacgatcattctggcttcacgcattcctcccatcaaagggaggagtctattatctttctcttcaacccggaggaaactttctggctgccttgttgaagataactgcagaaatgacacaatgtgacttccagggctaggtcatcaaaagtgataggtttccaccaggctctctttctcagaacttgcccttggaacccagccaccatgttgtgaggaagcccagagcacatgcaggggttctggctgaaagccagtctcaaccaccag

SEQ ID NO: 122668 - DNA, 325 bp, Homo sapiens
ctaagacttgtacctgtgtgttttggtagacacaggtgctggcttgacactgtgctgtgcctttcgcctttgattggcagctgcttacacacccacatcacatcgctgtaccacatgcggggcctgatgtttttctccaacaagtaccaccatacaagtctatattcccggctgtggcaaagcacattttacaccttgatcagtgtttgacaccaatgtgaagggctcgcggtggtgctgctctcaactgcacactgttgaaaaacgcaagcggatctgtcttcaaaatttggggggactgcttcagtttctgtcgacgcggccg

SEQ ID NO: 122669 - DNA, 142 bp, Homo sapiens
ccctgattcacaaggggaggggggatgggtgcagaagtcttccccagtgaggggatggagtccacctgaattttctttgtaatgattatggagattaacctgcaaaataacaattcacagtgggtgttggcatggggcttca

SEQ ID NO: 122670 - DNA, 278 bp, Homo sapiens
acagtggtctctgctgtgggtgggcttcagagaaagcctctgggtttctagggagaatgggctcccagaggtcaagctttccaacaccatcttccaaagggaagggctgccctgtctgaagagtcccgcccacgtgcaggatgagacgtggaaaatattgttgctttaacttaaaaaacaagaccagtggggttggctgggagcaccggccagcaggccctgctgagcataaaccccctccactggagaaggcgtggcccctgcccacctggaccctt

SEQ ID NO: 122671 - DNA, 316 bp, Homo sapiens
tgatactctttattattttatttctcctgagaaatgccttcaattgaatataatgtaaacgaaagtcccctcccttttagggaagtgttctcgaatacggacatttaatttcataaaaatgcactagctgtaaaacccagccttttaaaaatagtgggaaaataataaatataacagatgatgccagaaaggaaaggcatttatcttgtgatctctaatgactgaactgaaaactgatcagagaagttgttcagatcctttgcctctgctcactccaaataaggggtttaatggtagcagaacagagggctggaat

SEQ ID NO: 122672 - DNA, 300 bp, Homo sapiens
cccaagcatcacagacagaagtttccaatgaggaatttctcaattctcttcattgtttcaattttcccctctggccctcacacactatcccaagacttcgggccatccgctaagaatcctggaaatgtattcacttatcagattcttaggaaatagtccaaagtctgagccttctactatgctgtgagctccttctctactaaaaatacaaaaaattagttgggcaaggtggcgcacgcctgtaatcccagctactcaggaggctgaggcaggagaatcacttgaacccgggaggcagag

SEQ ID NO: 122673 - DNA, 234 bp, Homo sapiens
cttgtttgctgtggaagtacttagaacacggagtcctgatgttctataaatcacagataggctaagggaggagctactctttaagaagctatcctgtagctctgacaagggctagggttgtggtaatggtactggctcatccctggctacttctaggcttattttgacatggcaattttaaccacacactacactggccacatcagaggaaaacattctggccagcattctcta

SEQ ID NO: 122674 - DNA, 386 bp, Homo sapiens
aacccccttttattgacatacctacctattcattatcagtatgaattcactaacttctatttttttcccagtggtttatcattcatcactattcttattctggggctcaaaatatgccagatgtggccacaatgatgtccctgaactggttcttgtgtcctcttttttttcctgagacagtctccccttgttgccagtgcagtggcatgatctcagctcactgcaacctctgcctcccgggttcaagtgatgcttgtgcctcagccttctgagtagctgggattacaggtgtgcaccaacaagccaggctaatttttgtatttttagtagaggcagggtttcaccatattgaccaggctggtctcgaactcctggcctcaagtgat

SEQ ID NO: 122675 - DNA, 276 bp, Homo sapiens
atcatggctcactgcagcctcaaaattctgggttcaagggatcctcccacctcagcctcccgagtaactgggactacaggtgtgcaccaccatccaacccaagctcttaaccactgcctgatacttcaagtctccccctcacccagaatgacagctctctgaaactcactgcaaagataaaatgagctggtgagaacagtcaacccagcagcacttactgggcaccaggctcactggtgcccaaacatggtcatgacgactgttctcatcactgcc

SEQ ID NO: 122676 - DNA, 670 bp, Homo sapiens
taatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatacttgtatttcctatgtcagatggaatcttgctctgttgcccagccttgaaccgcatctacgcacctcttgcttacatattccgacccatccttacagcgccagctccccatcagccttaactccatcatctccaccccctggagccactatcatacgtccgtcaccggctcacacatcctaatcccgctcctccctctctcacctctttcttcacctgcctcctctactatatctctacttctgctccttctcctccctcccacttattcactgcttccattctttctcctttctcctattccctcctctactcctcccctctttacatcgctacccctttctcc

SEQ ID NO: 122677 - DNA, 433 bp, Homo sapiens
taatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatacttgtatttcctatgtcagatggaatcttgctctgttgcccaggctggagtgcagtgacgccatcttgattcactgcaacctccgcctcccaggttcaagcagttctg

SEQ ID NO: 122678 - DNA, 841 bp, Homo sapiens
atcctggcacctgtgcgccgagccactgcaccgaggaggaccctactccgggtgaacaccgggcttgaagccacggacacccagccccagtgcagcgggttctcgccggcgggacctgcagccgcccactcgggccaccgccaccgcctcctgcagttgcggagcgctcagcccctccgagacgcccgctgcgccctggcccctggggatcctcgccctgcacaggcgcggcaacgggcaggggttgttacggagttgggtgcaggattcgcctttcctgcttgtctcttctccgcccaggatttattgtctgtggagccttctgggggcggggagggagctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaaccttaataacggggaaagggatcccccggaataccagaaaaagttccttgttacagagggtccgtgccagcacttccggaagaaggctgaagagcattgccctggggatgaacccc

SEQ ID NO: 122679 - DNA, 635 bp, Homo sapiens
gatacacgtctgtggtcccagctactcaggagcctgaggcaggaggatcacttgagcccgggaggctccaattgcagtggtgaatcttggctgtcttgcaaggatctgagattgtgccactgcactccagcctaggtaacagagtaagactctgtctcaaatgagtgaatgaatgaatgatccaggaagaaaaaggaacattttatttgccagctctggaacttgtaacattgaattaggtagctattcaccattttaaatttacatttttattattctaaatatctttaacaaggacttttaacataggggtctttttaaataagtgttttgctaggcacagtggctcacagttgaggagccacttggtaggctgaaggagggtggatcgcttgagcccgggagttccagaccagtctaggcaacatggtgaaaccccatcgctacaaaaaatgcaaaaattagcctggcatggtgacgcatgcctgtaatctcagcttcttggggatgctggggcaggatgcttgagcccaggaggtcgaggctgcagtgagccaagattgcaccactgcagtccagcttgggtgacagagtgagaccctgtctcaacaacaacaaaaataagtaaaataata

SEQ ID NO: 122680 - DNA, 417 bp, Homo sapiens
  misc_feature (117)..(117): n is a, c, g, or t
  misc_feature (158)..(158): n is a, c, g, or t
atgggggtgcaggagctttctttatgcaaaggtggaggctcaggcaagagggtggagaggaagaccggacttcactagactgactacagatgcagtccatctgttgggtgcagccanatgtgcaaccttggctatgccacacagaaagagggtctccnctctcaaccatccatgggagcagagtagccaacaggaaggtggggtagggacaggaagagaaaggactgagagctggtccacgctgctatgtttaggcagggctcagaagtaatactaatgatgaggtgttttgaggcatggaccacagggacattcagtgtaggatgaacctgcctgaaggaagccaactctgcaacaaagatggacacagactagcctgcccttcccactggcagtggcgacagatcccacatgcag

SEQ ID NO: 122681 - DNA, 179 bp, Homo sapiens
ttgttttactcaacagaaggccaacaagacaaagagctggctgagaggccgctcagcggtgcagctgcatgaatacaggtgttttctgtctttgaacccttccagcgtggcgtaccttgggcacactgaatctgctattgggtacaacttcaaaaccaaagccagggacagtgtgcatg

SEQ ID NO: 122682 - DNA, 139 bp, Homo sapiens
tcagtggtttcagacatccaccggggatcttggaacatatctcccaagaataagagggaactactgtagtctgttttcctacagtggtgccattcctgatattttcatatttttaaaaatttgctgatatttttattta

SEQ ID NO: 122683 - DNA, 652 bp, Homo sapiens
tgtggtggctcacgcctataatcccagcactttgggaggccgaggcgggtggatcacctgaggtcaggagttcaagaccagcctgaccaatatggtgaaaccccgcctgtaataaaaatacaaaaattagccaggcgtggtggccgggcgcctgtagtcccagctactcaggaggctgagacaggagaattgcttgagcctgggaggcggaagttgcagagagctgagattgcgccactgcactccagcctgggcaacagagtgaggctttgcttcgaaacaaaacaaaaaaatctgtaaaatgaggcaattacttcatgttacttctaagtctttttccagctgacattatttgattctcatctgaatactgtctgagagagtacagtgatgcagatacacacaaatcagatatgcatctgaactggccaaaggctttcccagtggcttcacatgccatgaaaagtcctagtgggtttccccaatctgtgtgagagctggatcagctcctggagataccagaatggttagggttgcctaagaccaccagaaacagtttagcttttaacactgtgcctcccctttctggctaatctttctagaatggaacaaactgatttttacaaaagtaatcaacttaagatcaacccac

SEQ ID NO: 122684 - DNA, 375 bp, Homo sapiens
tgtctaggtcattgccatcctaaccaggtagagagttgaaggcagaactcgttttatttggccagtattatgtttaataaaatgaacatttatgccttcaggcagtaaacacacagtctagttcacagcagttcctgttcttcattttatcttgttcttggcaccttaaattttgtttaacccctgtatccaaactcctgcagccatttgaatttgccatccctgatttagaacttcagcagaactgcttccctttattctcttcttccccctatcaatcaacgtttctgatgagtgagtgtgtagctaattcgaataagctagggtgggagatgaattctaggttgttgtgcaaagcccatctattcaatcatt

SEQ ID NO: 122685 - DNA, 1185 bp, Homo sapiens
gaattcaaaagatgcctatggttggttacacagcttttgatttgcataggtattcgaacccaggttttgctgacttcaatgctttaccttaaaagatgcttttttagaatggtagatgttaatagatggtctgtgtaattagtttcctgggcctcctgcaacaacatagaaaaaaatgggtaacgtaacatttattctctcacaattccagaggccagaagtccaaaatcaaggtgtcagcagggcgatgctctctgaaggctctagaggagaatccttccttacctcttccaaacttgtggcagttctcagcagtccttggtgttcttggcttgtagatgcatcactccaatatctgcctccatcaccccccagctgtctttcctcatatgtttttgcatcatcttacctctgcgtctgtgttcaagttttcttctgcttatgaggacatcggttatatttgtttaggagcctaccctattccagtgtgatctcatcttagttacatctaccatgaccttatttccaaataaggttacattttcagacatggtagttaagactttaacgtatatttttggggttgagaggacacaattcagttggtaacagctatgacaaaattgggtaaattgatgaacatcttaaaaaaaacacagtggaagaggcaggcactgtagagtgacaaaatacatctttatagaaattccatgttaaaattattttgtgttataataatcaaatttaaatacctaatacatatattaccattaaacaggatagtcagcactacctagttttttagctgaatttgtaatgtccatatgtttatgtttctttagtaatacttgaactaaaggaatttgcaaagaaaacccaataatattagtattacatcaaaaagttactgtgtatttttcttccatcaagaaataatgctgacttttaaaggtggaggagtttttagacttcagtaaacataggtaccctgaaaatgtgcactgttgtatcttttcacttttgtatgtcagtgctttgaaaaaatggacaatgttatcattttgttttgtctgcttattaaaattttctccctagtgtgatgtgactatcattttgccatttcagtgtcatattagaaatggttgttttatttaccaaataaattaaccaattcgttcagtattt

SEQ ID NO: 122686 - DNA, 1238 bp, Homo sapiens
gaattcaaaagatgcctatggttggttacacagcttttgatttgcataggtattcgaacccaggttttgctgacttcaatgctttaccttaaaagatgcttttttagaatggtagatgttaatagatggtctgtgtaattagtttcctgggcctcctgcaacaacatagaaaaaaatgggtaacgtaacatttattctctcacaattccagaggccagaagtccaaaatcaaggtgtcagcagggcgatgctctctgaaggctctagaggagaatccttccttacctcttccaaacttgtggcagttctcagcagtccttggtgttcttggcttgtagatgcatcactccaatatctgcctccatcaccccccagctgtctttcctcatatgtttttgcatcatcttacctctgcgtctgtgttcaagttttcttctgcttatgaggacatcggttatatttgtttaggagcctaccctattccagtgtgatctcatcttagttacatctaccatgaccttatttccaaataaggttacattttcagacatggtagttaagactttaacgtatatttttggggttgagaggacacaattcagttggtaacagctatgacaaaattgggtaaattgatgaacatcttaaaaaaaacacagtggaagaggcaggcactgtagagtgacaaaatacatctttatagaaattccatgttaaaattattttgtgttataataatcaaatttaaatacctaatacatatattaccattaaacaggtagtgctgactatcctgtttaatggtaatatatgtattaggtatttaaatttgatagtcagcactacctagttttttagctgaatttgtaatgtccatatgtttatgtttctttagtaatacttgaactaaaggaatttgcaaagaaaacccaataatattagtattacatcaaaaagttactgtgtatttttcttccatcaagaaataatgctgacttttaaaggtggaggagtttttagacttcagtaaacataggtaccctgaaaatgtgcactgttgtatcttttcacttttgtatgtcagtgctttgaaaaaatggacaatgttatcattttgttttgtctgcttattaaaattttctccctagtgtgatgtgactatcattttgccatttcagtgtcatattagaaatggttgttttatttaccaaataaattaaccaattcgttcagtattt

SEQ ID NO: 122687 - DNA, 385 bp, Homo sapiens
  misc_feature (358)..(358): n is a, c, g, or t
tggggctctttggtccccttcaccccccacaacactcagggttaggacctcccccatgcttgtcagcacacactgaattcctccagtgtctgggacagggtgtagggacaggaaggacacccttccagctcccgtcaccagagctcgggaggcagcggggcaggccttcgctctaggtcagagaggagccctttcttcagggccacgtggccagttacagcttcctgagttcaggaagggaaacgtcagaaggaagcagaaagggacatgggaacttgatggtcagggctttaactgccgtggtgagggatttccattttatcttgcagtcagccgagatcgcgccatggcactccancctggcaacagagcaagactccatctc

SEQ ID NO: 122688 - DNA, 206 bp, Homo sapiens
aaagtgctgggattagaggcgtgagccaccgtgcctggccaaaaaatgtttcctaaataaagttttatcagaagttccaacagtgactgtatggcctgcaaacctaaaatattcgctatccgatcctttaaggaaatgtttgccagcccctgctgtaatgaggaaaggatacagacaggagtcaggcagacctgattgtgtcaggg

SEQ ID NO: 122689 - DNA, 1545 bp, Homo sapiens
atgaaaattattagcatagcatataagataatttataaagaatctagaatctaaaatgtacaggaggatgtggataggttatatgcagatactataccactttgtataagagtctgaagcattcgaggattttgatattcaggggggttctggaacaaatctggatactgagggatggctctacagcctttcagaattaaattttctatgattttaatggttctttcaaagaccatgacagtaatcactgacgcctgttgccttacaaatctgcttgtacaagtaacatttccatgattatatgtacaagtaaaaaatacccactatacaaataacaaatccaagatcagtgaaattgagtacgatgacaattaaaatggtttgcataaatgtcctataacacatggaacacatgattcatcctcttgctaatgttcccagtttggcatcttctaagatcatattatttgagcacaatttttgatgcagaatcatctctctgttcccctactcgcttgtgagagggaacatttcctccttatgtgtcttagaatatttttacctaacatgcttaaacaaaacaaatttcattcttaacatcaggctctgaaagttccttttagttagcatttgctatattgacagctggtttgacaagtacatattttagcataagaaaaaaacagcaggccgggtgcagtggcccttgcttgtaatcccagcactttgggaggccaaggaggcagattgcttgagctcaggagatcaaggccagcctgggcagcatagcaagaccccgtctctaccaaaaaaaaaaagaaaaaaaattacaaaaactagccagatgtggtggcgtgcacctgtagtcccagctcttgggaggctaaggtgggaggatgacttgagcctaggaggcagaggttgcagtgtggttgagattgcactactgctctccagcctgggtgacaaagcgagaccctgtttcaaaaaaattaaaaacagcagatgagtttcttttttaaaactggattcaggatcagtgtaatgttactgatcttcaatagtaaccacaaacttaaaaaatctttacatattgccgtatgtattagatattctgatatttaatagctgagacagtcataccttatagtattattatcccaattttactagtgaggaaacaagcagttaataactgttagagctcagattcacattctgaaagttatagaaattaagaacatagagcctatgttcttaatttcaccaaaatatctcctcccaaattatacataccctttcaaacctaccttcctctcttagtaattaatgataccgtctttcaatttacatgaatcagtatcactattagtaaatgtattttatgccattatataacagactaatttatttattctgtactctactgtgatattttcctctatcttctgcaagattttcatttttaaaaattactgtcttggctgggtgcagtggctcatgcctgtaatcctggcctaggcaacaagagtgaaactccatctc

SEQ ID NO: 122690 - DNA, 541 bp, Homo sapiens
aaagtgtaagcatcgcctgagaatttgttcagaatgcaaattatcaggccctgtataagatctattgaatcagacactctggggagtggagtccagtagtctgcatttaacgagccctgcaggtgaattggatgcatgttaaagtctgagagccactgaattagaacaagggaactgataggaacttacagtataccttgtgagaaatgctaagtttatcagccaaagtattggttacagtaatggagaagcaggcatagacagattcagataagtgtttcagtggccagataagtcagtgtgataggaacatcaaggaataagtcatcatcgcttctgagagagaggtgggggtggtgcttgatagacatataacagtgacctgtggctttgagaatggatcagacagaatgagatgctgggaggagcaagcgaagcatagtccagtaaccagaaccacaaggacgtcagtgtctcctgccctgactccacatcattgctggccatgaaaagtgaaatgttacctaagaaaggtattccc

SEQ ID NO: 122691 - DNA, 662 bp, Homo sapiens
tgcctgctgccatccatgtaagatgtgatttgctgctccttgccttctgccataattgtgaagcctccccagctatgtggaactaaaatgaaacagttggtgatgtttcagagaacccaactcaaactgacttgaacaagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggcccc

SEQ ID NO: 122692 - DNA, 124 bp, Homo sapiens
ctgcctgcctcggcctcccaaagtgctgggattacatgcgtgagccactgcgcccggcctctatgcgttactttggagaagtcacgttcctctttacacacccatgtgtccaaatgtgaagtcc

SEQ ID NO: 122693 - DNA, 330 bp, Homo sapiens
tatcaaggcaacatcccttaaacaagttaacagagatgctctttttcagtgagtcttctggaagaatcgatgccagtctgcccttatgacaaacatatttcttaatgagatctgatttacgaagttttgacaattatgcttttcccctctcttactgccactttaagaaaaatcatgctggtaagctacactacaaaacttctggcctgcagagggctctataataccatattttcctagacaacacttgtaaaaaggaaaaaaaaaaaaaaagatacttgctggaagggggaaggggaagcccagaggctttataatgcttccagcagg

SEQ ID NO: 122694 - DNA, 543 bp, Homo sapiens
gtgccatgtttggtatcagtaggtcagccacgcaagctgcagtttctgggtctagcaggaggggtggtggggtttccaatgcaccagttctgtggtgtgatttgaaaaatgatattatttagattttgctgcataactgatcatcccataactaagtggtaagtcgcaaagactctcttcttgactgaactttagataagctcttctgagttctgtttttgaccatgccccagtgtaggcttataaaaactgcagactctcagcataaatgatttttgtctattttccatactccactcccacactaaaatttttgagcaaaaattaatatagtttctagcagctcaaagctacattcctagaatgaccctagccccttaaactgctcaccttggaaagctcaagactgatccagtccaaaccagtaataaacaggcccctgaaccctcccctcttagagcagttgtagtttaggaagcttgcagttgtaattcctttctcttcccctttgcgatgtagatcttctaccacccaaaattaaca

SEQ ID NO: 122695 - DNA, 482 bp, Homo sapiens
agaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctg

SEQ ID NO: 122696 - DNA, 529 bp, Homo sapiens
agttaatagagatataataaatacaagttttctggaactcttttcttttttttcctatgccatttaataccaactaggtttattacttaaatattatttgaaaagccccagctatgtataaatacaccctaggtgtgcatttataaataagtcaacagaaataaacaaaatgtacatatgtatacatataaattccatatggcatgtggggctatattagtttgaaccatatatgattgccattgtaggtcaaaacagactatatttatagcaaaactgtttagactgtagccatgtggagccaagtttcagaaacctgttgagtttcatatcccgggaagccactttctagtgtatatgggagcaagattgcctaaaatgtgttaacacatgctgctcatggtctagaggatgattctaggtgatacacaggtcaacattttttgtttcagtagccagctatttcacaggtattattgcttacaattggaaaaaatttttttgagttaacattaaagatgttagttga

SEQ ID NO: 122697 - DNA, 861 bp, Homo sapiens
cgcgccaggcagatgagggaagctggagtgaggttcagagcccggagggaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggcacctgg

SEQ ID NO: 122698 - DNA, 1375 bp, Homo sapiens
tccaggctgtacggccggatttatgggatgctggtgcgaatactgcctccttagagctccaggaacccagttcttagctgtgatggatccttgcaatgaaagaattaagaagggcgggtgcggtggttcacgcctgtaattccagcactttggaaggtcgacgtgggaagattgcttaagcccagggctcaaggccagcctgggtaacatgaacaattcttaacgtccaaagataacgtctttccttaacgtcgaaagatgccttgttgtgatattacagcagtcattcctgctcactacgggcaggcagacagtgcagaaaaggtgaagcacaaaaactaaaaaggaaaatctctccttgaaccactgcgaacagatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggcacctgg

SEQ ID NO: 122699 - DNA, 1097 bp, Homo sapiens
tccaggctgtacggccggatttatgggatgctggtgcgaatactgcctccttagagctccaggaacccagttcttagctgtgatggatccttgcaatgaaagaattaagaagggcgggtgcggtggttcacgcctgtaattccagcactttggaaggtcgacgtgggaagattgcttaagcccagggctcaaggccagcctgggtaacatgaacaattcttaacgtccaaagataacgtctttccttaacgtcgaaagatgccttgttgtgatattacagcagtcattcctgctcactacgggcaggcagacagtgcagaaaaggtgaagcacaaaaactaaaaaggaaaatctctccttgaaccactgcgaacagatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcactcctgcctgccagctggcgtcttgtatccaaatcaagatgaggaagagggggcctgtcgtgccttgagaaagctggaacgggaatcaattaaacattgtggtgctggcacctgg

SEQ ID NO: 122700 - DNA, 580 bp, Homo sapiens
tccaggctgtacggccggatttatgggatgctggtgcgaatactgcctccttagagctccaggaacccagttcttagctgtgatggatccttgcaatgaaagaattaagaagggcgggtgcggtggttcacgcctgtaattccagcactttggaaggtcgacgtgggaagattgcttaagcccagggctcaaggccagcctgggtaacatgaacaattcttaacgtccaaagataacgtctttccttaacgtcgaaagatgccttgttgtgatattacagcagtcattcctgctcactacgggcaggcagacagtgcagaaaaggtgaagcacaaaaactaaaaaggaaaatctctccttgaaccactgcgaacaggttggtggttttgcttggaatatttttggagcgtgtgggtagttggttaaacttagaaatatatttttttgtgcgtgggtagttggccaaaccgccgtggggcagaatgcagcaaactccgaggatgatccagggtctgcaggcctggagagcacacacgtgtcggccccacctctgcaaactctgtccctcccctacagcgga

SEQ ID NO: 122701 - DNA, 1077 bp, Homo sapiens
  misc_feature (3)..(3): n is a, c, g, or t
  misc_feature (7)..(9): n is a, c, g, or t
ggnacgnnnggagttgccatggcgtcgctgagcggcctggcgtcggcgctggagtcgtacaggggccgggaccgcctgatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggcacctgg

SEQ ID NO: 122702 - DNA, 846 bp, Homo sapiens
gactgcttctggtttcccacagatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggcacctgg

SEQ ID NO: 122703 - DNA, 877 bp, Homo sapiens
attgatctcagctcaaaataatcctacaccaagaacaattcttaacgtccaaagataacgtctttccttaacgtcgaaagatgccttgttgtgatattacagcagtcattcctgctcactacgggcaggcagacagtgcagaaaaggtgaagcacaaaaactaaaaaggaaaatctctccttgaaccactgcgaacaggctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggcacctgg

SEQ ID NO: 122704 - DNA, 597 bp, Homo sapiens
gcacgagctaacacagagtatatgatcctcagtttcatcatagagcatattcagataccgtggaggcacttttgatggacaaaggctatcagcaatgctatccagtcccattagggaagttaagagtctccccagagtctgttgtcctttctctgagctctgcagaagctgagacctcagaagtttagtaaggcagcccgggcacagtggctcacgcctgtaatcccaacactttgggaggctgaggcaggtggatcacctgaggtcaggagttcgaaaccagcctagcctatgtggtgaaaccccgtctctactaaaagtacaaaaatcagctgggtgtgatggcatgtgcctgcaatcccagctactacggaggatgaggtggaagaattgcctgaacccaggaggtggtggttgcagtgagctgagattgcaccatggcactccagtctgggcgacagaatgagactttgtttcaaaaaaaaaaaaaaaaaaaagtttagtaaggcagacgtaaaaatcaggaactaaatttcggttattgctgagtctgggagataccatggtaccaccaggagggatgctacccttatgaac

SEQ ID NO: 122705 - DNA, 575 bp, Homo sapiens
atgttcacgtagtgccatctagtacaatggaaatggcatgggatttggactgaaccagaattgtcttaaatcctggctttgttagttttaggtatgtcatcttgagcagttcacttcactttttgagccacaatttctcttccttacataaagatatttataaataccccacaggttgttataataaaggttgaaggtgcttggcacataagcaaaaattatgaataaatatgtattaaaatatataataactacaaaataaaataaaaatattgtttttctcaccacatgtcaggatctttacacatataatctaattttatccttacaggattgctagcctggtgtgcaacaatagttgtcatatattgagtgactgtcaattgccaagtccttcacttttctcatgaacatcacatggacacctcatgagccagtcaccaagcactgtgctaatcactagggaaacaggaataaaatatgatcctagtcttctaggatggggtttttcaaactttaattgcaaatgaaacaccgagggatatgttgaaatgaagattctaacccactaggtc

SEQ ID NO: 122706 - DNA, 1049 bp, Homo sapiens
atgttcacgtagtgccatctagtacaatggaaatggcatgggatttggactgaaccagaattgtcttaaatcctggctttgttagttttaggtatgtcatcttgagcagttcacttcactttttgagccacaatttctcttccttacataaagatatttataaataccccacaggttgttataataaaggttgaaggtgcttggcacataagcaaaaattatgaataaatatgtattaaaatatataataactacaaaataaaataaaaatattgtttttctcaaaaaaaaaaaaaaaaaaaaaaaaacaaaaacattgttgtggggcgggcctggcgcccatagagaaaaaggattttctaagaccactttgtgcgttgggggcgcgcgcgggggcgccccaaaagtgggttatcggtggaaccgtgtggacaaagaggggtgctcccaagaagagagaactccgcggccacgggcaatggcggccgtggggtcttcctcacaagataaaaaaaaacggcgccggggggacaccgcaggggggttcttgcaccaacaccccagagagggggggcttgccgggaggagccccactagacgggggagctcttacacaagcggaggaggtccccaagggggagagccgggaatataaaaaattagcctgccgcgggcgctggaggagggaaaagaggaaagcacaggcacgccagagaaaggacacgaaagacgacacgatagcacaagaagacacgaaacaacaagcggacgaaagagagaagaaaaagaagaaacaaccaacaagaaaagcggatagaaaaaagaagaaaaaagcaacagacgaaagacaagaagagaaacagaaaagaagaagacgaaacaagaaagacaaaaacaaaacaaaaggacataggaaaaaaggagagaaaagaacaaaaaacggaaaaaaagaaaaaagaaggagaagaaaagacaaaaggaacacaaaaaaaaagaaagaaggaaaacgcaaacacaaacggcaacaagagagagcaagagaagacaat

SEQ ID NO: 122707 - DNA, 429 bp, Homo sapiens
atacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaa

SEQ ID NO: 122708 - DNA, 765 bp, Homo sapiens
agagatggaatctggccaggttgaccaggttattcttgaactcctggcctcaagcaatcctcctgctttcacctcccagtgtgcttggattacacatatatgattttatttgaaaacaaaatttcactgctaatttttaatgtttaaatcacggagggactagaagagtcataactagaggtaaagagaattggaagaaaagtttttacaatcacattagaagaaataaacacttgaaccagaaaagtggcagtggaaatggaaagtgtatgaatttgatattgttagagtagaatcaacaaaatttgatacttgattatgtatattggagaaggtaaagtcaaatgcaatcataagatttggaactggatcattgggacaatggtattgattttagtaaaaacagaaatgcaagtttggagaagaggagagcaagaggattgacttaactgctggacatgtttcttgcatttgaaaggctattggcacatataggtggagaggtccagcagacatcaagaaattgcagggatggaacttgggtgggaagtctgtgctagaaatatagaattggtggttattcatgtacaggtaatggctgtagccagagaataggtttgattgacaaaggaggagtataaagagaagagacaagaagagtaaaacttaaccaccaaagtttagaaaaaaggaatttggaagagttgcttttgcacttgttattctccctacatatttgtttgcaaattcctagaaagtagtaac

SEQ ID NO: 122709 - DNA, 471 bp, Homo sapiens
atgtctactcctatgggcaagacacagaaagtgggtcaaccaaagtcaatcctaccattatataaggtgaattgctcaaatagaattctcactgacctatcctggaaagttctcagttaagggtcaaaggctgccggtgcccctctctggaagcttctgtcttgtttgaaagcttaaactggccaccagcccaaacctgatttcctatagcagtttttaaacctagcctgcaaaagaatcatctggaatgctcattacaaaatgcaaacagggccgggtgcggtggctcatacatgtaatcccagcactttgggaggccaaggcaggtggatcacatgaagtcaggagttcaagaccagcctggccaacatggtgaaatcccatctctactaaaaatacaaaaattagccaggtgtggtggcgggcacctgtaatcccagctactcaggaggctgaggcaggaggatcact

SEQ ID NO: 122710 - DNA, 468 bp, Homo sapiens
atgtctactcctatgggcaagacacagaaagtgggtcaaccaaagtcaatcctaccattatataaggtgaattgctcaaatagaattctcactgacctatcctggaaagttctcagttaagggtcaaaggctgccggtgcccctctctggaagcttctgtcttgtttgaaagcttaaactggccaccagcccaaacctgatttcctatagcagtttttaaacctagcctgcaaaagaatcatctggaatgctcattacaaaatgcaaacagggccgggtgcggtggctcatacatgtaatcccagcactttgggaggccaaggcaggtggatcacatgaagtcaggagttcaagaccagcctggccaacatggtgaaatcccatctctactaaaaatcagctgggcatggtggcgcatgcctgtaaatcctagctatttgggaggctgagttgggaggatcacttgaa

SEQ ID NO: 122711 - DNA, 326 bp, Homo sapiens
ggctccgacacaggcacaaagagcacagggctgatgccacccggcacccaaacgcagaccagacctgggcccgctgctcccctgctgtgtggccctggggaaatcgttctcctctgagcctatttcctcagtgcatcacagggaaagcaccgcagatgacacctgctctagggttaggtaaagtctctccaaagtcagcagcacagagcagtgtcctcttagagcccccagcccccacggtgggacagaggaaaagcgtgaggacaggctgggcctgctaagaccatctctggtgcagaagctgagccctgcttgtgtccagggct

SEQ ID NO: 122712 - DNA, 569 bp, Homo sapiens
aataacttacgtaacaactacccaggacacaccagtgtttagcaacactatagttgataatttttggattagacattgtttctcaagtggatgactataacctcctcagtccatttttgtactttcatcattaacttttttaaaaagcaaaggtgattgtgttattggactggttaaaatctacctttctttgtctacaaattggagttcagactcgttatcttggcatataaagctctttataatcttgccctgaccttcagctctatgttctgctacttgatctgatacaaaaatacgctgcagcccaccaattgaatttgtatcttcagttccccaggtgtaatgaacatgtcttacacattttacatctccagaatacatcacagtatctactgtcacatacctgataataaaaatgtactgaatatctaaaattgttaagtgcttcttactagaaatcactcataatggctgtttttctaaattaatgggttttacttcaattactgaaatatatgcttttcaatcacttacctttcaagagactcagaaatcaaaatttcaag

SEQ ID NO: 122713 - DNA, 1651 bp, Homo sapiens
tggattgtcacccttctattttccccccctcataattcattttttctctttattgatttcctgttttatctcctaagttttgcttttatcttccttccatgctttctagagattgcttatggctttgcttttgttaccctccttgatcctggggatatccagtaatgtaacaaattactgggagttacttttcatcttttgtccacccaatttaagcagataattatttgagaacattgactgtaaaaatgtatttcaaatttcgtttaggcttttttttatggtagatacatgacttcaaacattttttaaggtattgattcaaatttctctatgtctgctaaatcagatgtattggttgtattattcagttcttctctgtccttgcacatactgtgtttattgaatgcgtccgtcgaagttacggatgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccagggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatatatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaatac

SEQ ID NO: 122714 - DNA, 595 bp, Homo sapiens
atgtctcaagtagactgtgtgcattgaagcatttacttctgattctgggattgtgcaattgatttatatctgatttacaaattaaaggtgcatgattaaactagatgttcattaattttgaaaaattgtgactcacgctaatgatttttaacatattaacagttattatagatttatagtaagtatattgcttttatcttcaaatcatagccatttagctatattccttgcagtacaagtgcggaaaatcagttgcatttgaaactctcttaagtggttggactatgttgagaaatgtatagtagaatatttctgattaacaataattttgggaaacctcataaatctgtatatttgttacatatcagtgtggatgctttgtagatatacatgtaatatctgttgaatttttaattttcatatagggcaagcagtatccatggcatttttgcaatcctatattgatgtggcagttaaactgaaaggtagtgtactgtgctatgcatgcttattattctgattctaagctgtagctatttgtaaaactatgtcatgcaaaaaatatagaaaaccacataaaatttcagttactatg

SEQ ID NO: 122715 - DNA, 4561 bp, Homo sapiens
  misc_feature (913)..(913): n is a, c, g, or t
gccgagtcggtggcggctgcaggctgggagggagaagtgctacgcctttgcaggttggcgaagtggttccaggctacccggctagtctggcacggccccgtcttctgcctcctcctccgtcgcgtggcggcgggaactgttggccgcgcggcctcgggaacggcccaggtccccgcccgcaggtcccgggcagataacatagatcatcagtagaaaacttcttgaagttgttcaagaaaaatttgaaagtagcaaaatagaaaataaagaattaacagcagatacagaggacagcatggaagtgttgtcttaggaaacagaacacagcagtgaaaaaacagacaaaatccgctcagatacaactgcagctgataatgttttccggcttcaatgtctttagagttgggatctcttttgtcataatgtgcattttttacatgccaacagtaaactctttaccagaactgagtcctcagaaatattttagtacattgcaaccaggaaaagcctctttagcttatttttgtcaagctgattccccaagaacatctgtatttcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccgnttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccgaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcagtataaaaaagcaatattgacactggtaaagcagaaatacttggattcatttactccatgctggttaaatctaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcgaaatatagaaattattaatgagatattttacatccttttttgtaccaagtcttctaaatgcagtacatattttatacttactgcatttcttacttccgagtagccatatttcaagtgttccttgccacatgtggcctgtgactactgtattggacagttcagtactagacaaaaactagcataattaacttagttctagccatgatttctatttggattaaaattaaactctaatcacagttaactccacagtgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccagggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatatatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaatac

SEQ ID NO: 122716 - DNA, 4507 bp, Homo sapiens
  misc_feature (859)..(859): n is a, c, g, or t
gccgagtcggtggcggctgcaggctgggagggagaagtgctacgcctttgcaggttggcgaagtggttccaggctacccggctagtctggcacggccccgtcttctgcctcctcctccgtcgcgtggcggcgggaactgttggccgcgcggcctcgggaacggcccaggtccccgcccgcaggtcccgggcagataacatagatcatcagtagaaaacttcttgaagttgttcaagaaaaatttgaaagtagcaaaatagaaaataaagaattaacagcagatacagaggacagcatggaagtgttgtcttaggaaacagaacacagcagtgaaaaaacagacaaaatccgctcagatacaactgcagctgataatgttttccggcttcaatgtctttagagttgggatctcttttgtcataatgtgcattttttacatgccaacagtaaactctttaccagaactgagtcctcagaaatattttagtacattgcaaccaggtcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccgnttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccgaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcagtataaaaaagcaatattgacactggtaaagcagaaatacttggattcatttactccatgctggttaaatctaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcgaaatatagaaattattaatgagatattttacatccttttttgtaccaagtcttctaaatgcagtacatattttatacttactgcatttcttacttccgagtagccatatttcaagtgttccttgccacatgtggcctgtgactactgtattggacagttcagtactagacaaaaactagcataattaacttagttctagccatgatttctatttggattaaaattaaactctaatcacagttaactccacagtgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccagggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatatatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaatac

SEQ ID NO: 122717 - DNA, 312 bp, Homo sapiens
attattggtattgcttggaatggagtggagaccgatgagaggagaattaaagaataattcctcagattctaccttggatggagccagcaactaggatagcaagcagaagatgagaagctagggggtatgtgtgcatgcacgcaggtgtgtgtatgtgcatgtgtgtagctagggtgtgaagctggggtgtgtatgtgtgtgtagctagggtgtgtgtgtgcacgcatgcatgtgtagctaggggaggtgtgtatgaagctagagtgtgtgtgtgcgcatgtgcgcgtgtagctagggtgtgtgtgtgaagcg

SEQ ID NO: 122718 - DNA, 159 bp, Homo sapiens
agtggccgtgcttcacctaattctagagatgatctgatgtctttttcattgatatgaaaatatgcagacatttgtgagggggcggaaagggtgcagattctttacactgtaaagaaagtatctatttgtgctgaaaggctcttttaactgtaatcccat

SEQ ID NO: 122719 - DNA, 544 bp, Homo sapiens
taagtcacaactgtcagtacacggaaagtcaattacctaaagcccattagttatcacagcaggtcacaggtaggtggccaaattttgattgatgcactaaatttattttcattttaatacaggatatgtagagcaaaaccattacccagagtcttgctgagcaagtagagaatgtgtaagtgaaagcaaagatgtgcggtattaacaccacaccaaagtgcacagatttactgaaatctggggaaaattttctcccctgaattcaaaatacagcacgtttgaagaagtatacaattctatataaatgcaatatattcctgaaggacaaccaaatgataagaagctaacaatgaataatttaagaatgccaccaagcttctagcaatgagaagtaacttccaaaagtgggaggctgagaagcaactcctaggtagatttaatcctatgtgacagctacctaattatgtacctaccaactgtgaatgacacgtagccagttctcaatacatatttgtggagttaatggatcttgttgaatgcctac

SEQ ID NO: 122720 - DNA, 420 bp, Homo sapiens
ctgccttggcctctcaaagtgctgggattacaggcgtgacatacctggccgacatatcttcaacattccaaaaagttcagtggaaaatatcaattttcttgcttatagtctggccgttcaggcaaagtaaaataccacatttctttgcttctgcttagaattgtatcagctgaggtcacaatgattatctctttctgatcagaagttccttcctgattgccttggtggacttgcaaaggttacatatgagtcagtgatgatgatggcaatgaaggtgacaatgaaggcagcgatgatgacgacagagacattgagtactatgagaaagttattgaagactttgacaaggatcagggtgactacgaggacgtgatagagatcatctcagacgaatcagttgaggaagaggacctcgggtac

SEQ ID NO: 122721 - DNA, 357 bp, Homo sapiens
tgtgacgcaggagagatatatctactgaaaaagggagattgaaccttgtgcttagattaagaacctgagtgttctaaccagaagagaaccagagttttgagtccctagcgatcaattgtatatcagcttaattcatccaacaaacaattactggtatagatactactggtatagacactaaaattagggactggagatgttataagtataatggtccccatcagagtctaggggcaagagaggagagtatgtgaaaaataattactaaataaaagaatgttaacacagtgtgaccttttcatttacgtgtatatcttaggccttctacccaccctccagctggagagaagaatgctg

SEQ ID NO: 122722 - DNA, 3125 bp, Homo sapiens
gttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaggccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggattacaggcctgagccaccacgcccagcctattttgtgtttttttaaagctaactaccattaagatcattatagaagtttggtataatgaagatttgggtttttcagtccaatgagtttccatattcttgaatgaaaaagatccacatttcatcatttgcctgtttcattttcttttagtacttttgaacttagtttggtcagaaaatactagaattttagtttgatctaaagaaccagcttatataacttgctgttgccatgtacatttgtatgtctttgctgtgtcaaataactggatctgattttagctctttttaagtggtgaaagcaatgcatttttattcttcaaattcagacattgaatgtgtattaaaatgtgtgtgcttacctttaatcctctccccaccgacaattaggaacacgtttctccaattactgttggcaagactaccaagaaaaattgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacgccattgcactccagcctgggcaacagagcaagactctgtctcaatcaatctatccatcaatcgataagaaccccagattgtatagctacatgttttagcccccttttcaaagtatatgttctccttggtacttattttgacattctgacttttctacatatgctttatcaacctcttaattaaaccatcattgtctattttgagagataactgcgctgcttcccgttgtgtgttttaaatgttattgttcagtttgagtcaaataaaaggatatttaatctgtggtgccttgacatt

SEQ ID NO: 122723 - DNA, 2382 bp, Homo sapiens
gttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaggccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggtgcagtggctcatgcctttaatcccagcactttgggaggccgaggagggggttcacctgaggtcaggagtttgagagcacgcctggccggcatggtgaaacctcgtctctactaaaaatacaaaagattagctgggcatggtggtgtgtgcctgtggtcttagctactcaggaggctgaggcaggagaatcgcttgaacccaggaggcagaggttgcagtgagccgagattgtgccattgcactgcagcctgggcaacaagagtgagactcaatct

SEQ ID NO: 122724 - DNA, 177 bp, Homo sapiens
gtcataggcaatgaatgctatgattttacaaatgttgtataagtttaaaatctcagtttttctttattatgataagttgttcattcacctgatattcagtcaatttctaccatgtgtcaagaaatgtgtgagcagtagggatggagtaggacataatcctatccttaatgcttgtgc

SEQ ID NO: 122725 - DNA, 532 bp, Homo sapiens
ctttccaccatgattgtgaggcctccccagccatgtggaactgtaagtccaataaacttctttattttgtaaattgtcccgtctcaggtatatctttatcagcagtgtgaaaacagactaatacactcagtttctcaaggctgacttcaggacctggtatatgcacattttggtatttcacgagagtggtagaaccaatgctgggagtatatcctaggagaaccgtactttttttgtgggcaagactgaaaactgtcagttcaaaggagaattataaacatccagcagaattcaaaattcaacacaaccatttgaacaggacaggatatatttcctttataagttatctgccacattaccaatttacaaatacaattattcaatgattacaaattgttcccttattaggaaaaaaattatcttctctctgtatcagtaggccattgttgatccgtagactgctatggggatcaatcaaatcttatttttctaaaatgttaactgtgttggggtgggtgcagagcggggggat

SEQ ID NO: 122726 - DNA, 225 bp, Homo sapiens
ataagctccatgaaagcaaggatttttgttggttttgttttctgtagatttcaagcacctagtagaacagtgcctggcatttagtaggaacccgagtatttgaatgaactattttattaattgtagtctatacttggaaaaggtttaatttttttaaagttttaatttcagtttttctttggaatattatgcgccttgaagtcgtctttttgctgtatttctgtt

SEQ ID NO: 122727 - DNA, 283 bp, Homo sapiens
gggggcccgtctcatgatggggaaagacaggcgcccctgtgtgtgttcaccacagcagatccacagctaacaagcagctgctggtgaaataaagttgccttgaactaagagggcttcatctggtgtttggtttggcttgaaaacactctgtcgaaatgttctagaggtggagctggttttaaaatcaatattatttcatctgtcatcaaacagagcctctaaaccctcaaatgggtgggttcaaaagccacagtgaacccgagtgtgcccctccatcactgag

SEQ ID NO: 122728 - DNA, 430 bp, Homo sapiens
taaaccacaaggcttagaaaacgaccaaattgtgaaaacctaagattctcattataatcgtaacttgactatattacacatttttcatataacaaaacagccctggaaagtttatccagatattgagagagattatacatgtacaatttggatgagttaacattacaatgaaagcctttgcttttgcatttcctggcttttgtgtgccattattattattatttacgactcgaatgttgacagccaattcagcattgcataagccatagagtaaacaggtttctgccttggggctttctgaatgaattagacaggcaaaatatttcatattaaatatcttacttctgaggatagctcactctcagaggtgcaagttgctttgtctttaagacacttgtccttttctttatcctttttaatcttttgcctt

SEQ ID NO: 122729 - DNA, 1129 bp, Homo sapiens
cagttcaggagtgtcatgggagaaactgcattctagcagttgggtggttgggcccccaagtttaaatcccaacagatgggcctgggggtgaggcctctccagcccatcagagtcacagaggtgtcagagtgacctcaccctcaacccagtatggtgggaaggtttggtcatggaaagaaaccgggtctgtttttgtctgcatgtccccaggtttatgttggacgaaagaagttgaggttggctggcccagctgcattgaaaagcttgaaaactggccttttcatttctgtgtggccgtgtcgttcaggtccttccctcccgtcggagctgtccttctgcattagggctggggctgggcaaggggatgagatcatatgtttttgtgttacagaggtaggtttacacagcctcgtcgctatggcagttttaataaagcaggttactgtccccaaggggaggcttagcacatagcactgcccatgcacagatgctgctgtcattccggggcactgttgtcctttactcgtggattgacacagcgctcctccgccagctgatttgggaagggtgagtgctggccaagagcacctcacagctcgcttcctctggaatgaggaggaaggagatctaagcatttcgagaccctggatctgagcccattaaaaacaagaaatggttctggaggctgttcactgtttgccaaggcagcactgggggctgcggagtgcaggtgatttcatcaggtgacggcctgccctgcgttcccttccaggagaagggtctgaccagttaggtgggtggccagcttttgtcctttctgcagggtctggagaccgagagaggctgagctctcactaccagctgcttcgtcctttctccttcgtgtttgggactagggagcaaaggatcgattccacttggggtgccctggactcgtgcatttaagaaatatttatgagcacccactgcgtgccaggcactgttctaggctgagctgtggagccatcaaaagtcacagggaacagcaaacgggatcagtagataaaaacataaaagtatatcatgtgttagatgatgagtgcagggttgaaaatgtcaggcaaggaagggagtagaaaatattgggggc

SEQ ID NO: 122730 - DNA, 214 bp, Homo sapiens
ctgggattacaggcatgtactgccacgcccggctaattttgtatttttagtagagacagggtttctccatattggtcaggctggtcttgaactcctgacctcaggtgatccacctgcttcgccctccaaaattgctgggattacaggcatgagccaccatgcctggccagttcttgttctttttctaagggataattcccttatttagcagaat

SEQ ID NO: 122731 - DNA, 752 bp, Homo sapiens
tgctgagtgttctcggttaatccagtccaaattattaagccttcataatcctccaagacacgtaatcagataagactgcaactgatttgaagaaatccttaattgcagaaatcatcaagccttgctcttctgctgggcgagatgaaagcgttcatcttctccggagaacacacgaagtcctcaccttgcaagcagagaccaggccctccccagacactgagcttggtggcacttggattttggacttccagcctccaaaattgtgagaaaaagtgctgaatatcacagaacacaaagaaaagagaaagagaaactgacagagcctataaatgttgcacgaaggttcagatacatacagttctgctggctttttaaggagcagtgtttcctatatcctaaggcagatggacatgttgggatggagggacatggatggagctggaagccattatcctcggaaaattaacacaggaacagaaaaccaaacactgcatgtttgtgggagctgaacaatgagaacacatggacccagggaggggaacaacacacactggagcctgttggcggtagtgggggtatgagggaaggaagagcatcagaaaaaaataactaatgtatactgggcttaatacctaggtgattggttgataggtgcagcaaaccaccatggcacacatttacctatgtaacaagcctgttgcacatgtatcccggaatgtaaaataaaataaaataaaataaatagtacccca

SEQ ID NO: 122732 - DNA, 100 bp, Homo sapiens
gtcaggtctgtggcttaatggagagttgctcatataaagggaggtttagcaagactccgcctcacaaaaaaaaaggcggggggaatagtaagtaaattgt

SEQ ID NO: 122733 - DNA, 147 bp, Homo sapiens
ctagtcctctgtgtacacttaaatgaaggtggtctaactttgacacttaaaaaaatttgctctacattttctgagtaattgttcctgcacactcaattcttatttacatgtgaatgactttaagatctacatctctaggcctgatct

SEQ ID NO: 122734 - DNA, 760 bp, Homo sapiens
actggcaagcaaaggcagagccacagaggggctgctggtccccaaatgtctctccagctgctctggagctgctggggctacagagctggtgaaggctgagatcatgagataaaccccagggctccctgggagatcctggtttgtactgctgtgtggtcttaattattaagaaacaaggcactttatgaagaggaaaagagctgaacaaaaggtgttctcttcaggaggtccatgtagaaggcaggcagaacactgggctaaagacacagacccaggaagccctcaagttgccacagaccttaaatattacaatccccctgcttgtcaatcattaatacaaatctgagcaggtcttccctgcaggacacaggcggctttctggaaaaagcatggaaaagtgagtctcctaaatgttctcaagtgactgattcaggacacatcttaaaaggatcaaagaaggatggagaaaaacttcagaaggaaataacagtttgaatgaaaacactcatttagcagaaagtccagaagtgctcgaccaagaaattgcaagatggaagcagacagtacaggaaaggaaggagagaaagaaaagctggaaacctttgaatgcacaaataaaacaggtcatgaaagataccatgagccaattaaaatctatggctgaaaacctgctggacaccatgcagttgggagatttctctagggaccacagtgacgaggactcgaaagtacagctaaagaggaaagcagaaaatgaaga

SEQ ID NO: 122735 - DNA, 429 bp, Homo sapiens
ttgatctaacctctccatgcctcctttcccagtatcatctacacatcatccaaaaaggatgaggctggactctttcctacagtaatcaaggtcttccataatctggcatgtgccatctccatgatcatcttctttgattcctgatcgtattctttgctccagtgaagctcttcaagctctctgttgtttctcgtgcctcctgcttctgtgcctctgcatatgtgattccctctgtctagactgctctctttattagtgaatactgcctttctttaagacacacttaaaggttttcttccttctaccctgaatttccaccttgagttactcccatgtactgtgctctcagctctcaaagagatcttaaagggcaagatttatgattttgtttccctttaaataacattaatgtcccatgattaaaaaaaa

SEQ ID NO: 122736 - DNA, 450 bp, Homo sapiens
ccgatttcccttagggccgggccgaacaagggaaattggccagtgccttccttgatgggtaggttaattttcttctggagtgaatgaatgttctaaaccgatggtgatggaatacacaactctgtgaataaatatacctacccccttattggtacacacgtgtgtacgagttaagggttgtgagaatgaaattccgaggtatttaaagtgtttagtatagtacctgtgtcatcgtaaacactcagattactgtgtctttaccactctcatccttattaatgtttctcaaatcatttcgaatgctaactttgctaatgtagattggaattgtagaaagagcacttcagtgctcctggtaatcaggagacatgcattccagtctgcatccaccagtaactaacaacacttctatgattgttttactccaaaggtacattttctcatccacaa

SEQ ID NO: 122737 - DNA, 381 bp, Homo sapiens
tagcaataaaatagctctcttatacttagtgcttaattcagtgaggaatactgtcacatccttgacttttagtagatttccctacagcaactttttcttctcatattgtagggagaagaggtcaggaattgctaaaggggcattttagcagtctggagtcctccaggtgatgaaatattggggacattaatgtaacatttgagtatagaatggactagaagcaaagagaccaatcaagtttacgatgtggaggtaatagttgtacataggctaatctaagagagaatactggagcaataagtcaaatcccaactttgtcagctacccaagtgcacttgattcctactgaaactccaggattcaatttattttcctccccta

SEQ ID NO: 122738 - DNA, 387 bp, Homo sapiens
ccttcaaagttttgctgatatttaatatgtcactacactaatacatgtacataatttacaaactgtgcagtcatatgctcaaacattttttacaggtgagcaataaaaagttcagagatctctggtctagagaaatcaaatatatagacactcttacataacataatatggtaagaacaatagagggctctgtaaagagggttccccaggggtaaaaagctaaaatttctgatttgctgactaagcctaaagagataaacaggaattgggcaactggaaacccctgggggaggattctgctcattagagaagatctaatgagcaaagacaaagaagtggggaaaaacagagcatttaagaactgtaagtgggttcaatgttgctgga

SEQ ID NO: 122739 - DNA, 430 bp, Homo sapiens
gcggccctcctcccatgtcacaagttggtcagttacaagctatatgggtcacattctcctccctgagaccctctaagggttggttccctctgaggtcaagctcgatgtcacctcctcagaaaggccacccagggaactttcttcatctgacttccctgtctttgtgcagcacttctcactgaagttatgctgcaggattactggccgctgtgctaacagctggtccccgcgctgtggtgtaaacttcccacaaatgggaactttgtttgggtgccactgtatctccactaacggcatgcagcgggcatgctagatacttactagttgaagaaaatgaatggaaactatagaaagattcagtcagttagtggcaggaaaaaaaagaagacacacagagaagagtgaccaagggagggaccacatgctatca

SEQ ID NO: 122740 - DNA, 303 bp, Homo sapiens
gtggggtggggtagaggccaggacaaatccctctgcagtccaccaggtggcggtgttgcactgcagacccaaaggtccttcctccaaactccagggcgggcgcgcggggggacaggggctcgacaagtcccaagcagcttaggcccagctcctattgccctgccctgttctgtctcttcagtcaagctcacggtgactagcagccccaggtgccaaccctggggcaggggttgccacctgggctaatagggcctttcctccactggtgggctgtggagcccaccccactgcttcatcctgttg

SEQ ID NO: 122741 - DNA, 529 bp, Homo sapiens
atcggtttcaggaaggagttcatatggaaactgaggttctggaaatgtaatctacttttaagaatcaaccacacctgtgcctcctccagaaaatctttgtagtgcatgactcttaccaggcgtatatgtagaggaaaaggtcaaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagatggacagacaggttggcaggtgctcctggagtctcatggagagggggtcacttgctcccaagcagccagttccaaagtgtcttgacggcttcctttctggaagtactcggggctggttagtaattatttcccagcttatgggatttcttagactctccctggctggccttttaaaaatgaatgaccctcctatcctttcaagatg

SEQ ID NO: 122742 - DNA, 520 bp, Homo sapiens
agcttaggtttcctatatggcttttgtgggacaacacctttagaattcttagaaggccttttgtttgaaacaatctatgaggtaccaccttaaatgtctttgacatctgaactaggagtaggcaaaggccatcgaactaagacttgtttttatattttcaaagggttaaaaaaaaaagttcaacagagactgtatatggccctcagcctaaaatatttatctggtcctttgcagaaaatgtttgctgactcttggtctaaataaagttttaatcttcatgccaatttaccctggtctgctttggatttgatctttgcccagaaggcttttttatttttttatttttttgagacaggttcttgctctgtctcaaaggctggagtgcggtggtgtgatcatagctcactgcagccttgaactccttagcttgtgaccctcccacctcagcctcctgagtagccaggactataggcaggcacatgcctggctaatttttaaatttttggtagagacagagtct

SEQ ID NO: 122743 - DNA, 115 bp, Homo sapiens
taagctaggtgggtggctgagtcctaaatgagttgagatggggaagaggaataccgcatggtagaaacctccaaaatcaaaagcaccaagacgggaaatgttacagtgttgggct

SEQ ID NO: 122744 - DNA, 232 bp, Homo sapiens
ctgtgagatgttaataattattaagccaaagcaaacagacaaaggatgtgtggccaaataagtctgacaaaccttgcatcaaacaagttttcagtcttttttcttatagtacttctcagggcttttattatattcttggtctgcattgtggatcttccagagcagcacagtccaacatgtggccacaaataccaggcacgtgtatacttttccaatttatgctaaccatgtt

SEQ ID NO: 122745 - DNA, 743 bp, Homo sapiens
ggtggagggaggtaaaatccccagacctgaggactcgaaggggcagtcaaggagaggatagctcttctccagagcttaaaggcaaatattttctttttccctggtttctcaccttattgctttgtgtactgagtgaacttatttgtttttgagatccagtaacccatgcaagaaatttcataacacttctcatttagtactttaatactagttgaagaatctagggttacacacacacacacacacacacaccaggcttagttccattacctatagctgtaaaaatgagatttttttctcagttttgtgaaaatgaaaggctgctggactggaactcacagtattgtatatcaaaaagtatcagattgtgataaaatagaaacccagaattaaacttggccttatgatttttagaaagtcaacagattttgaaggagcccacccagtgtattcatttcatttttactaatcctttctttcatgctaagatagagatgaaaaagaatgacagacttcctgttctcatttcattacagcaaaataaataagttttagtgttccatagctctgtaggatgactatagttaaaaataacatataatttcaaatagccaggaggacattgactgttcccaacacaaagaaatgataaatgtttgcaatgatggatatgctaattacactgatctgatcactatacattgtacatacataaacatgactatgtacctcatggatatgta

SEQ ID NO: 122746 - DNA, 232 bp, Homo sapiens
ccatgagtctcaactctaccgagggatagtacttaagtttccaaaggaccatatataggtttaggaaacatcgaatattaccattgttttgattggttctagttactttatagtttattttaaaatttcaaataatcgaaacggggtcctccacctttccaatataaacaggtagtatgggttttaaataaaccaaagttgagaaatacagacctaaaactttatatctaca

SEQ ID NO: 122747 - DNA, 161 bp, Homo sapiens
agtattttacttttgcatataaaattttccataataaaaatctaaaaataacaacaaaaaaataaacttgaagtggttcccactggccaaggatgaacaatgtgagcatcaagaagaaaaatgggggccaggcgcggtggctcacacctgtaatcccagca

SEQ ID NO: 122748 - DNA, 307 bp, Homo sapiens
aatgaggtcagggttcatgagaatgaagcactttctttgttaatggaaagttcgcctgaaaattatgaggcaacactgaaatcatatgatgcgctgaaggagctccgaggaccttcttgcactgtagctctgggtatgacaggcacttgccctgtcttgaattgcataagtttcctgtcatgtggttatcacgtccctatggtgactcaaggttttggtgttttctgtctgaaaatgaagaacctggagggaagccagtggggatgaggagggtaagcaaagagcttagatgcccaggaccagatcc

SEQ ID NO: 122749 - DNA, 318 bp, Homo sapiens
gggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaaagaccaga

SEQ ID NO: 122750 - DNA, 719 bp, Homo sapiens
gggaggcacctctgcaagctgatgtggccacaggatctggcatggctgcagaggcaaggccctagtgcccttgcagtgtcccaaggatccagagctatattgcctgaaccagtaaaagaagggaatgtctgctgaaattcagcagggagagaatgcatgttctggaataccacatttaattccaaaatatggtggcttctaatgattctgtgtgtggctgaaacagaagaatcgttttagtttatcctgcccgatattttttattaaccaactaattgttaaaacccactgccaaaggattttaaaacttaaaactatcagaatttgaatgtggagttaatgttttgaaaaagaataatgttttctggcattaatgtttgcagtgtctgccaagagtggacatacttggaatgtgattacattaaccattgtgaatatgctaaagttgtatagtgttcatcattatgcagttaatttttaatggttccccaccatgtcaattttgttttaaatatttggtttatatactttgggtattttggtaattcacattcttgctaacaaaaatgcattgtaaacaagtgtaaacacccacaacaactttcacagtaatccagcaaaatatgcacttgatctcactgtttcctaatacagacaaaatgggattattcttcttctgtttgtcatatattataattacggctgatctttcagattca

SEQ ID NO: 122751 - DNA, 317 bp, Homo sapiens
ctaaggaatgtaacctacttatgacctgggagaagcaactgtcagaattgttgtagaggaaacctcgtcatggggcagatgattcatcgaaatgacttctctggcaccctctaacagcatcactccttaagccaatcatatttttctcagaatgaaggtgcaaaaattaaatcatgcatgcaaagcagttcgtaggtgctccatagtatgtggttagccttataatgcttacttaggatccgatgtaggaagtggtgcagaaggcagaattgtatgccatttagtttttcggttaatgttcaataatatggcagcag

SEQ ID NO: 122752 - DNA, 522 bp, Homo sapiens
ctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccggagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatcc

SEQ ID NO: 122753 - DNA, 413 bp, Homo sapiens
aaaggagatatcaatgagatgactataatcgtagaagatagccccctaaacaaactgaatgctttgaatgggctcctagagggaggcaatggccttagctgcatttcttctgaactaacagatgcttcttatggccccaacctcttggaaggtttaagtaaaatgcggcaggagaacttcctatgtgacttagtcattggtaccaaaaccaaatcctttgatgttcataagtcagtcatggcttcatgcagtgagtatttttacaacatcctaaaaaaagacccgtcaattcagagggtggatctcaatgatatctcaccactaggcctggccactgtcattgcatatgcctacactggaaagctcactctctccttgtatacaataggaagcattatttctgctgctgttta

SEQ ID NO: 122754 - DNA, 613 bp, Homo sapiens
gattaagttcctgaaaaatgataatatggaaacaaccaccatttttcttacttaaaactatggccaatccatttcattttaataaaatatgccaatatggaatatgatgacttaaattttttctttttgaaataaaaaaagtaattcagttataatatccagcttgcaaatggcattagcttgtaattattgtatctactctagtatgggagttcttctgaagtctttgttaaacccagtgatggctgataaaggcactttctaatcatcgctcttgacttagctgcataatgaagatgccactcgtgtcagggcaactaatggctttgattttactctgatggtgagagcctttcacttcgtctccactgggaatcactctgatgttgtttaattccagtcatgatttttacagtattaatttcttcattctttgtttaaagaaacccacattcattatgctgagatgtgggtatataattactttgtttttcagtagctgcagatcagtattttttttaatagtgccacatatttttaaaagattatttcagtttgagtatcatgattatccacagtaactatctaaatctcaaatgtgttgaggagtact

SEQ ID NO: 122755 - DNA, 276 bp, Homo sapiens
tggaggcaaataaaacttattatatatggtgaaactaaacatattaggcaaatctttcatgtataaattgcctgcaagaaatgaatgtcttctgccagaaaggagaagtgagaacacggcagaaagagaaagcatgaacagatcattcaaaacaccggtcactttatcctggatttggttccgggtcctgtttcttttcattaaggaagtttatcctccctccaccttaagactgattaaatgacatgattttcattgtacataaaataggaaata

SEQ ID NO: 122756 - DNA, 335 bp, Homo sapiens
aaaggccaacaaagcctgtcaaatcaacaaacttgtgttgagataaaataacttctgctgacgtttttgtgacacatagagccagagtcaagtaaaagttctgtctacaccttctacccagccccattttccatacagtcccccaaacgtctgcctctttctccatcaatcatatccctggtggttaataactgcttctttaaaaggcacttggttgcctggggagtatgcatattacatgagctatttagcgtcctaatcaagtttaagttccctgctttgtattttcttgcagtgggaaacatttcccttttttctaaaaaagtgtggattta

SEQ ID NO: 122757 - DNA, 255 bp, Homo sapiens
gtgagccaccgcgcccggccaggtatgcacgtacttttaatggaaacagcttgaccaaaaatctgtcacagaattttgagacccactaagaatgtttaatgagaaaaaaaattatccaatgattaaataaaataaatagttagtagggtttttcataaacatatttttaagtttgtaatttgaatgcttttaacatttaacttttttttacaatgaatgtgaatattttttgttaaaatatttgttcacacctcc

SEQ ID NO: 122758 - DNA, 501 bp, Homo sapiens
atgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaaga

SEQ ID NO: 122759 - DNA, 317 bp, Homo sapiens
tcagggtgaggttcagcgggagatacaaatatgggagacatcatggaatttaaatcatggagtggatgagatcatgtaagagtatagagaggtaagaggctcaagaagctaaccttgaggtgctctaacatttagagcttgggagagaaggagccagcaaagtgagactgataaacagttggcaggaggctatcagcgcgttaggaggctatcagcgcgttaggaggctatcagcgcgttaggaggctatcagcgcgttaggaggctatcagcgcgttaggaggctatcagcgcgttaggaggctatcagagcgtaa

SEQ ID NO: 122760 - DNA, 493 bp, Homo sapiens
agcgctttgagctcttctcatgtgtacttctgcatcgccaaatgatatggctacaatgcattttttaaagtaatgattttcggccaggcatggtggctcacgcctgtaatcccagcactttgggaggccgaggtgggtggatcacctgaggtcaggagttcaggaccagcctggccaacatggcgaaaccccaatctctactaaaaatacaaaaattagccgggcgtggtggcacacgcctgtattcccagctactcaggaggctgagacaggagaatcgcttgaacccaggaggcagagtttgcagtgagctgagattgcaccactgtactccggtctgggcaacagagtaagactctgtttcacgaaaacaaaaacaaaaacaaaaacaaaaaaacaaacaacacatagttggtgctcaataaacagtcacttccagcatgaccaccactttagcctatggttagttacttcagcatccccaactcccaac

SEQ ID NO: 122761 - DNA, 472 bp, Homo sapiens
caggcctgcctggtcatcttactgtttcacatccaactgaagtgagttgaaggacagttcatggcagttcactgtttaaacagtcaaacagtcttttcttaatggtggttttaaactacaaaaccaagcaagtgccagcacaaggaaccaagggaagctcgtggtcatcaagaggccccgtattgtcctgctggaggctgaggatggaaaaatgagggtctatgctttcatgacactttgtgaaggctgctatgttcactcccctggtagttgtgcatgcatctggtagacttcttctaggaggaattataaccaaaataacaatgtatttgtttttaatagctctttaagttttactttggcatgataaggtttgagtgtttacaatgtttttaaactaaatgcagatccaaagtcttgaatgaattgtttccttttaagcctactactcaataaattatatataggttta

SEQ ID NO: 122762 - DNA, 554 bp, Homo sapiens
ttttagcacagggggagtttcaccatgttggccaggctggtctccaactcttgacctcaagtgatccaccagcctcctcctcccaaagtgctgggattacaggtgtgagccatcgtgactgtaagtcttttgtttttctatatatgatagtttatatgcaaatagggacaatctgacttcctgttgtctaatatggatgctctttatttttttctcttccttaattgctctggctagtacttccactactgtggtgaataaaagtggtaatagtgggctttcttgtcttgttttggatcttggagaaaaagctttcaacttatcccctttcagtatgatgttggctatgattttgtgctatgtggcctttactgtgttgagatatactccttctatacctaacttgttgagagtttttatcatgaagggatgttgaattttatcaagtactttttgtgcatctattgagaggagcatatggtttttgtccttcattctgttgatgtgatatattgtgtttattgacttgtgtatgttgtatccctgtgaaagtt

SEQ ID NO: 122763 - DNA, 289 bp, Homo sapiens
tctactactactactaaattcgcggccgtgtcgactgccagcctacaggagtccagccttgtgggcaataatccaatcaatcatgcctacataacgaaacctcaataaaaactagacaccagtactcagaagagcttctttggttggctccacatagtgtaacacagtgatgtgccaggagggtaacaggcctgactccatggggaaaagataatgaaagcttccaatgggaccctcgaagacttggctgcatgtgtcactccctttggctcgttctgatttgtaatct

SEQ ID NO: 122764 - DNA, 335 bp, Homo sapiens
ctccactccagcctggcgacagagtgagactccgtctcagacaacaatgacaacaacagcagcagcagcagtaattatggctcacagttctgggggctaggaagctcaagatcaagctgctagcagatttggtgtctgttgaggacccattcctcatagagggcatcttctgggttctcacatggtaaaaaagacaaacaagctctctcaaacttttctgttttgttttgttttgttttttcagtaagggcactaatcccatttatgaggatagagccctcattacctaatcaattcccagatgccctccccacccctaacatacggcactgggg

SEQ ID NO: 122765 - DNA, 249 bp, Homo sapiens
tggcaccaatccaagctcacgattacttaggtttctacttaattgtctgtcttcccaccaggagacaggccatatctgttatgcttactattgtatctccagtgctcaatgcttggaaagtagttgggactcataaaaataggatgttaaacaaatcaaagccaaaggcttcctttttaccttaataaagatgcagcagggacatttatttaaccaatagttaagcactactatgtgcagtggcattag

SEQ ID NO: 122766 - DNA, 673 bp, Homo sapiens
aggcctaggttttgctcagcagaggtatggaaggaagagtgtaggaagagaagaaagaaaaggattgagtcttatgtctataataccaaaatcttaacaaagtgcaaatcaagaaatgagacaacaggatgtagaagtttaagcatattatttcagtgtgcaaagcatctccatgttattcagcattggagctcaactaccgactgtgtcaatcaaataagagtatcaggttcctgtgctaaaaatattccagctcaaatcatcttggcagacaataccagaaaaaacaaacatttttctgtctattaaagtgaccaaatgttaggagactaaatataagcagaaaagacaagtaatagctgcataaccttgagcaagatactgactgagcctcagccttttcttcattaaaatgatatttttaatgcaggtctatagtctttactctgcaattccaaaacaggacaaaaaacaaaacactgtgaaacccaaagtgtttttgtaagtttggcaccaggattatatgccaaagaaaacctactgtgaacaaatatgaagcctctattgtctcagcacttgtatccgtaagtcacacatgcctctgctatttgctgatattttctgacttggggattaattccatggaaaatgtcgaaaagggctaaagatatac

SEQ ID NO: 122767 - DNA, 334 bp, Homo sapiens
tggtagaatatttggcttgaatagggtgataaagtattcagaacaatgatattttctaggttttctgtgtttctggacaacgatctataccatggatgttatatttcatattacattggcaattccaacatagagccagccacagagataagatagttataaaataactaaagtatagctataagtaaacaaactagtaaatgcataatagtgggagaggacagaaaatactgtaaaatgcaaataacaggaggtcaatgaaaagtgggtaagtttggatctgaaccatgagacaatcctaccatttaaattgttgaaagaagggaatgagtgc

SEQ ID NO: 122768 - DNA, 362 bp, Homo sapiens
tctacagaggctgtctctcaagttttcagcagaatactgacaatcacattcatgtgaggaatctttctgagactggagaaggaactgcttgaaaggagtgaaaggaacaatactcagagttgcacataagcctggaaatactgccttcctctctaaccagattagagggtcacataattggtggggtattggttagagtactcagaatagtgttgcctcaatagtggagaacaattaactatagactaaatgctgctctggctgtggagaataaattttaaaagtaacagctaaaaggatcaaacatctatctagaaagtttaagaatatttataagaatacaaaaatattaagcactaaat

SEQ ID NO: 122769 - DNA, 729 bp, Homo sapiens
agcgtggggctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggcaagtcgcacattctctccgtgcagctgcctagcagtgtggattcagtatcaccgtgtgtgttaagctctttctaagaatcgtaagggaccaccagctggtggcatccgatgggcaggggtggcgtccaggtggcagagcagctaggaacgcaagggctgaacctggggccagacaccctggtctcccgggcatggtccacgaacctccagtatctggcttactgtgggcccaaggagggtgggccatgtcttggcaagggcgtgccccgcaggctggtgctgcagtttggggtgctcttctggaccattctccttttgctctgggtgtctgtcttcctctatgggtccttctacttattcctatatgccgacagtcaggcacctcagccctgtgcatttctactacaggaccgactgtgattcctccaccacctcactctgctccttccctgttgccaatgtctcgctgactaagggtggacgtgatcggggtgctgatgtatgggacaagcgtatcgtggtaccttagagcttgagctggcagagtccca

SEQ ID NO: 122770 - DNA, 424 bp, Homo sapiens
ggatgatgataatagtaacgtcttcattaagattattgtgaagtttacgtaagaatagtgcttaaaaaaacttagcacagtgcttcatatatagtaaatgaatgaatataactaatattagtacaaaataaaatattttaagtaattctctccatatacttgttatcagtatgtagcattaattgaattttaaaatatcagtgtttatgaacgaatcagactggcttactgtagaagtataagcctacttttcttaatcttaaaggaaatttgtgatgttaattgcttatgacatcagaggtagtgggcaatctaacaagtaaatgacctgatcatgtcattacaagaactaattctttgaatgtctaaaacatatagttacttgtgccagaaaaatcatcaggtaagattggtaaatagtttt

SEQ ID NO: 122771 - DNA, 482 bp, Homo sapiens
gaggttgcagtgagctatgatcgcaccactgcactgcagcctgagcgacagaatgagacttgtctcaagcaaaaacaaaaacaagaacaaaaacccaacaaccaaaatgctgcctctagttttctgcctatttgtgtaatgcatatgcatatttctgatatgtttatgtttgcagaatgaatagactaaccaaagctaaagcacaaatgcaaaaattggcattgatgagaactgattctacttacgtgacattctggaaaagagaaaatatacgaacagaaaacagatcagtagttaccacggactagagaaagctgagggaattgactacaaacgggcacaaaggaacttttctgggtgatggaaacattctacatcttgatagtggtgttggttacctgacctcctaaactcataactgtacacttaaaatgggtgaaatttaccatatgtacctcaataagcccaacttaggaaaacaa

SEQ ID NO: 122772 - DNA, 382 bp, Homo sapiens
ttttttttttgagatggagactcactctgtctcccaggctggagtgcagtggcatgatctcagctcactgcaacatctgcctcacatctgggaaatttcataaggggtaagagcacttcaagaccacctggaatcttcaccatgaataagctctacaatatcggtcaagccactcagcttttctgagtctcttttcctcatatgcagaattggagttaagatgactataaccgagtatctaatgtcatggtgcaaatacagtctgtgctctaagttctgcccttggtaagttagatatacttacccagttgtgttaattgactgtgcattcacgggaaggagtagatacaatgttggcagaacttacggtgggcgtaataca

SEQ ID NO: 122773 - DNA, 378 bp, Homo sapiens
gcagtgtagctctaggcctccaactccattctgatggacaggtgtcccatggcaacgttgttaaatattttgaataatatctcagatgtaagaaaatgccacttcttttaacctctctcttgattcagaacagatgcttgttataggtctagcactgtgctaagtagtataggaaaaacagaggaaatgagaaatggcttggctcttaatgatatagttgaagatgttaaattagcatacatttcaaagtcaagctaattaagttctaagtgggtctgacaaatacagttctgggtaggctggaattagcaagaaagagaagcatgaactggctgaggtttacgatgactaaggtttagttgggaggggagaaagcag

SEQ ID NO: 122774 - DNA, 175 bp, Homo sapiens
catttacggaaaacatagtgtggttttgggtggtattttggcatttttaatttcatgaactaaaatgtcttatttaaaaaattaagttttgagtaggaagcattcctggtattccttttgctactccataaagcacttaatctccaatagcaccacttgaatcattgctgtaacc

SEQ ID NO: 122775 - DNA, 817 bp, Homo sapiens
ggctgtggttatgatgaggctgatggagtgggaagcagtatgagcaaacttaagtgcacaagggtcagcctggtatttgggggtcatggagaggtatggacagaagagcattatatttagcacttactatctcctgcaggacatggcaaagtaaagttttttgtttgtttgtttttatggaatgtgtagacagtgaaaagggtaggcaagggaggagaaagaagcaggaaggtaagggagagttaaacatgctttccacatcagcctcacccttctgttccccacagctagccactgctagtctaggagaacagttcacaaactcacattctttagctggaagaccttcacagcttacctagcgacaagattttgagagagtttgagagatagagcagagagctggaaggtaagaaagtagatgagagaggttatcagatcagcaagggcaaggagttcctaatttgatttgtgtccattctttactttccatgcccctttctctttttctaccactatttgacaatgaatcatatggaaattgtggtttctatttttattactatttatagttatttgcaggttttattgttatttgatttatcctttatttgtcattttgtttcttgcaatttcattcatatcttctctcttttgttataatgccagaaacttgaaaggaggaactatgctttttcgtatttctcaaagtgtaaacagttttctttttcttagtaaatccttaataaaggtaacttcaatacatttggaaaccaggcaggcgtattagtcttctcaggctgctataacaatatac

SEQ ID NO: 122776 - DNA, 392 bp, Homo sapiens
ttcttcctgcctgctgcacaaacaacatcgattcacggaattgagtatagaaagagtttaattgacatgaggccagccgtgccacacgagagactgagttattgctcaaatcagtctcatcaaaggcttgtaggttaggggtttctcaaagtcaatttggaggaaggagtaggggtggctaggcagtggatgtttgctgctgctgatggttgggttggagatgaaatcatagggagttgaagctgtcctcttatgctgagttgattatgggtgcggacacaggaggacatggctccaggtggagccatgggtgtcagacatgcaaaaaaacatgaaaagctatctcaaaaggccaatcttaggttctatcatagtgatgttatccgcaggaa

SEQ ID NO: 122777 - DNA, 431 bp, Homo sapiens
cctcggtgggtactgtgcaattagtgggtttgcatcacagctgaggaatcctaagtttaggaatcctgaatgttttgtaagggatgacaaatgaatctgcctgaactttgctcggaagagaaccactatctttattatattgggccataaacaaagctgcccctaccatctgtttccatgggagacactaactctatattcccagcctgtttactatcaaaacattattgaaaagagttcagaacaaaagcatagttagtatctttgctctcaatatgtacagaaatgtgagagacctatagaggtctagttctaatgtacctaatgtacactgtggactgtgatagcttatgggtaaaatgatgaaaggaccgaaaagcctattgatgagcttgcataatgtatatatttctgactcagataaaaaaaaa

SEQ ID NO: 122778 - DNA, 3242 bp, Homo sapiens
tactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactgcagccttgaactcccaggcttaagagatcctcccatctcagcctcctgagtagctgggattataggtgcagaccatcaagccttgctattattttttagacttttcttaatttcatccaacaaagtagttgctgtaggagctgagtgttagaaggaaagatgctgaagaaatgaaatcaagcagggtgtatactgtcatgaataggcatacagtagtttttatacttttgttctttggagtaccaatgttaggttttacaaaagtaatttgatgaggggaaggagggttgtgtatttattttactttctgatgtttgcttaaataatactgtgtacgtattcagcttgctgtaattctgtaattacgctattgcgtttggctaactcctttttggaaatgtctttttttttgtacaaggcatgtgttagtttttactaattgctctgaatgtgtatatttagatttctgaattgaaaaaaaatagcgtacaataagtagatttaaagtaattagaacactttattgatttttctgatgttttctgtatctaaaatttatcaccaccaggttgtgctaaaacagcaggaagtttttatattgtgagtgacagtacccattatttctcttaattttactaacatttactataagaatattctctcgctcttttctccactcacagccattctccctccttctcttcataacatcaagctgtcacagacaaatctgaaaatgttacaagcacagactatgttgtatgttttgaaattttagaacagtaatgttctttttaaaattgaacttctgcagagtaagaaaatgaatacatttattactttaaatttgtaaaattttccaaagtaaaaccatacaaagctagtgtcagtctctctcattgttcacaaataaaggacttttgttaattgattaaatcacttactatattcgatatgaaatatataaaacatacaaccattatctaatacatttcagaatgtttcactggttacaggagccagtaaataaagttgactctaaacaggaattttaaataaactaaacattttttcatcaccaagcatcatttatatattggtttctgatttacatatgtgatgtctaagaaaatctctgactttattcttttttgcctgtattaatttaaaatttatcccatttcgtctcccccttcccacaaatcaggtatacaatgggggaagagggaaaggagtacatagttttgacacagtgaccttttattatataggttaccaactgctagccttcatatttttagaaagggcagttttgattagacccatctatgaggttctgtttttttttttactggaaatttcatgcgttaaatgttgggtaggattaagtga

SEQ ID NO: 122779 - DNA, 3167 bp, Homo sapiens
tactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactgcagccttgaactcccaggcttaagagatcctcccatctcagcctcctgagtagctgggattataggtgcagaccatcaagccttgctattattttttagacttttcttaatttcatccaacaaagtagttgctgtaggagctgagtgttagaaggaaagatgctgaagaaatgaaatcaagcagggtgtatactgtcatgaataggcatacagtagtttttatacttttgttctttggagtaccaatgttaggttttacaaaagtaatttgatgaggggaaggagggttgtgtatttattttactttctgatgtttgcttaaataatactgtgtacgtattcagcttgctgtaattctgtaattacgctattgcgtttggctaactcctttttggaaatgtctttttttttgtacaaggcatgtgttagtttttactaattgctctgaatgtgtatatttagatttctgaattgaaaaaaaatagcgtacaataagtagatttaaagtaattagaacactttattgatttttctgatgttttctgtatctaaaatttatcaccaccaggttgtgctaaaacagcaggaagtttttatattgtgagtgacagtacccattatttctcttcataacatcaagctgtcacagacaaatctgaaaatgttacaagcacagactatgttgtatgttttgaaattttagaacagtaatgttctttttaaaattgaacttctgcagagtaagaaaatgaatacatttattactttaaatttgtaaaattttccaaagtaaaaccatacaaagctagtgtcagtctctctcattgttcacaaataaaggacttttgttaattgattaaatcacttactatattcgatatgaaatatataaaacatacaaccattatctaatacatttcagaatgtttcactggttacaggagccagtaaataaagttgactctaaacaggaattttaaataaactaaacattttttcatcaccaagcatcatttatatattggtttctgatttacatatgtgatgtctaagaaaatctctgactttattcttttttgcctgtattaatttaaaatttatcccatttcgtctcccccttcccacaaatcaggtatacaatgggggaagagggaaaggagtacatagttttgacacagtgaccttttattatataggttaccaactgctagccttcatatttttagaaagggcagttttgattagacccatctatgaggttctgtttttttttttactggaaatttcatgcgttaaatgttgggtaggattaagtga

SEQ ID NO: 122780 - DNA, 3188 bp, Homo sapiens
tactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactgcagccttgaactcccaggcttaagagatcctcccatctcagcctcctgagtagctgggattataggtgcagaccatcaagccttgctattattttttagacttttcttaatttcatccaacaaagtagttgctgtaggagctgagtgttagaaggaaagatgctgaagaaatgaaatcaagcagggtgtatactgtcatgaataggcatacagtagtttttatacttttgttctttggagtaccaatgttaggttttactttgcttaaataatactgtgtacgtattcagcttgctgtaattctgtaattacgctattgcgtttggctaactcctttttggaaatgtctttttttttgtacaaggcatgtgttagtttttactaattgctctgaatgtgtatatttagatttctgaattgaaaaaaaatagcgtacaataagtagatttaaagtaattagaacactttattgatttttctgatgttttctgtatctaaaatttatcaccaccaggttgtgctaaaacagcaggaagtttttatattgtgagtgacagtacccattatttctcttaattttactaacatttactataagaatattctctcgctcttttctccactcacagccattctccctccttctcttcataacatcaagctgtcacagacaaatctgaaaatgttacaagcacagactatgttgtatgttttgaaattttagaacagtaatgttctttttaaaattgaacttctgcagagtaagaaaatgaatacatttattactttaaatttgtaaaattttccaaagtaaaaccatacaaagctagtgtcagtctctctcattgttcacaaataaaggacttttgttaattgattaaatcacttactatattcgatatgaaatatataaaacatacaaccattatctaatacatttcagaatgtttcactggttacaggagccagtaaataaagttgactctaaacaggaattttaaataaactaaacattttttcatcaccaagcatcatttatatattggtttctgatttacatatgtgatgtctaagaaaatctctgactttattcttttttgcctgtattaatttaaaatttatcccatttcgtctcccccttcccacaaatcaggtatacaatgggggaagagggaaaggagtacatagttttgacacagtgaccttttattatataggttaccaactgctagccttcatatttttagaaagggcagttttgattagacccatctatgaggttctgtttttttttttactggaaatttcatgcgttaaatgttgggtaggattaagtga

SEQ ID NO: 122781 - DNA, 422 bp, Homo sapiens
ctacaaattgatatattttaatttaatagaaaatgagataagggatggacgtggacagtttacagaagaagaaatgtaaatggccagcaaggctaacaaaaggtgatcaaactcattagtaaccaaggaggcatttccattaatcagcctagcaaaaactaaaatgactgataacatccagttctgatgatggtgtggggaaatggatgctttcttaccaatctttttggaaagatctcaggcatttaaaatgttcatttttcatggccagtggtctcagtttgggaattttactataataaaaacatctgtgcattggaatgtatgtaagatttattgtgatgttgtatgtgtagtaggagagaaaacattgaaaccaggataaacataatgaataaattaataaactgtggttcatccat

SEQ ID NO: 122782 - DNA, 721 bp, Homo sapiens
ctacaaattgatatattttaatttaatagaaaatgagataagggatggacgtggacagtttacagaagaagaaatgtaaatggccagcaaggctaacaaaaggtgatcaaactcattagtaaccaaggaggcatttccattaatcagcctagcaaaaactaaaatgactgataacatccagttctgatgatggtgtggggaaatggatgctttcttaccaatctttttggaaagatctcaggcatttaaaatgttcatttttcatggccagtggtctcagtttgggaattttactataataaaaacatctgtgcattggaatgtatgtaagatttattgtgatgttgtatgtgtagtaggagagaaaacattgaaaccaggataaacataatgaataaattaataaactgtggttcatccatagtatggaatattacaaaagaaattctctaaatctatcttgattggcataaaagattatgtgaacaaaatcgcatttcagaattatttgctttaggaactaacagagaaagccactggcttcttacccataatgatattccatacctcttctgtttatctcaggctctcattttcaagaccctaaagacttccccatttctgtttccttctgtatttgggttctctttacctctttgccacttatcagtccctttcctgtctaccatactgtggtcagatatttggtaaaaaacaaaac

SEQ ID NO: 122783 - DNA, 238 bp, Homo sapiens
tcaatcaatcacccaacttcagccagtttccgcatctcaaaatggtgctggaagtgacccgcaaaccgtagatgctcaatagatgctctctaactcactgcattgattgattgattgagacagggtcttactggtctcactgagctgagacagggtctcactggtccagcccacgctggagtgcagtggcacaatctcggtttactgcagtctcaacctcctaggctcaagtgatcct

SEQ ID NO: 122784 - DNA, 375 bp, Homo sapiens
gtttttgtttttacctaagacttaagtgtccattgttagtgaatatgatagtttccaaaaaagattgtacagaggagttaacagcaaaacagagctttaaaaaaaattgtttatcgttgttttccattgtaatgtactgttagttgctaaagcagttcttagtgctatatctgtggatatgcaaaaatgatacggtactattcccattcttcactttggtccttttcatacaccagacactgtgcactaagaaaatttgccccacccactcatttttaccaaatttgtaatatgtatttgagtaacaatgactgataaaaactcctgtttggtggggtactggaatgtgaaaagattagaaaactgcaaactgat

SEQ ID NO: 122785 - DNA, 553 bp, Homo sapiens
gtgctgtgccgcattaggttagtgggtcagtctttgtgctgacagtaactgcaagagagctccaggaaaaaggaaggatggcatgatgtctttgattttatgattatcctccccaacacacacacacacacacacacacacacgtacatgcacacacacacacacatgtatgtccacacacagcctgtgaatgtgagggtgtctttgcagttcatgcagttacagacccctttcagatttcacaggcaacagaatgtatgttatcttcataacccagggctttagcacaaggcctgggatttattaagcaccactctcagctgtttctgccgaatcttccataaattttaatttgtgtgggtaggtgcttatattattgtgttttatgcttaatctattttacattatgattcttatggcatagaactcacgttgcctcttcagtcacggcagcaacagtggtgaatttccatatagtatcaatgacttccttattccattttctgttcctctctcagaaactccttgccagaatacctaaatcgcacaggta

SEQ ID NO: 122786 - DNA, 460 bp, Homo sapiens
agatctaaccacttagctattcagtctaggggtggatggggccccaatttattggcaggtgataaagaatgcatgcagtccagtagaagccctaggcgaaaggcctctaggaccctctagactgaggcatgccagagtccagccttggtacagtcaacctaccaccctctagactgaggcatcccagagccttggcacagtcaacctaccaccctctagcccgctgaacccctggccacttttcccactctccctgaaccagagaactcctggaggatgggcttgggctctgcttcatcaagcgctgctgacagaatgaatctggggctccctgtcatgggatgaccttggcagtcattctgcaaggtgaacaggaagaaggagtaattgcacctgaattggtgaataaaggatgaataaaaatgcttcaagaggacaatggttttgtaagatgaggcaa

SEQ ID NO: 122787 - DNA, 456 bp, Homo sapiens
caagaggacaatggttttgtaagatgaggcaaaaggtgctgtgccgcattaggttagtgggtcagtctttgtgctgacagtaactgcaagagagctccaggaaaaaggaaggatggcatgatgtctttgattttatgattatcctccccaacacacacacacacacacacacacacaaacacacacacacgctacttggaaaagcccccactggtcctctaggcacataagggatgggcactcagcatctttcttgacatcagtgtcaaggaagcccatcttgacttgggccaactggagaagtaaggggaggctgttggttgagagacctggggcaggggagaggggactgtgagcctaaagtgctgggagattatatcggagaaaggagttcccttctaagcctgggctcccagtggttcatggactggaaatctgcctgcctctctcacccag

SEQ ID NO: 122788 - DNA, 479 bp, Homo sapiens
gctacaaagggtatagagtatggagttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacagg

SEQ ID NO: 122789 - DNA, 510 bp, Homo sapiens
aataaatacacctattaaggacacagatgattggtttgtctgaaagtccagatggaaaacagactcaacttttcttttttggtgtatatgtgtttgtgtgtgcgtgtgtgtgtgtgtgcgcgcgcgtgcgtgtgtatgtgtgtgtggtgggggagagaatgcacaaacactcgaggtggtttgtatatttgactggtgaatttcatagttgtttttctggggttacttagaatttgagagtccgtgagaagcattaggaagaacattactgagaaaaaaggaggggtgggaagcccctagacttctccccgagggtatccccgctgcagtcttctttagatgtttggattccccagtcctcttgttttgaggcgtgatataaattcagcctctcatacatttaaaaatatcggttgaacacctgctatattctaggcaccgaggagacggcagtgagcagacgagaatgcctgctctcctggagccacagaaaatacaaggggcaaagaa

SEQ ID NO: 122790 - DNA, 723 bp, Homo sapiens
ggaactgtttagattcttgttcatttacctgttcgatctaaaacatcaagttttagaatgaaatgcacccatatcaaaattcaagttggctgtagcttgagcaacatcttcattctggccatttgcagtgagaattgatcaaatcatgggtttctgaagcagtaagttccccaaaggtcatcgaattcagtgcccttattacaaatgaggagagtgagactgaagaagattatacagttactgacttagtcacatttatattccaacttcgggctttctggacttgtctgcttagcatgtccacaaaatagcaggctggaagataatagaacaacaaaaggcagtcctaaagatggaacgtttctcagcgggttcaggtgaacagttaaatggaggaagaaattgaaacaaactgaaaaaaaaaaaaaccatagaaagaaaaaaagacactttctaagaatctcttttgtaatcctgcaaaccctgccctttcagagcataacaatggcaaactgaggcttaccttttccctaatttgccaaaatttggagtcccagctttccagcagaagaaagcatatatcacagaccatttcatcgtagaagatttatagtacaccatcccagaacagaagaagtaaaatccctctgcgctgctctagaaaatgtccttctctattcagttaagctggcttcctgtagagatgtaaataaaagaggaaaa

SEQ ID NO: 122791 - DNA, 113 bp, Homo sapiens
atgtatctacttttatttaacttcttaaatttggtttccttgctcatttttagtgtgagatataataaaatgagtttcaaacatacttactctaattgtgagagattgatcag

SEQ ID NO: 122792 - DNA, 421 bp, Homo sapiens
ctttttatagtgcatctcgcttgggactatggcattctaactgggatggatactggaacctaaagtacatagttccttctggatttagcatttgcttcactctccgatttccagatgtttacttaaaaagtgtgtatagcggctgggcgcggtggctcacgcctgtaatcccagcactttgggaggcagaggtgggaggataatgaggtcaggagatcgaggccatcctggctaacacggtgaaaccccgtctctactaaaaatacaaaaaattagccgggcatggtggcgggcgcctgtagtcccagctactcgggaggctgaggcaggagaatggcgtgaacccgggaggtggagcttgcagtgagccgagatcgctccagggcactcgagcctgggcgacagagcgagactctgtctc

SEQ ID NO: 122793 - DNA, 197 bp, Homo sapiens
cctcccaaagtgctgggattacagacgtgagccattgcgcctggcccacaaatcactgttccttttaaagacactaacacctttctccaagttgtatgtatatgtgtatgaaaatacacatgtgcgattttgttttacaactttcaaagtgcttttgaatgcaattatcttgcataatctgtttagactgtttccac

SEQ ID NO: 122794 - DNA, 372 bp, Homo sapiens
gaggtcaggagtttgagaccatcctggctaacacggtgaaatccagtctctactaaaaatacaaaaattagccgagtgtggtggtggacacctgtagtcccagctgctcgggaggctgaggcaggagaatcgcttgaacccgggaggtggaggtggcagtgggccgagatcgtgccactgcactccagcctggtgacagagcgagactccgtctcaaaaaaaaaagaaaaagaaaaagaaaaagctaagatgcagcaggtggagccgcctgccgttgggtttcagcttttcttatggaaagaatgttacggcctgggtgcctccattctctgatttctttttctttcttgactttttaaaattgaaacaaaa

SEQ ID NO: 122795 - DNA, 476 bp, Homo sapiens
tggtattacatcttttaaattgatgaaagaaaataaattataacagaattcaatgaaaagcaaaacatccttcaaaaatgaaggaaataaaagatttttttcagataaatgaaaactgaggttcagcaagcaccaataaacagcaaatgatcctagatggaagtataatacataaggtattgaagaatgtcaaaagtcataaaaaggtgaataaacctaaatgaatgctaactgtttaaaatagtatttttgcaaggttttaaattttataaagtttgtaatgacagttacataaaaggtaaaagggaggtaaactgagttaagatactgtagatatgtgcattaccctgaaaatgtaaaacattaatacaggatagattttaaggatgcaagatacatttgtaatctctaggataaccactaaaaatacttaacagctgtattactaattagctaataaagggataagaatcaag

SEQ ID NO: 122796 - DNA, 608 bp, Homo sapiens
tctgcctctactactacaaatactacaatagtagcgcaggattctgctggattttctgcagctttagtttccacacaaatggtccctgtatgagttctggtaactgactgttagcatcatcttgattactttaacatttaaaaaaagagagagagagaaacaacttacaaggaaatataccatagaccattataccatatacagtaaaagttcccttaactaatatattgcattatctgatctttgcatacctgaatcattacagtcagttgagctatttttagtataccgacctactcaattaagtatcttgctacttggtcacagtcactttagataaatgcccttctgtaatttcagaaaagcaacatgtcaccacttaatcaaatccctaattttaataaaataaaaaaactgagtaacattataaaactgacccctaagcaatcctgcttcccagctgaattagtagagaaagaatgcagaatgggtgtctgttacataactaagatttcacctaatttattaaaatcagccaggtgctgtggctcacgcctgtaatcccagctacttaggaggccgaggcggacggatcacaaagtcaagag

SEQ ID NO: 122797 - DNA, 447 bp, Homo sapiens
gattagctccacaggatgggtctccaaattgacaccaaatccaggagttagagatggctgtgctacagagcgtgatccaagcaccatctggagcccccagaaaaaaatccctaggaatagcgactaagggactagcattgtaagagagttcagattagctctcctgaaaagaggcttactacaagagactggcagacagcctctgcagcaaaacttcacttaggaaaggacagaaaatgaatgaagaaagacagggggaggctgagcaggtcagagtatgaatccacaagtatgtgaaaaagagaatccacctatttcgaaaaaggtacaacttcctttcagagcctttttttttttttttgagacagaatctctcgctctatcacccaggctggagtgcaatggcacaatgatctcggctcattgcaacctccgcctcccgagttc

SEQ ID NO: 122798 - DNA, 758 bp, Homo sapiens
ggttttatttgggaaaagcagatcttgtgggaacacacaggaaggtatctcagtcttagggataacatgaaggcttctcaaaggaattaaaacatcatctgacacctgaagaagcagttattaatagggttatggataaccaggggagcaatcactacaaaaacgtgaagcagaaacagaaacctaagaattagagaatgctggggattcttgggatctacatgaaattccagaatgttgttatatacaatgtaggctggggactggcatgagccaactcatgtattaaaacctttcaaattacagtgtcaagaatgtatgtggtcataaaagttaagggcctatcacagaaatccagacaaataagttgatgacataaatgacaactcaatactttttttctgtggtgatttctgcacctcttgaaatgaacttggtcactccctcacctgctaactttagcacttgtgtgtgtgtgtttataaaattatatgtattatacataatatatataattacactgaatttagctgattttttcatagactatgagcttctaaaaaatcatccccatattcgtcattacattcttgggatcaaatatactgcatgaaaaaagatgctcagaaaagtctatgttaagttaatgtatgaatatatgaatgagtgaaggaaagtgttttgaaaccatcatagggaatataataagataaaattacactagaataaaatgaaactgataagaataaatttgatgg

SEQ ID NO: 122799 - DNA, 833 bp, Homo sapiens
attggtaaggctaggctatgttctgttatcacaaaattctaggacttgtttaaagaacttaaaggtcagtttcttagtttctctttgtgattgaggatgagcaagccattgatacaccaagagctgctgagtgttggaggttgcctggtgaaactggcaggccctgttgttgacatttccccagagctaaaatgtcctcatactcaaaccaactgtgctgcccaagttagtgaaattatccatcagcactaacaccaccctttgggttcatgctcatccctgcactccatgtgacctttgagcccagatacccttctagaaggtgaatgaaagccccacatgtcccgcaagacttagtctgcataaaagatttaaaaggatttttttttctctacagtccatttatatgatactgttagaagtgaagaattttgaaactacatacactggcctctgaaaatggttcttgtggctcagaaatagtatattgttctgttgcttgtttttgctgaactgtagagaaaacaccagagtaaaattccatgtaaattgctaaggcatcgaatcagaactgtccttgggcgttgtaacagtgcagaaaatctcatttagtttttttctttttttttttcagttaactacttgtttgtttcttttcagaataggcacttttttttgagtagaaaacctcttctttctccacagatacatctctttttgttcacgccttgaagacttcagaaaaatagaagctcacttccttccataaaggtgaagaacatcttgatgaataaacagtcaactaccaagttcacatatttgcctatgaagtg

SEQ ID NO: 122800 - DNA, 582 bp, Homo sapiens
  misc_feature (10)..(10): n is a, c, g, or t
cttgggtggngttctagaggtcccagtgtgcatgtatacctagtagtctgactccagagtctgtgtgtttagtttggctatgctatgctgctctctcagggaaagaatggcttcacaaatgtcaatcagaggtaaggcattgaatcacttcttcttagacagtatgtacagaaagagccacaaatggtcaaaactaagcctgctgccaggtgggaggaggaaagagtggttaacaaaggaaagaaaagggataataggagcttacaggacaactaatgtcatggaagggaagaaaaaagttcattgaaagtgtaatcagttgggttgcagggccatagaaaatgagcctatggtaagaagtttagtgaaccgcaacactgcaatataatggaaggatggaaaacaaaaccagatctcaggagatcaaaactgttgttacaaaggaagaaggtaaagaagtaatttaatagagaagaaagtgcaggttcaagtaatttttttccaggatggaggaggacctattcacaggaaatcctacagagaaggagagcctctcagaaagcaggtgtcgaagctgtgtgc

SEQ ID NO: 122801 - DNA, 184 bp, Homo sapiens
tttaatatgtaacataggacggtgattcctcagagtcaggaaacaaatgagatgaaccctatgagtgccccagctcattaccttaaaggactttccaggccatggcacggaaagagggaaaatacccttccttctatcccctcccagaacagccaaacagaaacaactagagttcacaaaatag

SEQ ID NO: 122802 - DNA, 106 bp, Homo sapiens
cccgggctccagccgccccgctgtccgccctgagtgcgccgcggctgcccgagcgccccgcagacgggcgggtggccgtggacgcccagccagcagcccgcagcat

SEQ ID NO: 122803 - DNA, 345 bp, Homo sapiens
tcaaaatttgcctctttttgctgtctcactattttaaggagtgcccactatatcactaatatctctggcaagaaagcattccatgtgtatgtatgtaagtgtgtatcttcattttttgctgtcaccacacagacatcaggctttttcacaaaatctgaccccctcccttgaccattttttataactacctggcatgtatcactacagagcttttgttctggtccttctacttggactttggcagatatttgaactcttctgagccagtgctttcctcttcagggatttgtttttaagattttcttccttgccaaccacagagactgaattttatatcccacagat

SEQ ID NO: 122804 - DNA, 470 bp, Homo sapiens
catgaatttattcctgggctctctattctgttccattggcctatgtgtctgtttctatgccagtaccatgctgttttgattactgtacctttgtagtatatttcaaaatcaggtagtgcattctcaattattacagaaaaagcctgtgggtgttaaccttatgactccttgcatatactgaaaaatgtgtgtatttgtttttatttggttgctgacttggaagagtacagaattttaagttttaagcaatctgataattttcttctgtgaagtgtgaaactttatttgctttaataagtacctgatgaactctttatatcttaaaattcaaatctttcctcatctctagaaatttctcccttctcttccttcttacactttgccttctttccctcctccttctcttcctttcctccttagtctccttatttcaatcttgccatgtctattagagagatgtttgttcttct

SEQ ID NO: 122805 - DNA, 382 bp, Homo sapiens
cggtcacattaacctatgaggcagtaccatcatctccatcttacagatgaggaaaccaaagtacagggaagctagcagatttgctcagggatgcaccatccagactggaagcatctgtttcattttagagtctgtgttctttccaatggcattctgcctttaaaaaaaaaattgatagcaggcatggtggctcacaccagtaatcccagcactatgggaggccgaggcgggcagataacgaggtcagaagatcgagaccatcctggccaacatggtgaaaacctctctctactaaaaatacaaaaattagctgggtgcacctgtaatcccagctacccgggaggctgaggcaggagaattgcttgaacttgggaggcagaga

SEQ ID NO: 122806 - DNA, 395 bp, Homo sapiens
gccagatacttgggtagagttaatacatagaatataaggctataccactctgactctttatttagaaatttcactgcttattttccaggcattatggtgacccaaactttgttttttcattcttcaagccagtaagaatgcaggtttctatcatatttagatgctttttatgtctgcaactgaggactgccctcagacagaaagtcacaaaacaggacacttactccgtgttatccattttttaaaagagtaaaccacacccctagtttctgcctgctttcgattgttctccaatgccttcaggccgttgatttttatattttgctcagagttgaaacttgctatctgtgttagaatttatccaataggagcttgctatcaactgagttgtatcc

SEQ ID NO: 122807 - DNA, 396 bp, Homo sapiens
tctcaatcggggaaagacatgatatcccatccagattacaaataatgactatctaaaaatctcgaaggaaacagttcctctgtttataacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaa

SEQ ID NO: 122808 - DNA, 541 bp, Homo sapiens
aggtaatgtttgtaattctttgttgttgtttaaactaatgcattcctcagtgagtgctcagctcacgggattgaaagagggagtcttgcacaattgatgtgccagaggacaaaacctgatacaagaagagcaggtggaaatttaagatgcagtctccagaagcaagaaaattacagagaaagtgctcagtaatagctgagcatgaactttatccaaatccttaacaaacactcaaattacacatgaaagaggggacagccagggatttaggcttaaaaaaattatatttgcctctataagctgtaagaaccacaacaacaaaaagtgttcagaagaacagaatggaagacagacttgcagtgaagtattatttatgatggctagttttcagccaaaaagtattagacaagcatagaacaggaatatatgacccatattcaggaaaacaatgcagtcagtggaaattacgtctgaacaggaccagatgctacatttcacagaaaaaaaaaaagactccaaagtaattattataaacatgctc

SEQ ID NO: 122809 - DNA, 170 bp, Homo sapiens
actcttagttatttttaactatacaataaattattgttaatttactatagttgccccattgtgctaccaaacactagatcttactccttctatgtaactgtattttttacccactaaccatcccctttctactcccctttccactaccctttccagcctctgctaaccac

SEQ ID NO: 122810 - DNA, 138 bp, Homo sapiens
gagctggaaggtgtggcacatagggagcgaagggaggggaggagtcttttttgatattcaaggattgctctccccggcttggtccaggcgaggctccagctccattcagatttcctggcctgattactggcttccttc

SEQ ID NO: 122811 - DNA, 662 bp, Homo sapiens
cactgccccctcaccacccatggacgacaaatgcagtcctaggctcctgaagggagtgctgaggcccagagaaggcaaggatggtcctggggtcacacagccagtgagggggacagcgggacccagacacccgactcctcacacgaccttcctcggaggctcaaagccagcagcagcccctgtttaaggaaacaaagctgcccctctcttgagcttcaaggggcctgggataggacgagggaaggaagtcaagcccctgaagagctgcatgcagaaatccgtgtgacaagaggtggaattatttcccctagaaaaaaagaaaaagccctcccttggcagagcccaggggtactgggctgtaggctgatgtaacagagagaggagaggccaagaggaaaggaatcccccttccctctcagcaaacctactgccaggagcacaacagggaggacgcagctggagcagggggtgggggagatgagccaagcaggatgttggagcctgggatagagccctcctccatctggctggaaagcagaagcctttgaactgcaacccagggggtagcactcccttggggcccaaatctgggcctggcatggatgtggggtgcccagagcagagtatgtatctacaagggctgtgtcagctggaaaaacccg

SEQ ID NO: 122812 - DNA, 397 bp, Homo sapiens
gatgatatgaataaaatgatggtgcatgagatgggaagtgaggtggaagaatagatttcctgaagataggcttacaaatacatggaatgagcaagcgagccagagtgaggggaaggtaaatcatggctgccatgaggaaaactaacacaaaaatacattaccagttcagatacaaaataaatacctatatatggcatcacaggagcgcccgtaggagggaataacggcctttaggagaagagcaaggtagagttaggatcaccttccgattttgtgctactataaggctcttgacaatctttctgctctgtaggttattatttataaaaatcacagaaccagctgatacattcataagctaattactgaggcagctgggtacacatggtgcaatatg

SEQ ID NO: 122813 - DNA, 340 bp, Homo sapiens
atactatattcccttaaggctcggtttaaaataaggcataaagcaacagggtacagtaagtatatgtttcgaagagaattcattagcagatctataccattaaaatattagcaagaaggttccattgaattacttaatgtattcctatagtacagccaaaagagatgcacatacgtcagtggctgtcatccaaatggaaatatgaacacatctgcgtgtgtctctctctttatacttcttggattcctcccaagctggaggaatatggttgcagatgaagagagtgcttctttccgcacccccgacccccgcccgaggctcttcactcgtggattccctc

SEQ ID NO: 122814 - DNA, 837 bp, Homo sapiens
ctgcctgtaggcttcatgtccttcccctacaacacgccatgcttgccaggctggaagaggggctccagaaacttggaaacctgggcctgtagctggcatatggaaaagaggcctggaaaagcaccactcctgtccatgaagcccccagatggaaccaggtcctgttcagaaaccccatctgtgcctttggagagactgccccgagcacacaggcccagcaaccgccatctatggcccccaggacctaatcccttctacatagggttcagtgcatgaacagcaagaggaccttgtgcatgaataatttgtttccatactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagctgtccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctg

SEQ ID NO: 122815 - DNA, 631 bp, Homo sapiens
aatcacacggggcccaaatataatcacggggcccgggcccggcgtgggggttgtaggccggcgccacagcctgaggacaccgcgacctctgccccgcggagcgcgccgaatgccgggaaactttgcggaatgtgtccaggtgttgaagctcttgatggcgaaaggaacagcaagaggaccttgtgcatgaataatttgtttccatactacagaaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagctgtccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctg

SEQ ID NO: 122816 - DNA, 741 bp, Homo sapiens
ctgcctgtaggcttcatgtccttcccctacaacacgccatgcttgccaggctggaagaggggctccagaaacttggaaacctgggcctgtagctggcatatggaaaagaggcctggaaaagcaccactcctgtccatgaagcccccagatggaaccaggtcctgttcagaaaccccatctgtgcctttggagagactgccccgagcacacaggcccagcaaccgccatctatggcccccaggacctaatcccttctacatagggttcagtgcatgaacagcaagaggaccttgtgcatgaataatttgtttccatactacagaaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagctgtccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctg

SEQ ID NO: 122817 - DNA, 941 bp, Homo sapiens
ctgcctgtaggcttcatgtccttcccctacaacacgccatgcttgccaggctggaagaggggctccagaaacttggaaacctgggcctgtagctggcatatggaaaagaggcctggaaaagcaccactcctgtccatgaagcccccagatggaaccaggtcctgttcagaaaccccatctgtgcctttggagagactgccccgagcacacaggcccagcaaccgccatctatggcccccaggacctaatcccttctacatagggttcagtgcatgtgagtatacaccgggcttgattcctgcctagtccctgccagataccccatgcccacctggtgaagagaatgaggccacacaaacacacccaggccatcgtggtgatggagtgcctggggtcctacttgcccacccttccttgctggttcagagccagctgtctgaccacattcctaccctgagatgagactttggggacattgtccaccagggtcactgaccccttttaaaattccagaaacagagggccagctggtcccctagaagtttggcacatgggataagccaaggcttgccttcaggaacaggttttccaccacgtcgctgcccaaggcccagggcatccccaagttcatgtggcacctgcctgccatgtccacaacccatgccgacccctcctagagccactggaatgcttgttcctgggcatgtgataaacccagacagcttcagccttgcaggacaactatgcacatctggcagcagtagccggagggccatggaaagaagttggaggtgaaaccagatgctgtgaaaatattaggcaaaactgcatactataaaagtgctttaaaatgcagcaggaggagaggtgaagacacaaatgaataagtgcttagagacacatggctgtcagaacagttaagaatccacgctgcttccccc

SEQ ID NO: 122818 - DNA, 378 bp, Homo sapiens
caacatcagcaaactacatcctagccacctgctttataaataaagttttgtggaccacagttacccccattcattatttttctttggctacttcctactacagcagcatagttcaggaggacaaagaccttatagctggcaaaataaaatatttattttgtggccacctaagaaaaagtttgccagacctgctctagagcatcctttactgtcttcacttctcataatcctttgttcaaactgcccccctccccacttttatgttagacagcaatcttttattgaacagtactgctccttgtgaagcagggctagttcagaggcagtgcacccacagccagcccaaactgcctctttttgctcctaatatgttattag

SEQ ID NO: 122819 - DNA, 402 bp, Homo sapiens
ttgtctttatcatgttgttatcttaataagttcccctatattaggctaagtgaaataagccagtcacagaaggacaaatactgcacgattccatttacatgagggatctaaaacagtcaaactcacgcaaacagagagtagaatggtggttgcaaggcagaggagagagggggaaatggggagttcccatcagtgggcataaagcctaagttacgtaagatgagtaagttctagagatctgctgtatgacattctctctacaattaatgatactacattgtacacttaagtgattaagagggtagatcccgtgttgtcttcttactacaataaaataaagtttaaaaaatattcaggccaggcgtggtggctcgcgcctgtaatcccagcactttgggaggc

SEQ ID NO: 122820 - DNA, 638 bp, Homo sapiens
atgggggaaagaattagagaccccacccttcaccaagcaggtcgcagggcagagagagcatgggcttggaagaggggcagacctctggatgatttggggtgccctgtactcctgtggaactcacgtctttgaacttcagtttagttgagtccacacaaatgtccctggctggtgaatggtcttctgtcacacagggacctgaggacagaggcctccatcccgtggctgttccgtaccctggggcctggaggcctcaagagagacagcgtggagaagcctcgcctgcttcttaaagcccctgccttgaatttacacacatcacttctcattttccaatggcaaaacttaggcccgcagccattctgggaacaaagtgggtgggacatgccgttcctgatgggtagcagcaccaggaccagctccactgcatggaataatgaacccacagctttggtgaataggcagccacctctgccacatatcatagcttgttgggtggttgtgaagcttgaatattataacacatgtgaagcattaaccttggagtgccctgcagtgcaggataaatgctgttatttagttaagttaaaaaaacacacaccaacagggaaacgagaagaaagaaccctccagggctg

SEQ ID NO: 122821 - DNA, 166 bp, Homo sapiens
ccatgagaatcgctagagagggataataaaatttacagctccatatttataaacttctgtgtctagggttgggcaagaactctaaagatgatcattctctctgctctggatgacatcagatcaattgtgatggaacccacagttgtatccaggcatggtcatccct

SEQ ID NO: 122822 - DNA, 415 bp, Homo sapiens
tgggttcaagtgatcttcccatcttggtctcccaaagtgctcccacagtggtgtgagccactgtgcctggcttagtcaaactttaatatgctcaggaatcaccgagagctgttaaaatgcaggctgtgattcagaagatccagtgtgggacctgagattatgctggtctggcgagacacaggctatactgatgctgtgcagaccacactttgagtatcaaggatctggtccatccctcagcctccgtgcagtccatccctgaagacaggcttatttttaaatgtggaaattcccagctcttgaagggggaagggatgagaagcagaaggtttgctctgccagatcgttgggtggagaaaactcctttcagaccagggtagctgtggttcgggctgggctcttatttgcgaaaact

SEQ ID NO: 122823 - DNA, 269 bp, Homo sapiens
tgggttcaagtgatcttcccatcttggtctcccaaagtgctcccacagtggtgtgagccactgtgcctggcttagtcaaactttaatatgctcaggaatcaccgagagctgttaaaatgcaggctgtgattcagaagatcacttgaacccagaagttcaagacaagcctgggcaacatagggagaccccatctctgtaaaaaatttaaaacctagccaggtgtggtggcacacacccataagtcttggctacttggggagctgaggcaa

SEQ ID NO: 122824 - DNA, 275 bp, Homo sapiens
ttgaagatgagtatttttacccaatttacactggaaaaacagaggcttagagaacacaagcatttgctgaagttcatgttaatcagtggtagaacaggtcttggaccagctctgtccactgacagagtccaaactcctaagtgccaagctgtactgcttctcccaaagcaaacagcctaaggagtatgtccgccccagggccctccattgcttagctgagtatgggactcagctgcagttaggagcctcaccctccacaggctgtcagagcctcc

SEQ ID NO: 122825 - DNA, 200 bp, Homo sapiens
cacccccagcctgagcctatatacaacccctctgatgaccctcctaagaagagactgccttcaggatctaggtgggattttgcaccctgcatcctgccttccacctcccaccttctttctcatcatttgctcctccctacaaaagaaaatccttttctgcataaactctgagatgcttgcagattttttttttttttttt

SEQ ID NO: 122826 - DNA, 509 bp, Homo sapiens
ggccagcagcttacaatgtgaccgaagtgaagtttgtattaacttccagctgagtccaaagagaaggctcttctcactgcctaactcttagcttgcatcctacctgtttctacagatttcagagctccctatagcaactctgcaattgggcacatccctattattccaactttgtgaatataaaattgaaaccatgaaagattgtgggactgactccaaatcccacagtctataaatagcagagccaagacacaaacgcaggagtctgaccctccagggccctagatccttatttttcagactattgtgtataagtcactccatcaagactatcagcaacagttgttggaaaggtcatgggattccagggaaatacgtgattcctcccaaatgaggttctcaaaagataagactagacttgataccataatccatggatctgccaacattttatgagatggaattctctacaatggaggatacagatgggagcctctgatgctgtcttc

SEQ ID NO: 122827 - DNA, 599 bp, Homo sapiens
ggaagtctcgggccatttaacaaaacaaaacaaaaacgagttggtagcaactgggtgtggatcctcatgctatttctggtggaaggaccttggagcattactctgagagtgttttggaacataatgattgtgggtggaacttcacccaggcctccctcagtgagtccaaggctgccaagaatacttaggagtgggaggccaatgaagggattgagagaaaggtcaatttcaagaattttttttctttttaactactaagtaagcttcctttaacatctggggtcttctgggaaaactgctcatgagctataaatagtgattcaaggaaccaggcatggatcttctctgaggtgtctctctctctctctctccctctctctctccccttctctctctctcatagtaaaattgacggccacttatctaattaactaatttttttttgttgttgttttttgagatggagtttcactcttgttgcccaggctggagtgcaaatggcgtgatctcagctcaccgcaacctccgcctcctgggttcaagtgattcttctgcctcagcctcccgagtagctgagattacaggcatgcgccaccatg

SEQ ID NO: 122828 - DNA, 497 bp, Homo sapiens
gaagactgcatattggatacagtgtactctgtagtcatttatattaagtcttgagtccttaagagcagagcctcatcctgcagccctgtggtcatcgagggaattccagaatgctgaaggataagaactatgcctttcaatcccctatctttacccctcttgttttccaaatgggaatggctttgtatatatgaaggtgctgatgaaagtgttcgtgtctcagagaaaatgcttgacgttgagctgattactttgctgattgctgatgcaggaaaacatcagtaaaaaagaaacttaaaagtgggttatgtaaaggcagtgttaattatcatcctttaaaggagctaattgccatttttacgtgattactgtgcagccaacaagggccctgtatgttgcatatcttgtttcatttctgcagtaattttgatataagtgcttaactgattcaggtactgggcccctagattcatatcagtgatatttttttcagttcc

SEQ ID NO: 122829 - DNA, 948 bp, Homo sapiens
ggtgtagcttgtataacctgacatcatgagcatgcacggctgccatctggagcgctggcaggaatgtgacacagaggccagcctcaaagctggccaggatatttcctggggccctttgttttatgggtagttgatttttaaaattagcaaactcccaggcaaatttagacaatggtcatttaatatgtctatcaatgactgggtgaaatgatggttcattaaactgctggttttatttatgtgcaagtaatttttcttctgtctgactcattatttaattaactcatattccaaaaataaaatcaattttcctagggacaacttaggcaatttgttaggtactggacaggggatgggtggaatgaaaaccacatcacactgtagagatcaattaaggagcataattagtcctattttaaaagcattgttcctcttggggaggcccacatccacacaggaatcacagacttcatttaaatgcatcttatccaatatttgagtgcaaatcattaagtacttgagagaggaatactcaatgaaatattctaagatcctgatgatcatcaaacattacagttaatatgaaacgtaaatgatttttttaccaggcattcgtgtgtctttttcagatttcactttgctggacagaaaactaaaattctcgatagcttagttcagcattggaagtgcggtaaccccagccctgaaagagaaggattctgagttatggcttccactgcagagtagcaaattaatctcctccaagaatagctagggagagtctggctacctgattaacagagggaattttaaaatttgagtctaggtcaaaaattgtttttttaatgaaaagaattttaaattctgaaacagattttctaaatctggtacaagaaaactgtcaggagaaatcagcttgtcagcttttaagaagcccttagttgatta

SEQ ID NO: 122830 - DNA, 176 bp, Homo sapiens
agtgtacacactctgcagaaacagacatagatgaagaccatcctcagagaactatgcctggttcctcctcttcctcaattccctaacccctgtaataatgggaccacattcttcagctgaaagtaacttcctgaggagaaagatctattagccaaaaccaccaagatacaccatgc

SEQ ID NO: 122831 - DNA, 198 bp, Homo sapiens
gatttgaccaaccacagatcaaaaatattttttaaaaatgaaaataacaatagtaaaaaaaaatacaaataaaaaacagtataacaactatgtatatagcatttacattgtattaggtattatgagtaatctagagatgatttaaagcagggatgtccaattttttggcttccctgggccacatgggaaggagaattg

SEQ ID NO: 122832 - DNA, 278 bp, Homo sapiens
agagttgacgggagaaaccaactttaaattcatgcaggatcaggaatgctgtgccacatcaatgtgtaaaatacaatcttcatgtgggagaacgaatggtcatctctgaaatatgctttgcacattaggatttttcagatcttccctattcttggtttacccaaagcaaagcgagttcttgctggggtgaagggtggaagagaaaagcagcggaatgggcgggctgtcgaacaaaaggcggcgagggaggtaccgtgcagagcctgctgggccttctg

SEQ ID NO: 122833 - DNA, 176 bp, Homo sapiens
taactcagactgggggcttagacacaacagttcacctaatgtgagcatcttctctacgggggaggcaaccagagtacctgcagaaaacccatgcagacacagggagaacatgcaaacaacagacagtggtctcagccaggaatcgatattagttttcctgcctcaatgtttttttt

SEQ ID NO: 122834 - DNA, 452 bp, Homo sapiens
atacagcagagaggaaacaatagactttttgtgtagctgcctgaaacttctgctaggtgaaggcaagccaataaatgaagaagaagggataatggattgcctaacctgtgaacttggtcaccatgttctttgaaaacaaagtgaaatgcaatgtgttgtctttggactgtctcacagtgcttaccctacatcagacaacccttgtctagtatttcacggattttgatttgctatttattttgcatttgccttcatgttgctatgttttaagccatgaaatgaattatttattctgtttatacaagcaaaaaaaagttaatagctcaaataaaatgggaatatatttgtaatggcatcatagtatatgatgtggtatttttattcttgcttaagaggctgaagattgaatttgtatactaattcagatctggagagagaagaaagtagatggg

SEQ ID NO: 122835 - DNA, 667 bp, Homo sapiens
gtggttttggagagggtcccgatggtaagatcctgattggaaggtgtgttggttaaacaatttctgaactaaccgccagatggcatcactggccaggactgtttactacctgctagaaggggtagggcaaagtgaaacgaagccactctagggcgaatggggtaaggggaaagcaacgaataaattgccctttataaagatgatcacagattggatatttattactcagtgtgtctgtatgcagtactagggtggactaatgtctcacttcaaaaaaaatatgagtgtagtatacttcgcctaaaattgttactcagtgttactaaagtgtaatcattttccacatctccaaatatattccaagtctctgaaatactagtgcattgggaggtagaacattttcgagcttcatgtctgtaaatggtttctctttactgtcattcagtaaaatcagaataaatgattgatgtaatacttaaaaaaaaattggtgttaaactttgtagaaagagtgagacaggatgattaggggaaagggtatcctgatgggaatcatcaggcctccttggtgccagccctgaccctgttagtatcttgctgtcacttcacctccctgcatctcattttttaaaaccatggaatgaggagattggaccagatgatcattt

SEQ ID NO: 122836 - DNA, 202 bp, Homo sapiens
gttccatctggtcaagttatggaatcttcttaacagttaattgcttgctctcagaacattaacaactaagttacgttcttggctgttagaatcctagcagatattttaaacttacatttttgatataattatttcaacccgtcacttcattttagtttatttcctctacctattcgtacgccttcacttcatattagtgttt

SEQ ID NO: 122837 - DNA, 293 bp, Homo sapiens
ccacaggcttgtggtccagcttctctgttctgcttctccctactcacttccattgccagggctgattttcttcttgcaagtttcctctctgccccatagcttcctcctgttcaagactctggtgcctgatggcttctcttcatggtactgctcaataccttctcgctatgtgtctcttagccatgtcactttagtttgtcttacttggcattatgattttaagacatgccaagaggaaagacgttattaagttgttaatcactctccaaaatagaacaaatagaattcactgg

SEQ ID NO: 122838 - DNA, 299 bp, Homo sapiens
tgcgtatggaatacaaatgaactttttaatgtcatcttttttcctatattcattgaatggacaaataatagggtgaaatttagaaaggaaaaatgcaaaatataatttttccaactagctttattgtactcatttccaccaaaaaatatttaaacattttctggcatggtgccatggaagacctttcatggtgaggggagatttattttgatataattacaaatttatagaaaagttgtattcataaagagctcccatatactcattgccaaattcagtagttgtacattttgcattat

SEQ ID NO: 122839 - DNA, 326 bp, Homo sapiens
tggcccagggagacatatgtaggacttctatcctacagaactatgagataataaatttgtgtttaaagccacaagtttgtggtcagttattacagtagcaataatagagtatatatacacagaaacttgggcaaacacattcatagaccttcctgagtctcatcctcataaatacataaaggctccttgtgctcaaaagagcccaatatacaacatgaggactctgagagctgtaggtatgaaattatttggcattcgtgaaaagatcaatgcccatctcatgacctcaatccgctccaaaatctcacctctacaaacatggattc

SEQ ID NO: 122840 - DNA, 466 bp, Homo sapiens
catgtggagacaacatgaagtaataaatctgaggcccttcatgaatgtcaggcccaagctaaatgccatcgcagccaacagctgctgccatcctccctgatatatacactatgccctattggccaacaacatagggcaacatatttaattcaagtgtctacttcaacagagatgatgccaactagctaggatcatcacagtcaccgtagcagaaatttcaaggaggaaagagtcaccaaccccccagtgctgccttggatcgggaaccacgtgacagcccatacctgtgtggcccagccacagttcatatcctcagatattctcaagattcccatctgccttgccacgtgtaacctgctatgaaaacccctgctacagagtttttgtgccttgggaccaagagagcctaatgccacaaccttcctacaactggacaggctgcccctgttcaaaattcacacaagcc

SEQ ID NO: 122841 - DNA, 129 bp, Homo sapiens
tcagagtctcaggctgccccagcaccgcagctccaagtcccgtcagcctacagtggggcgggataagggttcccaacctgattttatgtatgggaaaactgaggcacgggtcagtaaaaagccgcctcc

SEQ ID NO: 122842 - DNA, 392 bp, Homo sapiens
gatattctgcttgactatctagtccctcaaaaggcattacctttcccctgtattatctcaagcaccctattataactttttgagttagtagcatgttcaccaaggctaatcctctttagcatgttagccagctatgatggccacattttcacataacaagatgatttcaccaagttaaaaacttctttgggatctattcgtaaaagtatatataagagtttacatttctaacaatatagaaaaatgtagagcctccattataaaacatctagaaatgttggaaaaaaatatacaaaacatacttttaaaagcactgactttataagatagtacaagaaatgttcaggagctaaaattgaaacaggtcacaaaccagagcagtacagagacag

SEQ ID NO: 122843 - DNA, 437 bp, Homo sapiens
ccttccacgaggtcctcttcctcaacacgtgggatcacaatttggattacaattcaagatgagatttgggtgaggacacagagccggaccatatcagagagaaagctattactgaagacctttctaactcacttctgtaaagatcaattcaataaaagcagcaaacacacatactttgctttccttgtgattaatgccttgacttttttgtggaaagtaacaccccaagaaagccagctactcatgttggcaataaaggtaaaagtatctatggaataaggaccatttttaggacaatactttccctactacttagttctagtcccttttttgtagaattctgaggactttctacatacacaatcatgtcatcagcaaataaagattattgtacttgttctttgccaacccatatgtcttgccttactgccctggtt

SEQ ID NO: 122844 - DNA, 390 bp, Homo sapiens
atactgtgggacaaggttgtttgtcctgttcgaagagaaagatataggttctaaatgcgaactgtgacaggatacagagcctgtgcgtgggaatcagatctgtggcaggattggggagacagctgctgaagttcagagagaggctgggcaagcctccagtgatatgaagaggaaaaggtcttttcaatatttggccacatcttgatggtgaccctccagatcagaaacacattgcctcatggatcaggaaaacatgccagggcatttttttagagataaaacatgagagctttcagcacagtgtggacttatacatgtagatgtttatgtccctgtgcacatagggctcactgtgcttgcagtgggtgaaatgggaaatatttcaatgga

SEQ ID NO: 122845 - DNA, 150 bp, Homo sapiens
tgctgggattacaggcatgagccaccgcgcccagcccctttcatgtcttttcagccacaatattagatccattaatctgttttaaggacacaccgattttcctacatatatgccaactttcatggctctttccttaccacatggaaaact

SEQ ID NO: 122846 - DNA, 338 bp, Homo sapiens
cagaacacatttcctatacttaaaatctgtgagcaactttctttttgaccttttgtaatctacttcatctcttgaaatctgttttgtttaaattttaaagacaggatctctctctatcaccagggatggagtgcagtggcaccatcatagttcgttacagcctccgtctcctgggctgaagcgatcctctcgccttggcttcccaaagtggtgggattacaggcatgagccactgcacctggccagaagtctgttttttttttttttaaacatataaaataagggatgatattacttttctaaataacacatgggtcaatgaagaaatctcaaaagaa

SEQ ID NO: 122847 - DNA, 235 bp, Homo sapiens
cccacagagatgagaggcaagaagacccagggagaaggccactgagatgaggggagagggctacagagatgaagagaaatgaagagaagagagacagccgtcaagactgtccagagaagtgggctgaggcccacaaaccccacaaggacaaggacaggaaaagcccagggataagaaagaaaggcccatggagacaagggagcagcctacagagacaagcaaaaggacctcggag

SEQ ID NO: 122848 - DNA, 801 bp, Homo sapiens
ctcctatccgctccgggcgctgccgccggaagggccagcgacggagggtctcagatggcggggcttgaggcccacccgggctctcgggtcggcgagtcccgttggggagcccttgtgcctgctaggatatttagcagatgccaggcggccagaaacgtcctcacttttctccctcggccctctggggaaccgccgtgagcgtttcccacggacacaaacttaacaggcccagaacgtccagggaggacgcgttgtgagcctcaaagagcccacttacgtgaccgacagcaccaggccgacgggcactcgctgaactgctggcccggagcagcacagctcttaagtgggcagtggcatcttttatacaaataaaggaaggtggccccacgtccctaaaacaacagcttgctgaagagagatcgcaaagcatcccccactccagctcgggtctgactccaaagcccttctgctttagaaagtgtgactatttctgctgtagaaaaccggtatctaggccaggcgcggtggctcacgcctgtaatcccagcacttgggaggccgagatctattgaaaacagctgggcaccgtggctcacacctggaatcccagctgaggcaggaggctcccttgagcccaggagttgaaggttgcagtaagctatgattgtgtcactgcactccagcctgggaaacagtgcaagaccttgcatattagaaaaaagtttctgggaagtataccaaaagtcttaactaagatttgctaaatgaatattaattaaataacctaacggcaagtacatg

SEQ ID NO: 122849 - DNA, 903 bp, Homo sapiens
gtccataatgtgtgcccaaatagaatatggccagtgtccttacaagaagaaatttggacacagagggaagaccccatgaagatacagggagaagatgggcatttgcaagccaaggagagaggccacagaaggaaacaaccctgccaacaccttgatcttggacttccagcctccagacctatgagaaaatgaatctctgttgcttaagccacccacgttatggcagtcctgggacactaatatactaagtctccccttgccaccaatgacagatgataccacccagctttgttcaccctattccttctgccaggtatgcccttctgtcctatctctatctggtgaaatccccctcatcgctcaaagactagccaagatgccacctcttcctggaagacctccttactgccttccctctttagaagctcttccccagtcccaggttcccaaagcaaatgtaggcctctgtgagatcctgcaagactgagagcccttacgggtgtgcactgggtcaaactcattgttgcatccctgtgctcagcacaaggctggataatcaatgtctgtgattgattcatgaaggaatggagggttagagcaacacctctcaaactttgatgggcctggggatcttgttagaatgcagatgccagttcagcaggcctgagattctgcctctccccctagctccaaggtcacgctgatgtaggtagtccccagaccacactttgagcagcaaagggttcacacactcaggacattccacactgggacacagtagtcatacgattagttcacatgtctggttccccacactgcctggaacagggccctgcacacacccagtgccagctgagttgattacagcaaggggcagttgtccacctgatttgtcttcagctg

SEQ ID NO: 122850 - DNA, 101 bp, Homo sapiens
cagagtcatctccccgctctcttctccctgtttactagacccagccattgcagcgttcttatagctttctgaaggcaccaagttctttgctgtccctgctt

SEQ ID NO: 122851 - DNA, 637 bp, Homo sapiens
ccgcccatatactactgatggtacacttcacagagtgctgattggtccattttacagagtgctgattggtccattttacagagtgctgattggtgcatttacaatcttttagctagacacagagcactgaatggtgcgttttacagagtgctgtttggtgcatttacaatcctttagctagacacagagcgctgattggtgtgtttttacagagtggtgattggtgcatttacagttctttagctagacagaaaagttctccaagtccccacttgacccaggaagtccagctggcttcacctatcaatatatcttctataaagacattaaaatcatagtatatgttagctgacagtctacaaatacagagttttatttcaaatattattgtttataaagtatatttttcctaaaatgcattaagcttcttctggattatttcattcacaaattaggaaagcaaaagcaaaatcaaaatcaaaagatgtcataatgttttagaatacagaatataaacacatatttctaccacgtcatcatgataaaattgaaatactaagtataccacacaaatttattatacaatgatattttgtattctattccacaataatattttgaactgcataggtgggag

SEQ ID NO: 122852 - DNA, 302 bp, Homo sapiens
tggggccgatggcgcttgggagtcttacatgccaaggaagttcacctacccttcctgccttcccggctctggaagagtcaaagcggtcccctgaagcaatcctggcatggtcagttccgctgggggagaaagtgtcttcccgggacgtttctgggagaacctgtcctccttagttcccctttctctgcccatgtcccttccttatctcacccagggaggttctgcctctccctgccttgcagaggtctctgcaggtggctgccgctcctctgcagatgtgcatcccctagaaaggcgactgt

SEQ ID NO: 122853 - DNA, 762 bp, Homo sapiens
tgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaatt

SEQ ID NO: 122854 - DNA, 721 bp, Homo sapiens
gtgagttattttatgattacaaatccttattttttatgttattttattactatttattaacttatttatcttatttattagccttcaatcgttactttttgagtcttttttaaaatcttaaggtcatagaagtgtcctctgtattactttttaaaaactgtactgttttatgttacacattggcttctatatgaaataatttttgtgtatgttgtgaggttggatgttaatattcatttttatctgtaccgatgtatgaaagacagcacaatttattgaaaatgaatcttttcctcattgtactgaagcactatttttttcacaaatcagctaaatatattgtgtggttctctttacgagctctctattctgtttcattgaaatatctatacttgcaccttttccataatgtcataattaatatacatttataaaaactttatatctaatagtgtaagtcttcacattatattttttcttcaaagttatctatacactgcatttttatttgcattttatagtcagtttttcagttgccaccaaatataatgcagacaaattatgctattactaatcacagtattgtgattttcagtgtattacaaatatagatttatttacaatactgaatctttcttctaataccaggaatgacataggaacacagtacacctttatttctgttgaatatctttaatttctctcagtaaaatttcacaat

SEQ ID NO: 122855 - DNA, 415 bp, Homo sapiens
aaattttgttagtgatggtgtcttgctatgttgcgactttggaatgcagtggctatgcacaggtgtgattgtggctcactgaagccccaaactcctgggctcaattgatcctcccacttcagccttccgagtagctggtcctacagttgtattccactatacccagttagttttttattttttgtagagacaggatctccctatgttgcccaagctggtcttgaactcttgctctcaagtgaccctgccaccttggcctcccaaagtgttgggattacaggcgtgagccactgcacctggcctgtaccaattatattttgaagtgatttgttaatgccgtcttgagagcagggatcgtatctcctagattgctttctgatacatgataggtgcacagtatgtatttgtgggtagt

SEQ ID NO: 122856 - DNA, 277 bp, Homo sapiens
agtaaggaaaccagatgagtgtgatggtggtgaatctgggaagagagaagaacatgctttaagtgaggagtgatggtctctgttatatgctgctgtgaagtaaagtcaggccagagaatcgatctctggctttgacagtatgaaggtcattaatgaccttaatctggagagttggggaggcagaaccctcattgtatggggaagtgatagcctgagctgaagaagtggagagggcaagtatggacagctttttaaagggtttcactttgaaagggga

SEQ ID NO: 122857 - DNA, 375 bp, Homo sapiens
attaataataataaagattgagaggaaaacgtcacattttctgaatggttaattattatattagtgatagcagcctgagtcttaaaaattctcccttaaggacaagcatgtggctcacacttataatcctaacactttaggaggtcaaggcaggagaatcacttggctcagaagttctgagaccagcctaggcaacatagggaaacactgtctctacaaaaaaatttagctgggcatggtggcattctgtggtcacagctacttgggaggcttaggtgggaggattgcttgggccaggaggtcgaggctgcagtgacagcctaggtgacagcaaccctggtgtcacctggtgaaaaaaaggtgaccctgtctcaa

SEQ ID NO: 122858 - DNA, 352 bp, Homo sapiens
acgagggctttcgcctgttttgtttggtatctgagggctcgccaccctcccctgggtctctagtgctgagctgagcactggaaatcgagtcccaccatcagatggagctggctgacttcaaccagtttccagcaggaaattaagaaacatcttcaagcttgtcatcccagcactttgggaggccgaggcgggcggatcatgaggtcaagagatggagaccatcctggccaacatggtaaaaccctgtctctacaaaaatacaaaaattagccaggagtggtggcgcacgcctgtagtcccagctacttgggaggctgaggcaggagaatcgcttggacctgggaagtggagg

SEQ ID NO: 122859 - DNA, 482 bp, Homo sapiens
aaatgctgaccagtcctggttaactgtttgctgccccagggtacaaagtttctctaaagttaaagctgacccataccccggattgataaagggtgagatagataagaaactctactttagggatttgagaatcactggataagaggagattctaggacagagatgattctggtttgattaattgagaataatggaaatttctgactcctaaactgatacattcagatccactgaatagatcagttttaacctataagtaaagaaatgcccctgcctgtttatatcatggcagactcccagagacgggtcaacatcttaatatttgtcttttccaagtactgaacaatgccacaaatttcacttctaaagtataattccccattcttactgctttgattcatagtaaatgaaaattgtcctaaaggtaccagtattttactgctgaatatgactaagcttgtcagatcattatgtgagaaatg

SEQ ID NO: 122860 - DNA, 473 bp, Homo sapiens
cgagtcctgttaatgtgtaatgcatgcccagtgtgtacaagcgttgcttttatgctaaaaactgaaccgtccccggattgttcagggttgaaatagcctttgagactttagggatttgagaatcactggataagaggagattctaggacagagatgattctggtttgattaattgagaataatggaaatttctgactcctaaactgatacattcagatccactgaatagatcagttttaacctataagtaaagaaatgcccctgcctgtttatatcatggcagactcccagagacgggtcaacatcttaatatttgtcttttccaagtactgaacaatgccacaaatttcacttctaaagtataattccccattcttactgctttgattcatagtaaatgaaaattgtcctaaaggtaccagtattttactgctgaatatgactaagcttgtcagatcattatgtgagaaatg

SEQ ID NO: 122861 - DNA, 347 bp, Homo sapiens
gaacctctatttctaccacccacatttaatctgcctatttctgtgctgtacagacacaaaactgttctgtacatacccttttttatttggctacttccactcaacattgtttatgagatccatctgggttgctgcattagcagtagttaattcttttctatcactgtacgatatttctattgacagaacatacagcaatttattttttctttctattgttgacggacattgagttatttccaattcaggctattgcaaaaatcacagctatgaacacggacttgtcttctgcacttgctttctggtgcatgtctgcatgcatttttggcaggcgtgcaatgtccagg

SEQ ID NO: 122862 - DNA, 407 bp, Homo sapiens
aatcactgttcttatggttccaggagcttctatttcttgagatagacacgttagacccttagcgagcactagctatgaaacagggccacagccctggagagaagtaacaggaagcaagccatgccttggagcctggatccaggacttggatctcactggcagatcctggctggtctctgcgtgtgagagcagacaccagatgccagggtcaggacagcatcattctctccaagctaagatctgagatggttttctgtgtgtgtgtggatgggtgtgtatagtatgtgtgtagtctgtgtgtatatgtgtgtgtgcatgtgtgtgtatggtgtgtgcgtgtgcgcatgtgtctgcatgtgtatgaggtgcatgcgtgtgtggtgtgtgtggtgtgcgtgggggtgtgt

SEQ ID NO: 122863 - DNA, 318 bp, Homo sapiens
aaatttggaattatataggaagtgctttccttaacttatagtaaaatagaccaacaagttggctaatagagaagccactaattttacaaagaaagttacccaaaacactgtgttctaagttaccaatatatttctcttgagttcctgtaaatctttgattcatcccttcatttaaaaatatttgtctcccaaagtgctgggattacaggtgtgagccaccgcgcccggccccttaaacactatcttaaaaattacatatatatatcaaaaatacagagtgcaaaaatggaagatgcctttttgtctgctcccaaaaag

SEQ ID NO: 122864 - DNA, 208 bp, Homo sapiens
gttgtagcagcaaaatgaaatcaaattcagaatacatctggagataagcaatagaacttactaatgtattgatatatggagtatgaggaaagagaagaatcgagatttacatctagacttttaacctgaagaaccggatggatggtgattctattttctgaatggaaagggttatggtggaaaagactagatttggtggatggaaatg

SEQ ID NO: 122865 - DNA, 610 bp, Homo sapiens
aatcagaataatgcattttatttaaaggaagtagaaaataagtaggagcataatatttattgagcatctactatatgccaaacacagtgtttagcaccatttatgtattaaatcatttaattttcataaaatgtctaagatgtgttatccatctcattacacatgaggaacctgaggtgtgaaagttatgacttccctaagctcacacaactagtaaggtaaaataggtaagaccatattaggaggattcttctaaactgggtttaggcaaactttttttgtaaaggaccagataggagagccatttggctttgtaggtcgtagggtctttgtcacaactgctaaactccatgtttgtagtatataaatgaaagaagtggttgtattccaatgaaactttatttacaaaaacaggtggcaggccagatttagctcagagggtcgtagtttgccaacccctattctaatctcttcttccctttgcccaaatcaaatctgtttccttagtgatatttataaaagaaatttagaattcttttctaaaaatgtgctacttttttttcctttttacatactaaatgtaggaaaattagaaactgtacatacacaa

SEQ ID NO: 122866 - DNA, 616 bp, Homo sapiens
accatcacatttgccaaattccatgggttacatggggcctaataaatgttgaagagattatatacattgtgaatattaggaggcaggaatcactgggtgtcaacttggaagttgggtaccacagtctgacctctggtccccaatgatttatgtccttcccaatgcaaaatactcttacctcctttcaaatcctccagaagtttcaccttaatatagcatcagctcaaagcccagtatcttatcatctaaatcaggtcaggtgcaagtgtgaatgagggctccttgggatgagttccttaggtacagcaactcaagtagtttctcttaagacctgtgaactgtagttatttgctccccatatgtgtaacataccgtagcacagcagatataggataattgctagataccgtcctcttcaaaaagtagggaagtggaagacatacaggagactggcaattctgaaattcagtcagacagaggttggcaactctgattagtattcaaggcttcagaataattcttagttcttggctatgttctctgggctcttagttctaccttacgagttatactttttcttttttttaagagacagctgttcaccatatttcccagg

SEQ ID NO: 122867 - DNA, 452 bp, Homo sapiens
ttgtgcattgtattcattgtgttgtgaaacatttcaaacatacacaaaagtagaaagaaatatattatgaacccctatgttcccttgacccaggttcaacaactatctacgttttgcaaatttaagtggatttctaactctactcaacccttcccatgccggggaaggaggaagagatagaccatctgtttattaattaatcctaaagtttctagaaaacttgcacttctaattctgttttatgaaacctcctgccttctgggctgatgatgggcaggcccaggctgcagggcccagggggctctcggcaggagaggctgctaaccgagaggaggaagccggaagccctggagctcaaccattcattcccacagcagaattctctgctggggaggcgctccgccattcctcagtctgggctggaactgaggctttcaagggctaaaggtacc

SEQ ID NO: 122868 - DNA, 391 bp, Homo sapiens
agttggtttcaggttgtaattagcagatctccggaaccatactgccttaaccaacccaattttcctgctgtcctgctattaccctagggttactggaatcgtgttttgaggtgctgcctcagattgtgcagtgcagtgaggtggagattttaaaatgttcatcctattcattctgtcatctgacgtctaggcaggctatagacttcaacatccctgcagccaacccccctccaactgacaccgccccaaacataagtaccagttcaacacagtcctcagtctcacccaggactttctgtgttttgttgcttagattttattgcttatattgttgttttttctttctttctttttctcttctataattttccagagttgatttgggaaccag

SEQ ID NO: 122869 - DNA, 568 bp, Homo sapiens
gcgaagagttggtgatagaacagaaatgtctggaaagactggatggcagagagaactccagatagctgtggtggccaggagtgatcctcatggctgacctgcaacccaacctgccccaggaagcctgttgtgaccctccagaccctaccccacactgctgggacagaccaggggtcagccaaggggctccagacctctgaccccatcaaggccctccccagggcttccaggggatggggtccagccaaggccttgtcgacagcccagtgccccacacaacagcccagccacctgcccctgcagtgagttacaggaagcccactgctccctggatcacacccgtcctgagcagaaggggagacagaggcctactgggagtgcaggacttcagcccaggcctccaactgctgggcaactgggccccactcccccaccactcaggaaatggctggttctatagagatcccgtcactgaacgcactgcacctgacagtagagcttttcaaacactattgtgtcagatctgaaggtctacgcatgctcggaccacaggcaacaaccgtctgct

SEQ ID NO: 122870 - DNA, 399 bp, Homo sapiens
cttacaggaagtggctctgttaagccacaggaaggggcagtgtgaagccacaggaaggcacagtgtgaagtcacatgaaaggggctgtgtgaagtcacaggaagggaagtggaaagtcacatgaaggggctatgtgaagtcacagggaagggcagtgtggagccacaggcagtgtgaggccacaggaaggagctgtgtgaagtcacaggaagggaagtggaaagtcacatgaaggggatatgtgaagtcacagggaagggcagtgtggagccacaggcagtgtgaggccacaggaaggagctgtgtgaagtcacaggaagggaagtggaaagtcacatgaaggggctatgtgaagtcacagggaagggcagtgtggagccacaggcagtgtgaggccac

SEQ ID NO: 122871 - DNA, 345 bp, Homo sapiens
atagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattaactgggcttggtggcatgtgcctgtagtcagttacttgggaggctgaagtgggagaagaggattgttgagctcaggaggtcaatcaaggctgtagtaagccgagattgtgctactgcactccagcctaggcaacagggtgagaccatgtct

SEQ ID NO: 122872 - DNA, 357 bp, Homo sapiens
tcacttccaggctcccagtgcaagcctcagctcttcttgctttcttggaaatctctgctgtagcagccacttctattccggcgacactcagatctacttttcctgctgaaatctttctccccaggatgggaggtgggaggctgcatctttacctacatagtgcatgattaactcccgttcaacatgccaaacctggtgcccaggagaaagctctatacttgcctatgtcccaggctgcagtcaaagactccccacctttccttatagccccttgttggctttttcctttactattttattaaatccatcatttctactcccaatgctgctaagagcttcatattctcatttgccacc

SEQ ID NO: 122873 - DNA, 409 bp, Homo sapiens
cctcagggcagaattaattgctttcttacctgtctgaagtttggcactgtttccatctaatagctcaatgcctgtctgtctccctgttctttcacttgttcacccaacatgcattgtagtgccagcatacagttagtgacccccaaagacctcaagggtctccaggaggtctgacaggaccctttgcctgtgtcagtctttgttaaatgtggggatttggaattgagccatttcagggtcaagtctggagttaggggagctaaagggggttgattctgtgcgtaccccttgtcccaatcagcccctgagtcccaggtggtttctaaccttctcttgttttggctgatgggagctggggcagtgggagggtctggctgcccatctgcctgagcttcccagtgtctaggat

SEQ ID NO: 122874 - DNA, 203 bp, Homo sapiens
catttaggcatcaggtaaggaaaggatgtatttccagggggagggagtggagggtaaaggacaggagtgtcaccgagccctgaaatcatgcctgtcactttctggtgactttgccaacaagcaaggtgatccctgattgctcaaacttaacttcttcaattttgtgccatggtgattagcatggggtgcactagaatccagga

SEQ ID NO: 122875 - DNA, 248 bp, Homo sapiens
ccctttccaatggcacaaggaggaaccaggtgctcgcctctcccatgtgtcgggaacaggctcggcacaggtgtgctaacttgaattaccaatcaacatgagtcaccaggggacttgggccctcagtggcttccgtgtggccaggctacgcatgcccagtcagcatttgcccagtcggatttgcacaggcagggccatcacaccccatcagccaggacctcacaaccggatgccagaggccagctcag

SEQ ID NO: 122876 - DNA, 2104 bp, Homo sapiens
tttgtattttttgctaataaaatcaagtatcaaattacttttggtgagggatgggcaactgtattgtactgctgataatttgcagtcaggaaaaattttgttttccttctcataacaacactgttaagccatgattcagtttactttcacatttttcttgagccaagcatagaatgctattaaattaaattttattggttttaaattataattttagcctgtttcaatctttgtgaaagctaattctatcactcaacataattaagttattctcctcttgggctcgtgccacccaaaatgatgagctagctttcgacaactgagtcttggtaatttacaaaactgttcagaaagacgaaccaaaatttgaatggcttgctgtgttctgtataaatttataatcgaaagtctgatcatggctacaggtttttttttttttaacttgttctgtttttcaacaaacaatatacttatttgcaattaaatgaaaataaagcattgaattctgaagttttagagaatgaccttagagatttttagtggttgtcagccttagcctcctattaaaatcatctgggaactattaaaagcatttaatgttgtgaccctacctagacctattaaattccattctctggggtgaagccaggccatcagttattttaaaagttctccaagtgcttctaatgtgcagcacaggttgggagaatctgatctagcttagcacttaaaggttatagtgctaccactacataacacttctatattgagtttactgtagtatattaatggagctatcttaagtggaaaatgtctgatcaatcattaaatagcaatctaagtgaaatctataactaaaatttctatctggaaagacaaaaagaaaaaccaacttctctttgagggtatgctatacccagagacttggctagtgctaaggagggcatggtagacttcccgaggtcacacaaagaacaagcagctcatgcttggttctacccaatagtctgagtcccctcagtcactctgttttagcctctaaaccactaggacgtgatttgagaaatttcatgaagcctcaaggtgttctttcaggttatttgtacaatggggaagaaaatatctatagttcaacctctttcccatactcatgacagatcacctggcctgtgcttcagtattttacagattgttcatctgtggctgaaaagctcttatcaaaatgctcttacttttattgagctgataaagttgccatcctaacttctatccattggttctggctctgcctcctggaggaacacagactatgttgattgtcttttccctgtgttagcaatgcagatggattgtaattttcctaaatctgctcttcaagaaaagatttcaagttttgaaaaccatatcatcatcctgtcctcggtgacacctgtttctctcctttgtcaacatcacctttcacaatgtgtcacctggatagcagatcgaacaacctggctataatagtggttctgatagcctcctttgatctcgtcattgtattctagaaatgaagcccaagattttatgtatttttaccgcggtcataccacgttgatttaaaagatcaatgattttcaagccaggctggacattaaaatcacttgggagagctttgaaaaaatatagcgatatcctgttttacccttgatcaattaaatcagaatctctggggataaggcccaggtacagtgatttttaaaagtacttcaatgaccctaatatgcatctaagtgagttctatccttaaatgtggtttctctcaatttgtaggtaaatacaatattttgttgttgtttgaatgtaaatatcaggcttttgatctgttctagtttaattttctgataatagtagtcccagaattttcaaatgcaattctttaagattgcaatgaagttagaactcttacgttactgtttatgtccacaaaatgtttagaaaagtttgaaaaggattttgaaaaagattaacagtgttaatatttcttatattgttgggtttatgcataatataatttggttaatatgtatcataaataaaagtattttaagatcaaaatgtgaac

SEQ ID NO: 122877 - DNA, 380 bp, Homo sapiens
cactcacggaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 122878 - DNA, 558 bp, Homo sapiens
cactcacggaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaaaaaaaaaaaaaaaaaaaaaaaaaaaaaaaaaaaaaaacaaaaaaaaaaaaagggggggggcgcgcgcgccaaaagactccccccggggggggcccacatgccgccgcgcccaccgttttgttgacaacaggggggcccactagggggggcgtattacg

SEQ ID NO: 122879 - DNA, 367 bp, Homo sapiens
cagtggcaccatcatgctctcaaatgcctgggctcaaataatcctcccacctcagcctcctgagcagctgggaccacaaatgggcaccaccacgcccagtttatttttttattatttgtagagatgaggtcttgccatgttgcccaggctggtctcaaactcctgggctcaaaggatcctcctgcctcagcctcccaaagtgctgggattacaggtgcaagccatagcacccggcctcatgatttggattttattctgaaatatgctaccatatttatgactttgttttgtccctttgagaaaatgatatagtgtaattggaaacttaaaacaattgttttcacaaaaataccaagaatgcaggtta

SEQ ID NO: 122880 - DNA, 452 bp, Homo sapiens
ggattgcacttcctttcagatcatgttccccacccccagccccacgggcgatgatgcagcagctgctgtgtcacgacatttttcacggatggacacagaccctggaggaatgcgaccaggctgagcctcactggctgcccagaggagcaagtaacctgttgcggcccctctgtcctctcaggactactgtctctttcatagtcagcaaggggctgggggcctaggggtccacccctctggcagctgggaaatgccagcccagttccctggggaaagcactgaccacacagctgggcccccatgggacatcttagctcctgtccctcctgatctaagtgtgggcaggcacagcttttcatttatatcccaggcgccgagtactcatgggcatccagagcagtagggcaagactggtgagctgagtagattggacaaaaacatcatccagatct

SEQ ID NO: 122881 - DNA, 686 bp, Homo sapiens
atttggggagcccagacttgccaatgggtaagtgagtctagtcaagatgtaggatttcagaaaactcactcagaagagcaggatgaagataaaggaggcatcattcagcagcaataaccaactcatttccttctctagaaagcaatgaaacaagaatctggtcatgggattttaccagtgcaaaggattaatccacccaattgatggccaagaaaccaaccagtgagagcaggaagcaagaacacctcgagacaggaggcatggctgggaggcctcaggaaacgtataatcatggcagaaggcaaaggggaagctgtatcttgtaataagttaaatatttgctgaaggaagagagctgtaatagaaaatggaagtgccagtggtgagactttatttttttttctgaggaatggttgaaatacatgaagatacatagagaagaaaacaattcttaataagtgctaagtgtcatcaaatactatgtttaaatgaactcctactgaagagagattagatttttttcatctattttgttaagaaaacaattgaagatcaacaagtagaagtaaggagtagactcttcagatacatggatttctaatagtagagttgctccagctggactcactcaaataaaatgagttccaaattcccagggatgtgcaaacattgaataaacaatgaac

SEQ ID NO: 122882 - DNA, 285 bp, Homo sapiens
ttccccatttcacctgcttcccatttccctgcctcccacccccacttcctgttagggggtttgcttcccaaacttgagagccccatcaacacacagctccctggagaggcttcattctcagggtgctgccagccatcacccttcttagagtcataggagacatgtgaagagctcttagaccttctcactaaatgaacttcctcataactgaattcctttctccaatcagttgaggacaattgagtgcacaatgcctcctagagctatcattgtgtctttccaact

SEQ ID NO: 122883 - DNA, 342 bp, Homo sapiens
tacaaacaatagtggggcacagagctacttagcatgtgctgtttatttcgaggtcaccagaggaagctattgtataccatgagcaccatggtatccaagggcaatggttgtgggctgaggtagctgtggagcctggtgaaaatctgagtagtccagagctatgattaccaatgcctgccccattaaaaaatgaagcataaccaggtgacatgtggatctgtatttcacatctaaatatagcaatcagaaaatcattttacatatcataacacaacttcttaaccttcaaaagaaaaagcaatctcatttggttgtgctgaaaatcataattccgtggaaata

SEQ ID NO: 122884 - DNA, 496 bp, Homo sapiens
tattgggttccctgattaaacctccgactgttttgctttttcatctattttctgtctctctgcctttttgtttcactatctgacctacttcattttctagcctgcttactgaaacaaacaaaaaaattattatacttaatcttatggagtcaccattgtatatgtggtccatataccaaagcatcattatatagtatgtaactgtattattctggatctaaatctctaatcagatttatgacttggcaagtagtattttctaccacgtgagctgtcttttcactttcttgatggtgtcccatgaagcacatgtttttaattttgataaagtccagattatctattttttcttttgttgcttttgttcatagtgtcataccttaagaatcctttgccaaacctaaggtcataacgatttactcttatgttttcttctcagagttttatacttttagcttttatatttaggactttgattcatttttttaagtttgtg

SEQ ID NO: 122885 - DNA, 368 bp, Homo sapiens
tattgggttccctgattaaacctccgactgttttgctttttcatctattttctgtctctctgcctttttgtttcactatctgacctacttcattttctagcctgcttactgaaacaaacaaaaaaattattatactttaaattgcaagagttctttcttgttctcttcctattcatttttactgcactctgttctcccctgctttaatggatacaaaatcttctctgagaatgttagttacagttgggttttttggttgttttcttcagcaacctatattctttctgtttcttctgatttctgtcatttgcttgattgttttgggctctgtactttatgtgagaactttttctcaaaagtgcaattat

SEQ ID NO: 122886 - DNA, 451 bp, Homo sapiens
  misc_feature (26)..(26): n is a, c, g, or t
  misc_feature (54)..(54): n is a, c, g, or t
ctctaagctttagtccctgcctgaanaaggtgctggggaagagcccaccaaacnggtggataactcacccagtcttgcacttttattcaaggcagggactaaagcttagaggagtaaagggacagggacttgctcaaggtcacatagcttggaacagcagaatccagagaaggactggggcttgctggccctcatccatgggactgtccagccactgtgttactgaaaacgtccccataatggtttcaataaagtcctaaccaggaacttggcacagggcaaattctagcctgctgccaatcagcaggaaaacagctcttatgccagtgggcaggaagctgccaaggtgtcacttctgctcagagaaagtggtttgtgtatttgctgaactaatatgttcaccctgaaggtacagagatcaactctatctctttctggagggtccctccag

SEQ ID NO: 122887 - DNA, 224 bp, Homo sapiens
cttcccttgggaggcctgtcaggttggcaaatcacacacgcacagagctaaggtggaagttgttctctgtgagtgtgtcagaggagaggaaacctggagggaagtgtgctcggttttttgggaaccgtcaccctggggtaacatggttagaaaacacctgactgagcaggtggagatcccaagcctgagtgagatccagggtgccccacgtaagagagagatgc

SEQ ID NO: 122888 - DNA, 313 bp, Homo sapiens
ttgcagacacccttctttcccgtcagggagtagtagataaatgttatgtctctcgtttaaccctatgtcttctgccaaaagcataaggaccatctgctcaggaaaaatctctagcaggaatgattctgtttcaaagtattcttaaaaaagcttttacgactgggcatggtggctcacacctgtaatcccagcactttgggaggccgaggcaggcggatcatgaggtcaggagatagagaccatcttggctaacatggtgaaaccgtgtctctactaaaaatacaaaaaattagccgggcgtggtcgtgggcac

SEQ ID NO: 122889 - DNA, 164 bp, Homo sapiens
tggaagcaaggaatggctggagctgaagtcagtgagacacagccagctttgaaagctagattaaggatcacagggttaaggcccagatggggcctcatctggaaggtaggggattccctgaagggtttttactggttgtgttggggtgtttgctccagcatgta

SEQ ID NO: 122890 - DNA, 900 bp, Homo sapiens
tagaaaacattttaaagtaaacgacaatgaaaatactgcacatcaaagcttataggatgccactaaaacgctactcaaaaggaaatatatagccataatggctcatatttttaaaagcaaatttgaaatttaacgatttaaacagccaatttaggaagttaaaaagaacaacaaaataaactcaaagataattaaagaaaggaaacagtagagacaaaggaagaaattaatgaaacagaagacaaagatttaataatgagaagagcaacaaaaccaaactttagtactttaaagagttctggcaaaacttgttaagataacagaataaaaaacataagtaaagactatgaataataaaggggagatattaatacagatgttgcagagatcaaaaaagataataagaacattatgatcaattttatgcccaaaacaagaaaaaactaaggtgaagtgaataagtaaacagaacttgccaaaactgacttgggaagaaatagaaaacctgaattgccatataaccattaaaaataaataaaatggcaggctcactttggcagctcatacactaaaactggagccatacagaaaagattagcatggctcctgtgcaagtatgacatgcaaattcatgagaattccatattttaaaaataaatacataatatgaataaaacaccaatagtatttggttttgcaaatgagttctaccagacactcaaagaaaagagatcactgtgcagtcctatataaactctctcagaggagagaaaaagagagaaactctcctatttattttatgagagcagattcaaaaataagtatcaaaaaggaaattacaagctaatcagaaacatgaacatacttacaaaaatttcagagcattagaaaacataatca

SEQ ID NO: 122891 - DNA, 206 bp, Homo sapiens
ctgtctatcttctttgctgagatatgttaagggttttggcctgtttttaatcaggttgttttcttactgttgaattttaagagttcattgtggtttttgatttacatttccctaattagtgatgttgaacatattttcatgttttttgacctacagttttgtgtgtgtgtgtgtgtgtttttttttgagacagagtctcactctgt

SEQ ID NO: 122892 - DNA, 439 bp, Homo sapiens
aactgagaaagggtttatttgtttttgtttttcatttgtagtaggaaaggtgctagcaaaaaggtctagccaagaagatggataatcaggctgagccattgtttgacttttgccaagtattgctgtgaaaggacaagaaagtgaagggagcttgagaatgtaaacacacatgttggatgagccatggaatctcagccagttaggagaaaggagcttgaggggttgtggtcctagctgcttgggaggctgaggcgggaggtcgcttgggcccggggggcggaggttgcagggagccaggatcatgccgctgcactccaggcctggctacggatgagagacgtctgtctcaaataaaacaagaaaaaagaaagaaacggtgccgtgttgtgagaggccgagatttattacacaagggtccgccgaggtaagaattttaacc

SEQ ID NO: 122893 - DNA, 172 bp, Homo sapiens
aatgagagagatgggagaagggcgtggacaggcaaacgagggggacgatcagggaatttgtgaatgttgggactgtgagtgtgaatgtgtgtttgtgatcgtatctttgagtacgtgtgtgtatatgaatcagtgtgtgcacatgtgtatctgtgagttgtgggcatgtgta

SEQ ID NO: 122894 - DNA, 790 bp, Homo sapiens
gggggtatgaattgaaataaactgtttattttatgttgtgtattatgctcactacctgggttatagattcatttatacaccaaacctcagcatgatgcaatatatctatgcaacagacctacacatgcacccctaattctaaagtaaaagttgaaaaaagcaaaatatgtatatatatttacaataaaagaaaaatataaatttaaaataaaaataaaactgtaagaatgaaggaatagtaaattattttttactttataaggggaaaggattataggcttattttattattttgagacaaggtcttgctctgtcacccaggctggagtacagtgatgcagtcatgggtcatggcaacctccacctcctggacccaaaccctactccaccccctgagtagctgagactacaggtgcacaccatcacacccagttaatttttgcactttttgtagagagggggtttggccatgttgcccaggctggtcttgaactcctggactcaagcgatctgtctgcctcagcctcccaaactgctgggattacaggcatgagccaccatgcctggcctctagtaatttaaaaaatatttccctttacatacagcttttaagaagcacaatgttattttatttgtatattatatatacactcttcactattcattttaaatacaaagcagatcttgagatatgtagaaacctaagccatctttaaagttgaggatgttcttatttataaaggttttcctttacattctgatttcactatttttgtaattataactaaac

SEQ ID NO: 122895 - DNA, 1548 bp, Homo sapiens
  misc_feature (230)..(230): n is a, c, g, or t
ctgatgcatgacctctttgacagttgcctttgttcatgattcctagtttcctggtttattttattggggtacagggtgaggtctggaagacctggaaaggaaactcacttttttggtttgacagtattaatgcaatcatctagttcataccttgtaagcccacttattatttcctctgcgtgtgttttttctggtttagcggattagctgcactgtctcttcaaaggctntccaatcaaggaggggttattaaaaccagggcgatttatgactgagaattaattagagaagcattttcatgcacaacatccaattttttgattagcaatggagcagggccgcaattaacactcgaggaagcttaaatttccagctttttgattctcaggaaatgagattatcaaaccagggtcagacacttgacagcaaagtgggagtgggggagtgtgaaattatatgtaaaaaaaaaaaaaaaaaaaaaaaattccagagtctagaaattcggtcatttttctctttatgtaatggtaagaattaagaatcctcacatctgcaaccaaaaatacaagcctggtgtgtaacactaaagggtaaaacagggatagatataagctgttatgctattcttcaggcaacactgtggataagtgacattcagatgtttactgtaaagaaaaatttgaatacatttgtattgaagggcttttagaaaagagcattactacacagaactgagagttgaaaatatgaaggtgtggaagattaagagaacgcgtttactttaaaagataatttaaaagttatctttccaggctgacacggtggcccactcctctagtcataacactctgggaggctgtggtgggacgatccctcgagcccaggagttcatagaccagcctgggtaatatagggagaccccatctctatctaaaattttttttaaaagaaaataaatatctttacagttatttttcttagtcctatgttctttattttggtgttttccattggatacctgcatgccaagtgttgtgctacagtattactgaagagtataatggaagtaatgtcctgctgaaaattttctttgagatattaatcattaataatttatatattgctatttaatacttacataggtctttagccttttaaaggatttctgtttgacagcttttataattgaaagttattccattttttttttaattttgcatgcttgaaaaagatgaaaacagtgatttaaattatgaagtatggggccaggtgcagtggctcatgctggtaatcccagcactttgagaggctaaggcaagtgggtcacttgagcccaagagttcaagaccagcctggccaacatggtgtgaaaccccgtctgtactaaaaatacaaaaattagccaggcgtggtggtgcatgcctgtaatcccaggtacttgggaggctgaggcacaggaattgcgtgaacccaggaggcagaggttgcagtgagccaagatcacatcaccgcactgcagcctgggtgacagagtaagactctgtctcc

SEQ ID NO: 122896 - DNA, 216 bp, Homo sapiens
gaagaattactttatttccctgaatactctaacgtgcatttagccagagcagccaagagctgtgttcctggccccaaagcctactgccccgctgcagacacactcccagtgatgcttcagcctaagctgtggagcattctgagaaatcgccccatgaaactcatttttggatctcccatgaggatctgacggcatggctcatctcataaatctcag

SEQ ID NO: 122897 - DNA, 737 bp, Homo sapiens
gtttcagggccagctcaaccacactagaatagaaaaccacgtagacttccaagtttttttattccagtccttagctatcagatggcatctctgggccttggggtaactcactgcagtgaagcaaaggatacaagcctggctaactttgccacctgctgcttttagagcccaagggccttaagaaaacaaaggcagtagctaggcagtggttacagcaggtcttgagcaagacccagtgttgtactggctttaggtctgacccagcactgtcctagtgttggtggccacagggttgtttgtgtccctctatcccaagccccaggtggctcagcacagagagagagactcccattgtttgggagaaagtaagggaagagaaaaagtctctgcctggtaatccagataattcttctgggtcttatccaagaccaccaaggtggtacctctatgggtgtgtaaaaaccacagcattactgggcttgggtgcccccagtgcagagctaatgcaggtggcattagatctagggcttagatcacaacaccgaggccctttcaaatacctggaaagccttcccaagaaggacaagtacaaacaagcccaaactatgaagactgcaataaattctgaactcttcatgcacagacacaagtgaacatcaactagcatcaagatcatccaggaaaatgtgacttcaccaaatgaacgaaataaagcaccagcgactaatcctggagaa

SEQ ID NO: 122898 - DNA, 219 bp, Homo sapiens
caggttgacccccaggcttcaggtgcacactaggcccaaagtgtacacccgtgcccaggtgggcatcaggcccaaggtgtacaccagaccccaagtggacatcaggttccaggttgacaccagtctctaggtagatccttaagtcccaattggtcatcaggcccaaggtggatggataccttgaccccagggggtcaccaggtcccaggcaggcctcag

SEQ ID NO: 122899 - DNA, 601 bp, Homo sapiens
ttttatttactatatagttttgaatattgtttaatttctgatttttcctcatttcttttagttcaaaaagaattgttttaggagatactcatttaaattgaattaaatatgtaaatacatttggacaataaatatttttacatcacgtagttttcttgtacaggaacattatttgagataatcaaaatattaatattcccttatgttttctgttatttgcaaaagttgttaattttgaatgcaactttttcaaatacttcaaaactatagcaaaaaagatatgcagaggtcagtgctgctaagctggtatttgcttctttacatcctcaaagaagtaaataagtaatcccagcactttgggaggccgaggcaggtagatcatctgagctcaggagttcgagaccagcctggccaataaggtgaaaccccatctctactaaaaatacaaaaattagctgggcgtggtggctcacgccagtagtcctggctactcaggtggctgaggcatgacaactgcttgaacctgggaggcagaggttgcaatgagccaaaatcacgccactgcaccccagcctgggcaacagagtgacactcggtctcg

SEQ ID NO: 122900 - DNA, 502 bp, Homo sapiens
gattgcattagtggttttcaaggaacgaatctgtgaagccctgtccagtagcttgtggtaggctgtagagaacattgggtttccctgatgactccagtatacttgggtagttctcagacagtaaatactttgtatagcatgtcgagaccttttggagtgcttatgatagctacaagatggaattcactcctagtcagttcttcattcagatgatgattaacattctcttaagtacaggtgtgaaaacacattgagacaaaaatgtctttaaaaacagcctatttctgtacattaatagaaattctgccccagaagaaagctcttaaataagttcttgctagagaaacagctgagaattgcaaaagaaacaacaacaaaaaactgagtaaccaagataaatttcacaaaaccatgaactttattcataggagatttcctaggaccttgctcttctgtaagcacagttctacccgcctccccattggaaattgaaagcagaaaa

SEQ ID NO: 122901 - DNA, 421 bp, Homo sapiens
tgcattatcacagtaaagaaagacaaggcagaacgtccctattagagaacaaaaatgtctcaatgggttttaaaagtccagctctatttaaaaacaaacaattgaacaagagtataccaagcaaagtcaagtaaaaagaaagcaaagctggcaatagtaaaatcaaaccaagaactcaaggccattaagcattaaactggacagagagggatattacatgtgataaatatgtaatccctgaaaaataaaaaaattacacatattgatgcatcaagcaaaacggcagataaatacactaagcatttctcttggaaatatgaaaagtttaaaaattataaaaggggcccggtgtggtggctcacacctgtaatcccagcactttgggaggccaaggcaggcagatcatttgaggtcaggagtt

SEQ ID NO: 122902 - DNA, 169 bp, Homo sapiens
gcacaccactcccaaaacaaaggcttgagatttcaatcaaacaatgattcaagaaccagagccaaaagaagcatttcacctcctctcctctgaaggttcttgcaccaatccctgtcctctttcacctgctttttcttcatcctacttgaagcagaaggcagactggcag

SEQ ID NO: 122903 - DNA, 803 bp, Homo sapiens
agcggggggccgagcggcgtgcagaggctacaagtgccgtagctggtgattgggggactttctccgggaaccgtgccgggagagcgcgcggtgctggagccgcaccgggtggccgaagcagaagagacatggtctggctatgttgcctaggctgatcatgaactcctgggctcaagctattctccaaacctggcctcccaaagtcctgggattccagcagagaagattcaagaagattccagaagtggtcaagacattgatgttaaacataatgtttcagtgaaggatgtttgattccaagacctctggaaaagattctttatctacagtttctaagatggcagatttgcagaacttaaaagaatactgtaagattgggattgatgccacctgaaagtgaagagccaaactgaaaacgtcataagtgtcttaagaagttcgactttaaactaaattcaaggccatttatggacagaataccatggtgggtggtgtcatcactatatgtgatacagcaagagcttctacaatataattagtgattattgcattcaatttaatcaaagaatagtttaccataacaccaacaggccatcattttatagttatcaggtggaccagagaccagaatctaattgcgcagattctcttaataaaatgttagtctatatgtttgtttattggctggttggtctaaagtggttggtttattcattttagacattctaatttttgactcctcgatgtatatattgtgcattttacgccaatgcactttcaaatgaaactgttgaatttcctct

SEQ ID NO: 122904 - DNA, 326 bp, Homo sapiens
atgaggatgaggatgctggggctgccggccgagctgcaccaaggggaacggggcctcctcagcccccacagggagaacctaaagtggcgggaaacacgaggacacgggcacagccctggtcggccacctgccccactgcacccagctgtcccccggcctggcttcctgggcctctgttctccctccatatagtgctttcccgctgaccctcgcccagcctgataggcagtgccgggaacaccactctctcctgctgcctgacccctgctgtgctgggagcagggattcgggacccggagtccatgtcgagaagtcgcccacacgtg

SEQ ID NO: 122905 - DNA, 309 bp, Homo sapiens
ggggtctcgctatactgcccaggccagtctcgaactcctggcctcaagcagtcttcctgtctcagcctcctgaatagctgggattacatgtgctcatcactgcacaaggctcttcttagccactttgcaatatggagtacattgttgttaactatagttgccttacactactgttgaacagaatttacaccttttacctaactgtatgtttatgccattaaactacctctcttcatcctccaccctttcccccagcctctgttaactatcattctactctttacctttatgagatcaacttttctctgc

SEQ ID NO: 122906 - DNA, 385 bp, Homo sapiens
attacttcgataaaaatggaaatatcaggccaggcacggcggctcacacttgtaatcccagcattttgggaggccaaggtgagcggatcacctgaggtcaggcattcgagaccagcctgaccaacgtggagaaaccctgtctctactaaaaatacaaaattagctgggcatggtggcgcacgcctgtaatcccagctactcgggatgctgaggcaggagaatcacttgaacctgggaggcagaggttgtggtgagctgagattgtgccattgcactccagcctgggcaacaagagggaaactctgtctcaaaaaaaatgtatcaaatataaatctagtcaatgatatgaacaaataattgaaagaagccaaatgaccactaagca

SEQ ID NO: 122907 - DNA, 251 bp, Homo sapiens
gggtggatggataaatggatgattcacctaagcactttaaatgcaatgggcccaaagcaaaattcatcaactttatcctaaagttgatccttcttcagtgctccttatcacaagttaatggattcttcttacccaaagagagccaagctgaaattttcaaagccatcttgaactcctccctcttctatcctgctctgaatattctccaaatcttgtccaaacaggtctagaatgtctctcatctctcttac

SEQ ID NO: 122908 - DNA, 409 bp, Homo sapiens
taagttttgaattcccaaatgcttaattactaatagcctatggttgaatggaagccttattgataacacaatcaatgtgcattttgtatgttatatttttatacactgtattcttacaataaagtaagacagagaaaaaatgttattaagaaaattaaaaaggaaaggaaatatgtttactattcattaagtggaagtggattggccaggcactatggctcacgcctgtaatcccagcactttgggaggctgaggcaggcagatcacaaggttaggagatcgagaccatcctggctaacacagtgaaaccccatctctacaaaaaatacaaaaaattagcaggatgtggtggcatgtgcctgtagtcccagctactcaggaggctgaggcaggagaattgcttgaaccc

SEQ ID NO: 122909 - DNA, 339 bp, Homo sapiens
atccttaataactatttgttgaatgccttgatgataaactctgcagtactttgcaaacaagatgccctgagaagtcagaagaatagatatgtctttataataaagtttaaaagttgcctcattgtaagcaggcttaataacggtaatattaataataacaaaacatttgttcaatcctttgataattttcacacactatgataaatgtactttgtgttcttcatctaatttaacccttacagcaaccctttgtgggcactgctttatttcaattttgtagatggggaaaatgaaccttaggggttactcatgaagtgggtggcaaagccatagttttaa

SEQ ID NO: 122910 - DNA, 1522 bp, Homo sapiens
  misc_feature (435)..(435): n is a, c, g, or t
  misc_feature (472)..(472): n is a, c, g, or t
  misc_feature (958)..(958): n is a, c, g, or t
  misc_feature (1193)..(1193): n is a, c, g, or t
ggaacatagctttacattgtttgactattgcccatcctttgagagtctgctgtagatgtagcagacaagaaattaaagccgccgcgcctggctcttttttattttttttcactttggaaaacagggtcctcattcgtgttcacccaggtgtgggtagttgcaggtgggtgcttgttcttcagacctcaatgtttaaccttccaaccttctcacaggctctcagatgtgtgactctcttcccaacgcttctagggcctactgtgaagttacgctgtgggacccaccgggccagccccattcaacgcagtgccacagcgattaaagctttttgggcaaacttgttgggggataaacacgattgcaagtgtgttgcggcccaattgtttgcggccccagggccggttgggtctcctctcctgtgtaacagctctcaangggccgaaatctccccacggctgtgcactcatcaaangcctgtggcccaaaaatgtgtgcgccggggagcattcttatctacactgtgggtagaaggcgccacctaaatacccccaatgcctgtggtgttgtactaggatatacttcctctgtgggttgaaacaacggaactctatgttggttggctgctcggcgcaccaagttttttttgtagcagataacacatctaaccaaaggttttgggcgggcagtggggactatatataacgctgtaggataagtgggcgacccaatgtgtgtatgttgggcggccctcacctctcctggtggtcacttgtttaaaaaggaggggcgccacccagggatgaggggaatttgttgcacctctcctacacgtgttggcaagtacgaaggtgtcccccccaaagggggatcttcgcccgcctggttggttcctctcagtggggtttctcttaccccccgccgttggtgtgtgggtgtgcccacactctttgccggccancaacccagctcctgttgggtgcgtcatccacctctcgcaaaggggccgcaggtggagggccatactacccaaattattcaactttgtcttgttggggcgaccacagacaacatgctgggggctctgtctggtgggtggggggggtcatcacacacaccaagctttctttgagtagaaaggaagcggacccccaccctgtctgcataggaattgaaaaaaaagaggcgcctagttngtcagagaaaaaaggaagacgcgcttgctatatgaacagaaagaagtatgttcgacagcccttatgtcgtggtggggggtaccaatctctacgcttttcgcttgatagtgggcggcgacccatgataaacacgcgaaggcgggggcgcgctcaacccaactcgtttgatggtctgattgataagacgccccagagtgaagatgagcgcgtcgtgtttgcgtaaacagtccagtaagcgggcgcgggggtagttacacaccaatagtagggggagggtgcttaatatatgttggaccaccccactgttacgacctctccgttggatgcaa

SEQ ID NO: 122911 - DNA, 267 bp, Homo sapiens
ataaaattaaaagctgtagtcagtgctatgaaagaaaacacagagaacactgacagtagacactctgtgtcctggggtttggaggagtcctccttgaggaactggagtttgagccaacatctgaagggtgagcgttaagttaactcagtgaaggagagaggagagaggcagggagcatggcctttgggaactataagaagccagtgtcactgaagacagagtccagggcagagggtcgacgcggccgcgaatttagtagtagtaggc

SEQ ID NO: 122912 - DNA, 634 bp, Homo sapiens
gcaggcctccatattttgggcctttctttgcttccccctgtgatcccaatgaacttgggtaccaagtcttcttgttcccattacccttttcttggaatagattttctcagataatctccatctttctcccaatctcctcttccttcttcctttttcttaaacaggatgagcctgtttactgctgggggcagggtatgtatccccatgagtcaggggcttgattggtaggggaggtgagtgttcatgctgcgtccctagacatcttgaatgtcccccaatttgagcaagtaacacatcacttagttctgcaacagaaccagccacacattggtgtgtgtttggcttgcctctgatttgatgttgctcttttctcacgaggcttggacaaaactcctgctttactcaaatcttgtttgagttaatatctcagcctccaggtgaaatgaggaatgaaatacagattttagtatctaatataaaaccataacttgtttttactctgagctccatcttgggactatattctatccagaggccctgaggaacttctctccctcctttgttttgatttattaaagttcttgaattatatcccatgttattgatctcagcaaatgtgggtttcaaaattgag

SEQ ID NO: 122913 - DNA, 534 bp, Homo sapiens
cctggttaaactctcctaccatgtgaaactgttttccagcacacaaaagaaataggatcaagtttactgatgctttgtcatgtggtatacactcagaatatctgtgttaactagaataagaaattaagacaaaattcagcaaatgtcactttcagcacatgtgagctctcagaataaagctgcagataacacgcagtttagtattaaaaagagctttaagttcatccaactctttattagcatacatgtggttagaaaataaatagcgtgcaaatatctccaacatatataattcaaccaaataaattcaatctgagaaaatacagactcagaattttagaaatcaaagatctcgtacacattaatatgttagattaattttttctcatgtatggaaaacacatacttattccaaatgtaacatagttattcaaaacatttttaagctgcttacttaattataacactggttttgtaattctggagagccattctcccttccctagagaccttcctttgttcctagtgttcagg

SEQ ID NO: 122914 - DNA, 117 bp, Homo sapiens
tgctgggattacgtagccagtgtctttcttaagtgcctgtcaaataatgctcctggtttataagtgcccctggctctaccttctgggtgctcagacaccaacacagagagaacagaa

SEQ ID NO: 122915 - DNA, 466 bp, Homo sapiens
atatcagccctacataatacaaagaaaatgacaggacaaatagcaccagtctcaagagtccggaataatgcagcaatgtcaccgttcctgagtctcagtgtagagaggcagtctccgagctgcagaagacctggccagccgagggccgcacatcaccttctggtgaccctgaccttcagcgggactgaggactgctctgcattgcctcataatggccaccggccccggcatgagagggcaggagacgaactgcaaattagcgatctggcaattatcagtggtgtggacctgctgaaacttcactagatggatcgtcacacaaatggaagcactggaaagcacgaggccgtaccagagcatcaattaatcatcaacttagtacttcctgtcatctgggcacatgtttattttacgcaatcccattttaaaatagcaaccctgctgctgtcgtacacaataccacggc

SEQ ID NO: 122916 - DNA, 429 bp, Homo sapiens
gccacaacctggaatgcccttctccacttctccagggacaaatcctttcaagatagagcttaaacccgactgcctctgcagcatggtccctgattcctctaagctcattaatccttcccttctttgtacacacctgagcctcagtttttgccttttttttagaaaagttgctgtattttactatcacgaattttttttgtgtgtgtgtgtggtggggggatttgcctcctttggtgaaccccagagccctgtggccaaggactgcgtcttagtcatcaccctgttccctccttgtttcagccaggctgttcctcactagggcctcacagccacatttccccactgcctgagcgctttctcagtgagtctgtgcccagctacggttgcctgattggcacttggacttggctgtggcagagaaaatagact

SEQ ID NO: 122917 - DNA, 223 bp, Homo sapiens
ctgaggcctcacaccacagggccaccgggtgtgcatcctggtacccatcacattctgagaggatggcttagaaagatacctccagactgggaacactggagaggggagccgtccaggggggatcaggccttacctgtggggcttaacgtgttacagaagaaacttcccaggtaaggaaggaaactgcttctctgaggtgcagctttcctggacgggcctctgg

SEQ ID NO: 122918 - DNA, 350 bp, Homo sapiens
ccctcagctttcttgtctcactctcacttaagtccagcttaaatccagccatttttaaactttaagttagtatctgttagtgtctaaattagcagctatatacgtcgagaggaaaatgcagaatcatgctgactagttttacttaaattcatggtcacaaatatcaagtatcaagtgagtccttaatactacctggcattcatattgtattttcctagattgtttattcttctattttcttagatgacttatttaatgttttctctcatcagaccttccaacatctcatcctcaatctctcagctgatgattttggttcctacctcactgagaaaattgaagccatcaga

SEQ ID NO: 122919 - DNA, 144 bp, Homo sapiens
tggaattatacactataaaatcttttgatgtggcttcatttgctcaacattgtctgagatacatccatattgttgcttacaacgtcagttttcttttcattgtcgtatagtcttctgttatatgagcgtaccacaatttatcct

SEQ ID NO: 122920 - DNA, 603 bp, Homo sapiens
tctgtgtacttgtgttctatgcgaatgctttaccaccctgacaaatggctactttcccagggaatgtaaccatttacactggtaaaaatgttagtctgcccatgaagcaggcgggaaggagagctcagtcaccaggtacccagggactgggggcagagtccccatacaaaaatgtgtccttttgtggtgaaactacttcccacctggagccaaagtctgggccagtcttagccatttctgaatgaagaacaggacattagggaagtgcaatccagaatctgagaagaagtaaaaaattctcaaactagaaagctgctgagtcaggtctatacagatgcagggtcttaaaaattgtaaggaaagaaaagaaaaaagcttttagttaaacaatggcttataatgacttctgcaaataggtgactctcggggaggtggtggaatctggtgcatcagaatctgtcacaagaaattccagcaaagcaacgggggtagaacacaggatgatttagctttctgtaatgtaagcagaaatattactttatcaaataattcacttttacaacctttctctccatccctacccccctctcaaagcagtttaga

SEQ ID NO: 122921 - DNA, 170 bp, Homo sapiens
  misc_feature (124)..(124): n is a, c, g, or t
  misc_feature (148)..(148): n is a, c, g, or t
  misc_feature (156)..(156): n is a, c, g, or t
cagccctgttaccaactaaatgagaaaagactctgaagatggacatgacgcaggagattgccgtgctgtccatctgtccatctgtagctataggggcccctcatccacccaccgcccacctggntgagtggatgggggtaggcagacnagagtcanggtggatagaggac

SEQ ID NO: 122922 - DNA, 536 bp, Homo sapiens
ctaaccacatgtgctctcaatccatcagaccctttcacatggaaccccttagagctgtaagccattaaaagggtcaggagctctgtcttcggggagctcagctcttaagatgcgagtctgctgacgctcccagctggataaaaaacctcttccttctttaatccagtgtctgaggagttttctctgcggctcgtcctgctacaattccactttcttctgcctgctttattttatcctttatactttttgtatcctcagtccaatcaagttgacactcaatattaaccatcacaaccacattctgggccattcaaataaaaaatagattaagaaatgtaaaaatactgaaattatttgtaatgtttttctgatcaccatggaattaagctagaaatgatcaaaaagacgaccaggcacattggctcattcttgtaatcgcagcactttgggaggctgagacgggtggatcatctgaggtcaggagtttgaaatcagcctggccaacatggtgaaaccctgtccctactaaaaaaaaa

SEQ ID NO: 122923 - DNA, 375 bp, Homo sapiens
acaatccctttggtcccaaagctgaaaacagctgagaaaagcacacatctagaaagggaacaagaaacagaggccaccaaagaatcttttgaatatcctgtttgctacgtttcagaaaatgtaacattggtatattataaaatagtcattttcatagaaaagatggttcttgcagcatcagtcacatctccctttaggaatcatgttggcaaggatcaggggtgtgtgtgtgtgtgtgtgtgtgtgtgtgtgtgtgtgtgtgtgtgttttaaagaagtctaattcgaaaacaaaaacgtgatattgtctctccaaaggtaaagaatgagacctttctaagataaaaaaaatttttccaaagaaaaaaagaataaa

SEQ ID NO: 122924 - DNA, 674 bp, Homo sapiens
ccagccagagccaaacccactgtgaaatgaagatcctcccagtcaggatggggcctgtgccgagactgccccccagtggcccctgtcacaactgcagcgaccccactgcccaagtggcctgtggcagaggcctcaaagtgtcttcaaggacccaggctaaggcctgctgaggcagggaggcaaagaagggatttctaacatcagaacccttccattaaacaagaagctgccccttagttacactaaatggcttgtttcctcagtgcaattaaaacaagatttaatctactcacagggctatttttagtattgtttttccagcttatttttaagagatgggtctcgctgtgttacccaggctggagtgcagtggctatttacaggagcaatcccactactgatcagcgcgggagttttgacatgctccatttccgacctgccctggttcacccctccttaggcaacctggtggtcccccgctcccaggaggtcaccatatttgtgctggacttagctgggacacctagtgggtatagtacactacagccgagaactcccgggctcaagcgatcatcccatctcagcctccagagtagttgggcctacaggcatgtgtcactgtgcctggctatctttcttttttttaaagggagatatactcacaggatgtctgg

SEQ ID NO: 122925 - DNA, 359 bp, Homo sapiens
atctatgctgtgaaaaactcgcatcacttatgggctaataaccagctagcatcataataacaaattcacacaaacactattaaccttaaatgtaaacgggctaaatgccccaattaaaagacacagacatatacaccatggaatactatgcagccataaaaaatgatgagttcatgtcctttgtagggacatggatgaaagtggaaatcatcattctcagtaaactatcgcaagaacaaacaatcaaacaccgcatattctcactcataggtgggaattgaacaatgagatcacatggaaacagtggcatttctaaataaagtctgatcacaagcttctaagtgtactaatacttacta

SEQ ID NO: 122926 - DNA, 132 bp, Homo sapiens
ggagtgattttttaaaagtgacaagcctatgagcatttatagaacaactaatatgttctttttcatatgttaaaagaacaaacacggtaattctagcaaaaaatgattatgatggcatgtcaatccagagtg

SEQ ID NO: 122927 - DNA, 354 bp, Homo sapiens
cttttggggtctttgctttttgatgaactcaggagctgatagcctttagcaagtcaacccacttctgggaagcccacccttgacaaagctggagcaattaggtttgagcctggtaaggaaaacaaaggaggaagcaaaaaacgagaagccagtgtagttggtgtcgtaggtgagctgttcacagagagaggataatgcaagtcacaaaaacatcagcctggagaggccaagaaaagtgtctcgggagaggtcttgaactgtttcggttttttggttttgtttttgtttttatggcagagtctagctctgttgcccaggccagattgcagtggcacgatctcagcaaactccgcc

SEQ ID NO: 122928 - DNA, 532 bp, Homo sapiens
cactctggtcagacaacagctagagtatctggttgttctaagtatcacatactacaaggagaaaatgacaaactaggatgtgccagtaaaatattacacagaaaagtcagctcccgaagcaattccctgctacaagtctcactctctcgaaaacttaaagaaattgaaggttagaaaacaaagtgtgcattgcatgtattttaggtatttggaggattgtgatataaaatataggggttaggcttaaaattcatttcaaattttagcattaaaagagatcctatggagcatgtagtcttaatttccaatcaagaaactgagagatagaacaattatgtcccagctgcctatggcaggtgtgaaaccacaattgaggcttcttgattcttatgtcagtgtttatatcacgataccaaaataactgattctgggttgattaagaaagcactgcacaaatattgagtaccagcaatgtgccaaacactgagtttatagggaataaaaagatagatggggcaggtcagttcctaca

SEQ ID NO: 122929 - DNA, 643 bp, Homo sapiens
ggcattggtggtccagtccagttaaagtggaaagagctcattaacactccagcatctagttaagacatcagaaagtacttactttaaaagaaagcgccacacttttagagaacgacctattctagacccacccaacagagtctaaaataaaaagactgaagcaaaattaacagagcatcaggaacttctgggagaatattgggaaccctattaaacatgtaattagaggctcagaaggagaaaagagcaagaaagcagcagaaaaagtacttagaaattaatggccaaatatttcctatatttgataataaacactgacttatagatgcaagtgctctgtgaatccacaacaggataaatgcaaagaaaaccacacccaggcaaatcagactcaaacagctaaaattcaaaattaaacgaaatatcttgaaagtggataaagcacagtacatacagggaaactaaggatgatagcttctattgaaactaaggagaaatatgagaaagtatcctttatagagaaatatgagaaagtatcctttataaacataaaaatgaaaactgaaaaatgcattaccataagacctgaattataacaaaggctaaatgttacttttcaggctgaaaggatctaataccagat

SEQ ID NO: 122930 - DNA, 333 bp, Homo sapiens
gctcggtcccatgtttacatgagggcaagtcaaagccgacagaggagaaggccccaggagagggtacaaggtaagaaggcagaccaggccgggtgcggtggctcatgcctgtcatcgcagctctctggaaggccgaggtggatggttcagtctgtttattggctgagagagggatggcttgtattgtatttcccctggagaactctgttctagagttgataaaggagaaaacctgaagaattgtagacataagggccaaagtcaaagccgacagaggagaaggccccaggagagggtacaaggtaagaaggcagaccaggccgggtgcggtgg

SEQ ID NO: 122931 - DNA, 136 bp, Homo sapiens
tggatcacagagcgatgcctgttcattcctgcttgcaagggagcagatctctcgacacccgatgggcctctattccgttccggcagctgtccgtgtcaggagcgctgggcttgctcctccccacgggagccatcac

SEQ ID NO: 122932 - DNA, 453 bp, Homo sapiens
cccgcttctctccaccccttggagacctggtcctctgcgcccgctgttggaattggacacctttagatttggacttaaaactcaccattacaactttaaaatcaatgactagatgggtgtggtgtctcatgcgtgtaatcccagcacttcaggaggctgaggcgggcaaatcactcgaggtcaagagttcaagaccagactggccaacatggtgaaaccccgtctctactaaagatacaaaaattagccagacgtggcagtgggcgcctgtagtcccaagtactcgggaggctgaggcgggagaattgcttgaagcagggaggcagaggttgcagtgagctgagatcccgccactgcactccagcctggctgacagagcaagactctgtctcaaaaaaaaaaaaaaggtaatcagctggggtctgagggaactggggacattttagcaccaaa

SEQ ID NO: 122933 - DNA, 584 bp, Homo sapiens
ctaaggatccggtgctatcgatacacccagcactctaagtgtagtaggtgtaattagagctaggtgcaggtgctgggcggacataggaaggccgggtaggccagctgttgtcaggagagtttgtaaggaatagtgaggcctcagatgagatctaagggtaagtaggagttagccagataaagaaggggctgcgtaaagagtgtgtcagggctaagagtgccacagctgaaagagcatacttctgcagtgaatgggtgtggcatcgataaacagcggtgtttatcgatgccactaacaagaacattgttagtggcttcatagtctgtggttagatttatattagctatatgtgaaaatattccatcaactaaaacccctgtaataatatccaagctctaagcgtgattgtcacagccagggagcttcttctgttccattgaccactgggtgcaaggggaaaataaattaagcacaaaagaaacaccgtcttccaaaaactagccccttcttactacagaaccatgctgaacttggcttaccttaaatcccattcttgctcccaggaactctgaaatagcagcagt

SEQ ID NO: 122934 - DNA, 696 bp, Homo sapiens
cactgcactccagcctgggcgacagagcgagactccatctcaaaagaaaaaaaaaaaatgtgtgaggcagaagacatgtgccgggcaagtcagggagcttagatgctgatactggcccagagcagtcagtcctgaatcgtaccacagagccaagcccagtggcttcctccacctcccctaggggtgctaactcattgcacaaactcttgccctttggacctcaataagacccgtgcttaaacaataaaaatgtcttggcaaggtctagatcagccaagctgttttgaaagatagtctcacttcactaaagaggcagagaatacaattgctgtcctgactttactgttaactatacgcccttgatcagggcacttaacctcttttggccccagtttccagttgttaaacaagaacattgttagtggcttcatagtctgtggttagatttatattagctatatgtgaaaatattccatcaactaaaacccctgtaataatatccaagctctaagcgtgattgtcacagccagggagcttcttctgttccattgaccactgggtgcaaggggaaaataaattaagcacaaaagaaacaccgtcttccaaaaactagccccttcttactacagaaccatgctgaacttggcttaccttaaatcccattcttgctcccaggaactctgaaatagcagcagt

SEQ ID NO: 122935 - DNA, 327 bp, Homo sapiens
gcaagtgagggtcagaggcctggcttggaggagccgcttattgtgagcctggctggggcaggcagcagcgagtgctgggaggggaaaggttccctttgaagcacatggcgctaagagcttcccagtgaccatggaaacaggcgcagtgggttcccagcctgagaaccagggagagcagccgtgattcaaacacaaaacacacacaaaggtctgaaaagcggagacaagaggggccagagtgaggggcaggcagtccctggctggcaggaactgagcggctccctggtaggaaaatccggccaatgaagccgagcaggttcacggggt

SEQ ID NO: 122936 - DNA, 439 bp, Homo sapiens
gacttctcgttaataatctagctaaatgatagaacttaaaagatctttgactagctgagtgttgtggcatgtgtagtcccagctacttgggaggctgaggtgggaagatcagtagagcccagcagttcaaggctgcagtgagctatgaccatgccactgcactccagtctgggtgacagagcgaaaccttgtcccttaaaaaaaaaaaaaatctaagactgattactaaaccattgggaacaggaagttctgggttcaatgaatttctatatattttttcatactggacacatgaaagacattaaacaaaacacactatttactagtttagccgtctcagtgtcaacttttcaacattttgatgaaaattttgatcatactaataaaagaaaccatatggtattgaatattttcagcatctaagaaggtaaatctcaga

SEQ ID NO: 122937 - DNA, 344 bp, Homo sapiens
ggttaacacagtggtcaccagcctaatgtggctatttaaatttgagttaattaagtaaaacttaaaattcagttctcggtttgcatttaccgcatcccaactgctcaatagcaacatgtggcttgtagctcctacattgctggtatagaaacagaacattgccattattgcagaatgttctgttggacagcactagcctaaagctgctgtctcagctaagtgacttctctgtaacctctgactctctgtaacttctaacttgtaacttctgtgtaacctttgaccttacaaggtaggcttggagtgcagaggggtgcaatgaagttgtctgtgatacttatgct

SEQ ID NO: 122938 - DNA, 300 bp, Homo sapiens
gaaagtacacttggaagacggccgagggggtgacttgaaagacaagtgcacggtttgaccttttgacttggggtttaatatgttggcacacttccggggtcttgcatcccttcttccctgattcttcccctggggtgggctggtcgcctgcatagtggcccgcaggggcttggaaggggagcatgcgcagtgtgtttcttggagtcatacgcatgctcacttgaggcattcttcccttaccagctcaacctccgtaagaggttataggccagttaaactctgctcttaatgcacattctt

SEQ ID NO: 122939 - DNA, 92 bp, Homo sapiens
cccgcacagtcggctgcgagctctgggagcaggaggcgcggtgcgcagcccagcccgggacggagccaagcgccgtgcgagcttcgggaggg

SEQ ID NO: 122940 - DNA, 269 bp, Homo sapiens
ctaacattaaataatgctgttgatttttacgtttataggtaacatcctataatcttgctgaacttaactattttcttaaataaatttttgttgatttttgccaaattcaaggtatataatcacattattataaaaagcaacaaaaatgcatcagagtcttagtgacaagtattaattttagaggaatgggaagatattgaaagagcctcatcctggccactgcgccattgtattaactaccatttattgtatatcatgtgcagacacct

SEQ ID NO: 122941 - DNA, 267 bp, Homo sapiens
tttccctctatagttcaggggattccacattgtatttatttgcacatgttagataatcacgtggttctgtcccaggggacctccaacgacctccaatgaggtaggttaagggaacaggatttttcaaaatcaggagaataatcagaaacataacagctgcttctattaagaggtagagatgagctaaagttaatagaaactgcacgtgccagcggccaaaatccagtttagctagctggaaaacccgacccacgctgcttgcagacg

SEQ ID NO: 122942 - DNA, 167 bp, Homo sapiens
cagcatcagcatcacctgtgaactgttagaaatgcagaatctcaggcccaccccaaccccactgaatttcttagaagctgcatccaatggaagcatctatatgaaccacacttttgagtagcaaggatctagagttcttgtgcagatctctctctctctctctctct

SEQ ID NO: 122943 - DNA, 361 bp, Homo sapiens
tgctgggattacaggcatgagccaccacgcccggcccaggactcttgtcttcttgaacacgtggctttcacagttcctcttttcattgccattctgtcccacaggaaaagggaaggacacagagaagcacacatactgaggttttaaccagccaggtcctgatggcacgtgttatgtccacccatgcctcccagggagactgggcagccatggcccagctgcagccctaactgaagaagaagggagccgtgatttgggtgggctgggcccagtgcctgcactcaccttccatttaatggaagggtctgtagtgtttcaccatcatctctaccctgtgacctccctctgtttcttgtgtcat

SEQ ID NO: 122944 - DNA, 156 bp, Homo sapiens
ctaactgcacacctttgcacttgctattttctctgcctagaatattcttcggcagtgaagtcaaatggctcagtctcttgcttcattcaccctgttcagttatcacctctttccctagtctctttctcttacctggttttagttttctgtatggcg

SEQ ID NO: 122945 - DNA, 497 bp, Homo sapiens
cgaggacacaggtgtactgcacagtgcacattaaccagtgacggatggaaaagagcgggaaagggggactgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgccacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccact

SEQ ID NO: 122946 - DNA, 436 bp, Homo sapiens
aaattcatccatcaaataaggttgcctttcttagaggcagctttgaaataaaatctaaaaggaaatattagacaaatgttaaattatattaaagaaaacagggcttgccagttatatttccccttttgttgtagggcacacatctaatccttaccctgttactgagttacagtttgattgtgaccacaaaagtaatcacagtcaacaggaatggctggcacaagaacagctggcatcaggtgcaactttctctctcctccatcctagttaagtgccattacttatgcccttacccttggattgtaccagcactgtctagccaagatagttttcctgtggctgatgaatcacatggtaagagggatgagggtggaagttgagggaagataagcagaacagtgaagatcctagccctggggagaataactgtctggca

SEQ ID NO: 122947 - DNA, 377 bp, Homo sapiens
ggagcattattttgacaaagaataaaaagtggaagaggaattttatttggaatatatatttgtagtatttttgaactctgggtagttcttggaaatgaaggtttgagggttagaaattaatctcgtccttgtaatagtgcaagtttttggaggttgggctctgaagcaataaagggcaagcctatgagatttcgccgatcacgaagcatccagtcataacaagttttattccttgaaagtatactcttcccctaaaagcagcttaatcaatacttcccttatgggacttttaatgctgccataaatgagtgagagaaaactcacagtactctctcaactatcttcaaataaaaatttgaagaagtctaaatttctct

SEQ ID NO: 122948 - DNA, 484 bp, Homo sapiens
ccaaatacagaaggaaactagtcctttttagacattcaaaaactcagaaattggggaagtacttaaggatgtactccagcagagagagaagggtagaagggtggggagagggagaaagcacaagccaataaagagaaggaggtgatataatgggatatttttaaaaactggagtcaatccaaaagtataattagacactggacagcaagcctagaaagcaatcagtagaaattagaactccaagtatgtggctctgagaaatttttttcacaaaacttagctgggtgtggtggcacatgcctgcggtcccaactactcaggaagctgaggtgggaggatcacctgaacttggggacatcgaggctgcagtgagctgtgattgagccactgaactccaaactgggtgacagagtgagcacctgtctccgaaacacaaaacaaacaacaagagggaactaggcagatattataacgggttcaaaag

SEQ ID NO: 122949 - DNA, 394 bp, Homo sapiens
tttgggagtttcgcagtttctagttcttcctgaggcactgtgtgggattccatctcatccccacgcagtgtgacatttgggaaccagacaagcggtctgttgcgttagaaggtgcccaggggaagatccatggacaacccttcacctggagatttaaaatctacaataaagaaagcatcttgagacccctgagatgcgtacctggttttatggccagagcagcgtccgcatcttcatctctctccattggctctcccgcgatgagtgcctcctcatctcatgggggccctcccctctgcccccagccgcatggcctcttttcgattcttctctgtaacctgctatggtttctgcagaggcgccccacctgcctgccatggagggcccttcctgc

SEQ ID NO: 122950 - DNA, 889 bp, Homo sapiens
ctcgaactcctgacctcaggtgatccgcccacctcggccttccaaagtgctgggattacaggcatgagctactgtgcccagcctctatgatttcaattttcatgtttaagtacctatgtagaacctaactgtccataagtaaacacaacaaaaaaaagatttggcttttggtcaaagatcattggaggttacacagggtaaagtgcagtatgatttttatcacaattagaaagattaaaaagagatgacagtgagtttgtgagaacaggtttgtgtttcataaaatgaattgtgtgagttagctatgatgaactgcaagcagcttgcatttccaaagacaaatagagacacaggaatctaattaaaatgctaaagtaatgggaaggagacatccatacgtttttgtccccctaaggttccagatttatagtttgagcatcatctcggcttacattttctctgtggaaaacatcagccattacattacttggctctgggttgaaatcctaacttcatcaactgaagatcttatgacctaggcaagtttattaacctcctctatgacgtgataaaaatagtatctcttgtgcggattagaagacatgttcctctatgctaagatgattattatgtgcggaacacatagttaagtgcttgataaattgaactatggcaaatccagtctcaaccgtggcaaaactaagttaataaaaatgaaacataacctttattattttagtgcttgtgttttattttaaaactagcagtataatttccacgaggattttgctaaaattaacaagtacatttcgaaagtaatttctgtccctcttgtatcacacaaacattacaaccaaaaagtaaaaaacattctcccatgacccaatca

SEQ ID NO: 122951 - DNA, 223 bp, Homo sapiens
caacacttccttaggaagaagttttgtactttgaatacatggaagctgtcctttcacagcagacaatggcttcattatacaagaaatgtggacttaggttctccctatttcttcaacctgcttcagcagagccattgtctgctgtaaatcttcaaaaacaataactatgtcttgattttaagttttttattgcaagaagagggagtggtccttcaatgtattt

SEQ ID NO: 122952 - DNA, 417 bp, Homo sapiens
aatttcctaccagcagtaatacaaatgttatcaacacatgtgtaacctccctttactacagtgagagttgtttgggtgtccatgcacgggagaaaagaatcccaagaacatacatccctcttcccaatttacattttcagtatcctgaatttaagcttgttcaatgaatctgacagggagtgctactgaagtctcaactccaaataaatagtttaaaataaaaagttgtataaatattagtctgtgccaatggtgcggtttgagagggagtgctataaacacaaagtaaattaaatgggatctacttttgtggggtaaaagcctacttagactggttattatagagaaaattttgttgtgtggtgcgacagcacgtacccatgtggctaacctacaactgctagaagaaacaaatcc

SEQ ID NO: 122953 - DNA, 834 bp, Homo sapiens
gagaagatgagaggaagacatttgtgcctacaaaatgggatctcctcttagggctgagaaccagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatttctgtgatactttgacataataagcattaaattaggccccagactttctgtctttattatgctttcctataacattgttgttttgaaatcatatagttcgatattcttttgtagcgtgatatttcagtgaatcctgtctagttttcttggtgttttaaattatggcctacttcagatacgattagctgttaggtattgaggatcatacgtgttaagtatttgttgaatgaattgaatgattacaaagatgagtctagttattaaatcttctgtccttttgagaggtaccctatattaggatactgcagtccatttccagtttgtaagatagtaattcttaaccttttctaggccactgacacctttgagaatat

SEQ ID NO: 122954 - DNA, 399 bp, Homo sapiens
aagtgaggtgtgctactttgtaactcacatctttattaacttagtatcatgtgtattttccatattgatgcctttttgtgtactgattgtttttaaatggcacttcgcggaaagaaaatctgcacaatcacattcctattctccaggtcccagctcttatcacaaagtcctctgtagatatcctgttaggcaggaacaacaattattagacttccatgcggagataaggcctttgaagaaaaataaaatgggacaaggggttagagagtgcctgaatgggggtagctgatttagagaggaagtttctccaggggaacactggagcaggggcgtgcaggaagctgaggcaggaaccctgtgaaggtttggggaagaatattctagatggagaaagtggca

SEQ ID NO: 122955 - DNA, 273 bp, Homo sapiens
ccaaatttagagtcctataaagagaaacacaggcacagaaaactctgtgggctgcgccacagtctaaatccgatgatcatgatcagtgtgacatcatcattgggtagaatataaacacttggtctgctggcaatcaatcaagtaggccatccaaatcaaggaaacagcagagtcccacaatcatttgttccttttgcagacataggatggcccatgcccaaacactaagcatccacttccttcattttaagagtattattcaaatggtcacac

SEQ ID NO: 122956 - DNA, 676 bp, Homo sapiens
cgcagtggctcacacctataatcccagcactttgggaggctgaggcaggtggatcacgaggtaaggagctcaagaccatcctggccaacatagtgaaaccccatctttactaaaaatacaaaaattagctgatgtggtgacaggcacctgtaatcccagctatgtgggaggctgaggcaagagaatcgcttgaacccaggagtcggagtttgcagtgagctgagatcgcgccagtgcactccagcctgggcaacacagggagactgtgaaagaagaaagaaagaaaagaaacaaaggaaagaaagagacagagagagagaaagaaagaaagagagagagagacagaaagagagagataaagacagaaagagagagaaaaagagaaagagagagagaagaggaagaggaggaagaggaagaagaggaagaggaagaagaagaggaagaggaagaagaagaagaagaaaagaaatagaaaagaatttcaagttaatgaaatataattcatgagtttttgctaactaagcattttgtcaggccctgtgtaggccgtgcacatcaacacagtgcccagcaatcagtgtcctgctctactgcagccctccaggctagagcaaattcctgtagttctgctagcatggcatcctttttactgacaccaaaaaacaaggcagaa

SEQ ID NO: 122957 - DNA, 208 bp, Homo sapiens
acaaagtctgagttttatgtaaaacaagtttatgtttggaaaaagttcaaggtgcccaacagatgtgcagccttaacagtaaccctcttaaaattcttgaccctaaggagacaaccctcaaaggggaggagctgggcaaagatcagggcgtggcctggggtggaggaggggaagacacaatctggaaagtcaataaagagaggaagag

SEQ ID NO: 122958 - DNA, 322 bp, Homo sapiens
ttaatacaggctaaggctcagagttctcactcagccagcctgcattatttcagcagcatctgcagtggtgcgcttagatctgaagtacagccagaagacctgtatttcaatctctgtttcatcattaacaagatatatggtcttggggatagttctctcctctgtaaatgaaggagatgctctaccactgtgtatggttatcgtactagattgtgtgtatccagttctgtgcctctagacagcattgattatatgctctatgaactccactctgtttgcttctggaggacacaggaggtacgggcagcagatgggtgaggtt

SEQ ID NO: 122959 - DNA, 598 bp, Homo sapiens
cataatttggaaagtgcctagcacaatgcctggctcaaagtgagttctcaatggctgatcactaccactattgtaatttatgtcattaatcttcctggttcttcccagcgtgggatcagaagggggagagaatacttgggcacatggaaatagaaggatgtatgagaaccaggctggtcatgtagcttgatgccttttcttcctgtcctgggcaaggaatggctacaagaggttactatcaagagttccaaagtaaggagagatggactcctgccatctgtaaagaactggatattttgaatgtttaataaaactctttttaagataaacttttatattgactgcaaaaaataaaaaggaagctgcataaggcttgatagggcataatttttttcactattctatgggtaaagccataataaaataaacaacttgattatattgacaaaaagtgtttataaagatatatttaatgccatgaaaaaatttcagtagataacattaagaaaaaaacataagagagagcagctttaacattatatatagtttgtgcttaattgtatatgcacatacattataaactactaagcaaaaaaaa

SEQ ID NO: 122960 - DNA, 357 bp, Homo sapiens
ggcaagagtgagcatggagtataaggttacaggaagggccttttaattgaatgggagctcttcaagctgttcatttctcaggtgtgttctagctgaggcaagaagccagaaaagtatagtgaaaagaactggagaaagggagtgattccgaggggactggatggaagggctagaggccaatgcagaatgggatgtaggcccacctgttagaatggctgttctcaaacagtcaacttctagcaagggttggcgaggatgtggagaagcggaatccctgtacactgtagatgggaaggtcctccatggtttccacatcctctctccacctcccacctcgcctcccttggcctgctccat

SEQ ID NO: 122961 - DNA, 580 bp, Homo sapiens
gtcccccatagaactgaggctgggtggagggccccgggcagtctaacgggttggccttcaggcagattttcaaataaggtcttgcctccccaagcgtccctgtcacatgccttgcccctcttttctgggttgagggtaaggagatcggaggagaattgaaattatcctcttaactttgagaaacgtccgaccctattcatgtaggttacttactttacccatgtttctaatctgccataaatttttcttctggtaccaaaggtccgttggaaggaaagcatcaaacacccaaatgtgactttgtgtctttggtacatggtgttgtccaactctttcatttatatgcatttgaagaagagaaggataggaagtaattttttttttttttgtctttgacacaaatattggtgctaagcaacttaagagagtctggccttacagaatttctgaaacaaatgtagtttgagagggaaagatgctttcttttaggataaggcactgccagctatccttagagatgagtgattttggaggtgaaagtatatagaaagatctagggagaaggcagtgcaccctggaa

SEQ ID NO: 122962 - DNA, 310 bp, Homo sapiens
ctgcctcagcctccagagttgctgggattacaggcatgcagcaccatgcctggataattttgtattttttagtagagacggggttttgccatgttggtcaggctggtctcaaactcctgacctcaggtgatctggccatctcggcctcccaaagtgctggaattacagacgtgagcgaccatgcctggcagaggtgtcttagtagactctgcctcctctagactttgctataacagtcctgtgtcctttctagtctatcctaagacctgtccaggttcattaagtcattataagacaaactatacgctgg

SEQ ID NO: 122963 - DNA, 365 bp, Homo sapiens
tttacatgaaccatcgagtgcaaggttctcctcctgcctgaacactggagccaatgaggatcttttgaaacatcctgatgcttgggcccaactcagacaaacagaatgcagatggcctggcggagatctaggcaaattggtactttttaaaatctccccaggagattctgattcacagggagggttcagagcacacttttggtcccatctctgatgcccttcagctgtgtggctgtgggaacagtgccaaagctcaccctcccagccttgctttctgcatctgtaaaatggggatgacgatcctagcctctcacctcccaaggttgtcacatgcaataaattaaataaaagatgtaaaatcttat

SEQ ID NO: 122964 - DNA, 668 bp, Homo sapiens
ttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgtagtgcatggctgacactgatgaggaagaaggcagagcaccggaagagaggaccttgacctgagccttgaccaaggccattgctaaatgcaggtaggcctgtagcgcacaaagaagcatgaaaaccaggcaaggttgtgcaggagaaatcaagggcagagcttcaaggagagagggcgtgatcaaccatgttgattgctctgaggtgtcaggaaggaggaccatagataagtgatttatgggtcaggcacggtgattcatgcctgtaatcccagctctttgggaggccaagactggcgagtcatttgagcccaggagttcaagaacagcctgggcaacatggcaaaacaccatctctgcaaaaaatataatcagcctggcgttgtggtttgcctgtagtcccagctacctgaaaggccaaggtgggaggatcacctgcacctggggaggtagaggctacagtgagccctgttggtgccactgca

SEQ ID NO: 122965 - DNA, 625 bp, Homo sapiens
gactacaggcgcccaccacgacgcccggctatttttttgtatttttagtagagacggggtttcaccgtgttagccaggatggtctcgatctcctgacctcgtaatccacccacctcggcctcccaaagtgttgggattacaggtgtgagccaccgcgcggcccatttatgtacatcttctcagtcacttatgcatcagtggaaactaagttttaggttctgttcaaagagtgactttcaggagctgagagcttatggagcagaggccatgactgccggggagtttcggccgctgggctttgcagccaggtggggctgtctgtgttcaggcacgggagtttctactttagccaaaggagacggagctcccaaatctccctccctttcctggctctcagtgtgaatgggtggcctaggtaccctcgcaggttgcggagccgtgaccatctgtgcctcctgcgtgaggtgggcttattagcctctgggagcagagggtgcatgacaggccccagctctgcccagccttgagggctggaggagggcgggggcagcttctcctcagtccagctcctgggatccctgcatggtccctctcagcccaggtccagaggccaggccaggagcct

SEQ ID NO: 122966 - DNA, 231 bp, Homo sapiens
cttcaattgcatggacttaaggttaggcctatccttatgtcattcccaccctcttgcatgctgatgtgttttctcaaagggaggaggccatagcctgcagcctggtggttactgacgaccagtgccaaggaggcaggacccctgagcagaggaagtgggtcacacctggggatggagcctggcatttagatgatgatggggaaaagattcacagacacctagttctgcata

SEQ ID NO: 122967 - DNA, 449 bp, Homo sapiens
tagggacgttaggaagaacattaggtatgtctccctaattgcattttattatactcttctgtaagagcttatgatatcttctaaataagtgtggatttctctttctgtagacaatggaagaaacgtagaaataaatagtcaacacacagctatctctatagaagtgctagatattatgtttgacacacaaagtgatattcagtatctggaggagctggaagaagtgtgttgtcttcagagatgacaatgtccatggtgtctttaaagaaagaaaggtcagaatctaaaaagtgtggccgggcgtggtggctcacgtctgtaatcccagcacgttgggaggccaaggctggtgatcatgaggtcaagagattgatatcatactggccaacatggtgaaaccccgtctctactaaaaatacgaaaattagctgggcgtggtggtgcacacc

SEQ ID NO: 122968 - DNA, 293 bp, Homo sapiens
cccaagaacggaggccagggtcctttctgtggctgggaagttaccccgtggctgggacttttcatagcagaggaacttcacagcagatttttgtgaatgtttggcatctcaaacacatacctgggcagacttcaagttagttactgaccccacaactttctcggcttcctggggaaagggaagtctttcttgcctgcccctccccgccgacatgcatacccattcacacaacttctgctggggcagcaaccctccaaccccataaccccttgagtgatccccagattagataa

SEQ ID NO: 122969 - DNA, 822 bp, Homo sapiens
catcatcaaaataagaaaagggacacctgagctctctttcgtacactttcccatggattatttgccttcatatgcgctttccttgcaaaagagagaataatttttgtatgatcttcaaggagggaaattcttctctatcaccttaaagaatgataatgttaagggagggattgtgtcatattcatctctgtctctcttacaacatctgggcaatgccttgataatcactcaataaatgtctgctaaattgtctgccacatattgcagacactttcattaccaataatttcaataatacacagggagtatatgggtaggtgtaattaagcagatccttccaacaaacagaagagaaagcactgtgtactactcactataccacagtgaaaattgtagagaatttggaccaatgaatttgctggctaaaaacatgaggaacatgtgtttaagtcttcctgatctgtagattaaagacagaaataccttaatttattagatgggataagagaacacaactaaagtgcctagcacattacttagaaactcaagaaaatgttaggactctctcctacagccaaaccacttgtagagtatgtccaccaccttggaaagtcagctgtcacatttcagccttacattactttagcctgtaagtcacttgtcattatacttcagcaaggacactctattagtctggaatcatttgcacagcctctgcaatttcaaagcccataaccagttatttttgtcctaggacataggctgcaaagatttataagtaactggactaacttttcttttccataattttaagtatgagaa

SEQ ID NO: 122970 - DNA, 272 bp, Homo sapiens
actctccctgtcactctgcattccaaccactctggcctcactcagctccgtgtcaatgccaagttccttccaaccatagctccttcacagctcaaggctcaacatgtggttggttcatagagcagtaacataagcatcaccgggtagcttcttagaaatgcagaatcaggctgggcatggtggttcacacctgtaatcccagcactttgggaggccaaggcaggcagatcacttgaggtcaggagtttgagaccagcctggccaacatggca

SEQ ID NO: 122971 - DNA, 155 bp, Homo sapiens
ttattccttatgacttggcctgcactaagttttaatggttgcattcttatacatgtgactccccaagggaagggcatgttatgctctgctgtttgttttttagagactttatatttttagaacctttttaggttcacagcaaaaaagaaagaccc

SEQ ID NO: 122972 - DNA, 636 bp, Homo sapiens
gagcctagaagcaaatggtatttccatcaagaatcgtctcatataaagtagagcgttttggaaaatgaagttattaatagataaaaacatgtttatgcagttggtttctaagtatgacaaacctatttcttggtaaattgcaagtccattccacctgtgtttgtaggctcatttgcctaaaagtcttgggattttttctgatgatctattaaattttctttctgattatcttttctaatgctgtaatagcatttctaacactgtaatgaaagagaacaaaagtacacgcttgctcatcatttactaattctaaaaatatatattgaatacatctatgtagcaggtactgtggtaggtgtggaagatagttgagacaggtaacaagcccaacattacggagcttagcatcaccacctagaagagtttttaaaaaacatagataagtgaataatgattataaagacaaagagattcttgccatataattacatataagcaaatttaggatgtgatgaaagattttgatattggtcttctgatttggctgtaggatgaagtgtttataagtcatcccaaggaagaaacaattcagatgagaactattcaatggatttgcaataacaatccaaagatgga

SEQ ID NO: 122973 - DNA, 827 bp, Homo sapiens
agagaatgggcttgcctgatgaacgggagagaaaagaaaactctaggtaggagtccttatttattttctatcactgctgtaaaaaaagatagctgatttagtgacttacaacagcacaaatgtatgatcgtcttactcttttgtcagaggtctggtacaggtctcactgggctaacagcaaggtgtctgaggactgcattccatcctgtttgaatgtgttttctctctcattcaggttgttggtaaaattcagttccctctggttctgggctaaggtcctcatttgattaacggttgtcagctgagaccctttcccagtttctagaggccacctgcattccttggcttggaccctttgtctatcttcagagtcagcagcaaaggggtgagtccctctcacacttgggatgtgtcctgccgctgcttctattgctgcatctccctgaccgacacctctttgtatctcttccattctttctttttctattgaagtgaaattcacataacataaaattaaccactgtaaagtgaacaattcagggacatttactacatccacgatgttgtgcaaatcacattttcatcacttctaagtaaaacccctgacccattaagcaataaaaccaccattccctcctctcccaagcccgtagcagccaccaatctactttctgattctatggatttacctgttctacagatttcatatcaatgggattacacaatgtgtggtcttctatgtctggtttctttcacttagcgtattgtttgagaggttcatccgggccatggtgcgtatcagtacttcagacctttttgtggctgaa

SEQ ID NO: 122974 - DNA, 211 bp, Homo sapiens
tgctcactgtggtaggcagaataatggcccctcaaaaaggtccacatcctaatttcgaaaacctgtgaatatgttaccgtacacggcaaaagaactttgcagatgtaattaaaactggcaaaataatggtatcaacaaccaaaataagaatactggggctaagcacagtggctcatgcctgtaacaccagcggtttgggagaccaaggtag

SEQ ID NO: 122975 - DNA, 719 bp, Homo sapiens
gtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatccta

SEQ ID NO: 122976 - DNA, 374 bp, Homo sapiens
ctgcctcagcctcccaagtagctgggattacaggcatgcgccaccacacccagctaatttcgtatttttagtagagatgggatttcaccatgttggccaggctggtcttgaactcctgacctcaggtgatccacccgcctcagccccccaaagtgctgggattacaggcgtgagccactgcgcccagccttatcattattctttagcgtaaaggcactgtcttaaaagatctactcatttagtgaagatacattaactagttggaataacaaattaagctttaaaatacactagtcttacgtaaatttatcagataatttggctgccacctctgagagcagagttttaagaaaatggatgcatttaggactatg

SEQ ID NO: 122977 - DNA, 244 bp, Homo sapiens
tgcccgggctggtctcaaattcctgggctcaaatgagcctcccaaagtgcgaggacctagatcatgttttgaagctgacttctttccctgaatataatgccttggaggttcatgcaatttgttgtggatagtatagatacttggttccttttaatagctgagtagatccctttatatgaaggtactgcaatttatttatccagtgtcccattgaaggacatttggtttgttctactttggaggt

SEQ ID NO: 122978 - DNA, 746 bp, Homo sapiens
aatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagagaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaacctggcctcagatgtgtttattcttgctatttaaaaatacctttaaatttcacatgctggcctgcagaacttgcatcctttgttctata

SEQ ID NO: 122979 - DNA, 826 bp, Homo sapiens
tgcctcgccctgcttcggctcgcgcacggtgggcgcacccactgacctgtgcccactgtctggcactccctactgagatgaacctggtacctcagatggaaatgcagaaatcacccgtcttctgcgtcgctcacgctgggagctgtagaccggagctgttcctattcggccatcttggctcctcccacgtttcataaatttctaagatcagcaatgtgggagacaggagcttcaccttcaggctggattccatgatggagaaaatacatggagcagaccagcagttatttgcagctatcatgtgagagatatttcgtgattagggttgacttcagagtcagaactattgccacaaagcaaaatggaactattcatgccaattcttcaggattgaagggatcagaaatctgtgccaaggactcttagcatagatccacttgacatggagatccactctactgaaatggcagtggtatcatcagaggcacagtaacatccagacgcaatccttactgcctgtggttcctagatacctagatgacagtttgaagacttcactacgggggccagctggtcattccaaagatgtggctgtggcattccacccaggaagagtggcgggccactgggaccctgattgagaagattacctacgcgagcatgtgactggtgggcagaactaccagaccatctaggtaatcccttgtgacttttgagcgttggcaacctactgttactgtcagaagcgtcctggagcccgaagcactttggccccaagtcctacattcgtttacccactcacccagatatgaatccccaagcagaa

SEQ ID NO: 122980 - DNA, 795 bp, Homo sapiens
accccggggcgctggccgcggtgctgaaacggcgccctccgcggacggaggagggggcggggctctcgggagccgtgagccgggaagagggagacgggcagggcggcgccagcaggccctggtgggcttgggaggaggcaggagactggagacagcctcggctagagcggacacaggcacctggcaagctttccttgaccaaatcaaggttgtccttgtcctattaagcctcttccccttgccttgaagggacctcacctggtgccctgacctcagcctcctccccaaaccccgctggggagtgacctgcttctaggcctccatccacaaagctacggacttgcagcccacgggaccccagcccagggcctgctgccctcaccatggtgaaattgctgccggcccaggaggcagccaagatctaccataccaactatgtgcggaactcgcgagccgtgggcgtgatgtggggtaccctcaccatctgcttctccgtactggtcatggccctcttcatccagccctactggatcggcgacagcgtcaacacaccgcaggcaggctacttcggccttttctcctactgcgtgggtaacgtgctgtcctccgagctcatctgcaagggcggccccctagacttctcctccatcccctctagagccttcaagactgccatgttctttgtggccttgggcatgttcctcatcattggctccatcatctgcttcagcctgttcttcatctgcaacacggccacagtctataagatctgtgcatggatgcagctggctgcgg

SEQ ID NO: 122981 - DNA, 505 bp, Homo sapiens
tcagtgatttctatttccagggtatcctgatctgctgtgtctttagataggttgccggcaagaattataataaaccaccaaaatctgccttaagttgattagaaaatacaggcaaccagagtaattaattctgccagcatagccttcgaaatacaaattttggaattgaagggaattggtgcaatttggcaaaaaaggtttgtggttagacagatgaggttcaaatgctaactttggaactgatgggctctttgagcaggtgatttagtcacttgagcctcaattttcacattcttaaaatggagataatgatatgacttcacagggttgagagttaaatgagatactgtgtttaaggcctagcactgtaattagcacatcataaggattcagtaaatgatgcctaaaagtaataaagttcaaatgcagtttggatggtgatatattaaaagaaccagatccctgtttctcaaaatttaaggtgtttatcaatcggggactttta

SEQ ID NO: 122982 - DNA, 130 bp, Homo sapiens
tgtggtgggaagggggttttctgtcaagggattaggttcccctggggcctgtcctgcctcctccatacccaccacttactgcccctgtgagctggctctacgctttggctttgaaccctgtacacagagt

SEQ ID NO: 122983 - DNA, 214 bp, Homo sapiens
ttggagactttcaatggcaactgtaacaaactctgcttagtaccacagttggagaaaggtttacaataatgcccagtacaaaatgttattcagacttactactcatgcataaaataaaactggttctcttcttaaacttcgttacatattagataaaacactatcaagttttggcctcatttgttcataatatgtaatttaattcagttgctca

SEQ ID NO: 122984 - DNA, 293 bp, Homo sapiens
tgaattttctgtgtctagcataaagtttggcacataataagtattcaatacatatgaattgagtgaatagatcaatgacttgtcaaaaatgcccatattaaatatcaatgtagctaaaattcagctgtgaggaggaggtagatagatgataaattaagttctgaaagaacaccgagattctgcttttccatgtgaataaaatatgggggtctgaaatccactccgcaacgtcacagtaccagttccttctggaacttcttagtataatcacgtcctgcttttaagactgggct

SEQ ID NO: 122985 - DNA, 149 bp, Homo sapiens
tcttatttctaacaattctgtttctcctcatttactattaggtgttttactaaccactgtcctgtttaagatactgtttttcaattttccatgtatttttgacacatttctgtaaatttcttctacaattgttttagagatgacaagta

SEQ ID NO: 122986 - DNA, 201 bp, Homo sapiens
ttttttattaagaagtgaaatggattttaaaaagatcaactaagtctatttaaaaataattctccttcaactataattacttcacggtaattctccagagttcaggaaaattagagagaactagtacccactgcagaatgatacaaagggcaggccaagcagctggcttttaagtcaaagaaaatgctcaatatggctgtg

SEQ ID NO: 122987 - DNA, 473 bp, Homo sapiens
atgaaaacaaacaaaaaaattaatgtattataactcactgaataaagtatcaaaccaagagtccatattgataaaaattaatttgattttatatagtttcaaggcacctcaccatgaaatgtttattatttgattagagaacattctgttacagtaaaaaagcctgacagacaccatcttaagtcacatactacattctgacgattcttatcgattcatttgacttgtctgcaagttgtctactaagcagtatgtatctgctaccacctatctgcctgcctgcctatctatctatctatctatctatctatctatacatacatactatttatctatctatttatctgtctagactactctctctatatgtggtgctccccttttctctttcaggtgcataatatagtattaatcatagtatttgattcatgattcttattattatcgatccatgacctactttggcttggcta

SEQ ID NO: 122988 - DNA, 230 bp, Homo sapiens
cacccacctgtcagccaaacgacatcccttgcagcctttacaggcaagtacttgtctcttggggtttgtccaaataatgtcactgtggtcacagaaatcacagagtagtgacactcatgctgcaggcccaggctgggggtgcatacctgtgttcttcttgccgtgctttggggtagctccccccgcctttcctatctgcactggaacagtgtagacccagacattagaat

SEQ ID NO: 122989 - DNA, 1021 bp, Homo sapiens
gcaattcagccatatcttcaggctccacttctaattctagttctcttgctattgctaccacatctgcagttgaactcagcttcttccaaactcctgtcaatgttttgacctcctcccatgaatcagaaatgttcttaatggcatctagaatggtgaaactctgttactttgctcagatccaccaaaggaatcactgtctatgggagctatgtgtaggagattggtcactgtggtgggaaaaattgtagaaagatgcaaaccttcttggaaggccgggagattttacaaaagcttcagaaaaggatttggctgaaggcagccagattctctcaccctgtgcctgaacgcttaggttagataacaaggagatgtaaagaaactgatctagataacttagtttacttagtagaacctggcctttaatcatctgagtgcaggactgctggggctgtgtgtgtgtgtggggtggggaaggggggaagcaccatgttaattacccaaaagtgtgttgactcaaggcctttgtcattaaatctgtataaataaatgcctgcagcaccagcttgtcagggccacagctgctacaactctttacaacaccctccttggggtacatgagcagccgagtctcctagcccactctcactggatacctgtgtctgagtgcatccgttcatccatcgcttggtcggggtctgtgggtcagacccagcaactatggccttatgaaatgtatttcttaaataagacttgacagtcaaaattactctttgattcatgggctgcagaataaatgttgcatttgcaggcatgaaaacattattctcatcacacacctccatcacagctcttgggtaaccaggtgcattctcaatgaaaagtaatattttgaaaggaatcttttttattaagcagcaagtctcaacagtggaattaaattattcaataaaccatgttgtaaacagatatgctgtcatccagcctttgttgttccatgtatagagcagaggcagaatagatt

SEQ ID NO: 122990 - DNA, 452 bp, Homo sapiens
tggcagtacggatgtggtctcttttatgatagctatggggatagtagacatgcataacatgacaatttggtaccgtttccttttaaaaacatatcgtataggtctgtgaaattccctcacgaatgagatgctcatgtgacagcctcgtcaagagcagcccctgctgccactacccccacttctgtgctcttcagcattttttacacttcctgcttaaggttgtggatttgccagagagggagaatgaggaggaggagagagcaggaaaaatgataagtgacaacccttagggcagcagtagcttttaaagaaaagattgtaattctgttgaaaattgctggagaagagtgtgcagtccaaataggcatatgcaaattatatgcaaatcacacccagccctcctatttcataacctggatgtagcccttgggaaaatgctaatggagactagt

SEQ ID NO: 122991 - DNA, 371 bp, Homo sapiens
tatctgctagctagatttggcctgaggggctccagtttgcaacctctataagtgaatctcaacattctttcataataggtaaaggttgtctcaactacagctatccagcctaaatatgtttttgttttttttttttccttaagaatttcacagtagtgagatgctgcttttggtatgaggaaaagcaaatttagaagcttcattgcccaggtaaaatgttgctgggtcataatatgatggtgactctgatttcctgtggatctgtgaagttcagtattatacttattttctccagtaccccaggaatttctttatagctgtatggggtaaatattgtcctaagatttgataaagcaaaaaaatcttttttt

SEQ ID NO: 122992 - DNA, 690 bp, Homo sapiens
ctatcctctctgttttctctaaacttggatttgggtctaaaggcttgaatatatttaggtttaatatttttttgacaggaatacttcataagccatgcagtatgcttcattgcatacaacatccaaaggcacataaagtaggcttgtcttattaataatcctaaatttgatctcttagataaggtggtgacaagctatctttccattgtaagcatttccttctgcaattagcaagtcatttgtggtgtgatattttggcattagtagttggtaggaatttacctgcagtaatctgataaacacagttgggagcagtcgtttaggtatggctttggaagttaggaagaagaagaagtggagacaattctggaggaaatactaacccatctactttagggaacttggaatgcttctatgtgttggcatcagagcctagggagactaggagagaggaggcagaaagtagatgtcagaaagctttgccttctttgaaagtttgcttaggaccattttagccatagtaagctatggtaaatagaaaagttctgaagtagtttgatgttggaggattgcaagtgcttcaactggaacatctgtccagttaggctactaatccagtcctttttcattccagtgttctattaatcagcattggctcactgaaatagcagttttcacaaatgaaaagtc

SEQ ID NO: 122993 - DNA, 343 bp, Homo sapiens
atgatttccttgtaagtctgtagttacatgtttatattatttggcaactttttcattcctattgttatattgctgtagtatttagtcgatctagtctatctgatatttgcaagtcttctttgaccttgtttatatagtctccaacaaatttgaatacttacagattgatctttattagcagcgcattctataaaaggtgtggatttcaggattcaaggaaatgttaaaggcaaagtttaactttaatgttgtgcagttgtggggaatgatttttgtattagttacttaaaatttaatttcttttccagttttgggaatatagataactcacactaatttggtt

SEQ ID NO: 122994 - DNA, 415 bp, Homo sapiens
cttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctg

SEQ ID NO: 122995 - DNA, 2092 bp, Homo sapiens
ctgaattgggtattactaatagtagtgataaattccagggatcatctcaaataaacttccaggtctatagttctaaagattaatttaataactttaatagtggaggtaaatagaaatgattgacattttgtcacatggcattatattttgatttctcataattcataccacgcactattcttccccttttcatttcctcacttcccattcttccccttcatcttttatctatctaagaaattctgtctccaggctgccagagccataaaagtatcaccaacaaacaataatggcaataacagcaaaagcagttggaattacttctgctcatttacaggcatatgccacaaccacaaccaagacccaaaatatatgcttatttttgcaggtgcacttctattattctaagactttatgataaacattttaaaacataatttaggaattacccatcaaactccttttcttcagtgaagcagagggaacatattgctctttaaaggaatgaattcttccggagcatgctggtatttgtgatggttttgtttatttcaaagactaattcccacttcaaatagaattttcaggtaaagaactaatttctcttctaacatccttggaaactgggaactggaaattgattgacataagcttgcataatgagattgaacctaaatgcacatgcttctgagaatatgtgatgggtttgacattacttttaggaaccaagctcttgacccaaaaagccacttgcttgttaataacactcttatgaaatacacagaagttcattatcccttgggacttcaaatcaccctgcaaatacctagtcagtcattctgtgttgaagtcatttatttctccttagtttgaatagctagaatcagatctaaatgttctctctaaagaattgtttttaattgaagaaaataaacattcttttaaaatgttctggtgcattcttttaaatacaccagattctaatttactttgcatgaacaaagcgcaaatatcagaaatactaaaatctattttgaaagtttgcacatagtaagctagtccagaatctgaccagaaatacctattttttacctttattatttgataatgctggcagcatattaaaacagtccaatatctgatgagtggttcaaaactagcaaagtatacaattatctaatctgaaaaaccactttttattgattgatttgcgtggtttttcattctttgaaagtagagatcttgactaagacattcaatctgcgtagcagtcataaaatttagtatcccctttgtgacatgctgtgtgtggaagggttggggaggagctattgataatttcttaggacatcgagcacaaaccaggaccatcctgagcaaagtatatggtcagtatatacttaaagacagtttatagaagtgatgataaataatccaaagatggttctattgtcataaacttgagcaatttcccccccaacactcacttaattggttctctccaataaatattctttctttaaaagtttcaacaaagttttaaaggtctaacttttacttttgacttattcgttttgcctggaagcactaaggcttacagtctgtggtgactggcagtaagaatcaacatggttttcctttttctttttctccagtgaaaactatttccactttaagtcttctgcacacggcaattaatgagaggaaataatactccctgaccaaatcacaaacattctgtataatcatataagttacttttccaagctgcacaaatgatatgtttcacatgctgagaattgttaacaagtacagtactcaatacgcaatgttagaacttactttgtttaaagcaaatagactgagataaaatatctatcccctaaccccaagatgcttacaatcttcctagagttcaaggcttgcttataaaaacaacaacaacatcaacaacaaagcaataagaggcaatgaatggcaatacagataataaacaccagaaagaagttcgctgtaagttggtgtagttatggaaatgatgatctgtagttcgtctgagagagttgcaagattctaaacagagagctttttc

SEQ ID NO: 122996 - DNA, 2001 bp, Homo sapiens
ctgaattgggtattactaatagtagtgataaattccagggatcatctcaaataaacttccaggtctatagttctaaagattaatttaataactttaatagtggaggtaaatagaaatgattgacattttgtcacatggcattatattttgatttctcataattcataccacgcactattcttccccttttcatttcctcacttcccattcttccccttcatcttttatctatctaagaaattctgtctccaggctgccagagccataaaagtatcaccaacaaacaataatggcaataacagcaaaagcagttggaattacttctgctcatttacaggcatatgccacaaccacaaccaagacccaaaatatatgcttatttttgcaggtgcacttctattattctaagactttatgataaacattttaaaacataatttaggaattacccatcaaactccttttcttcagtgaagcagagggaacatattgctctttaaaggaatgaattcttccggagcatgctggtatttgtgatggttttgtttatttcaaagactaattcccacttcaaatagaattttcaggtaaagaactaatttctcttctaacatccttggaaactgggaactggaaattgattgacataagcttgcataatgagattgaacctaaatgcacatgcttctgagaatatgtgatgggtttgacattacttttaggaaccaagctcttgacccaaaaagccacttgcttgttaataacactcttatgaaatacacagaagttcattatcccttgggacttcaaatcaccctgcaaatacctagtcagtcattctgtgttgaagtcatttatttctccttagtttgaatagctagaatcagatctaaatgttctctctaaagaattgtttttaattgaagaaaataaacattcttttaaaatgttctggtgcattcttttaaatacaccagattctaatttactttgcatgaacaaagcgcaaatatcagaaatactaaaatctattttgaaagtttgcacatagtaagctagtccagaatctgaccagaaatacctattttttacctttattatttgataatgctggcagcatattaaaacagtccaatatctgatgagtggttcaaaactagcaaagtatacaattatctaatctgaaaaaccactttttattgattgatttgcgtggtttttcattctttgaaagtagagatcttgactaagacattcaatctgcgtagcagtcataaaatttagtatcccctttgtgacatgctgtgtgtggaagggttggggaggagctattgataatttcttaggacatcgagcacaaaccaggaccatcctgagcaaagtatatggtcagtatatacttaaagacagtttatagaagtgatgataaataatccaaagatggttctattgtcataaacttgagcaatttcccccccaacactcacttaattggttctctccaataaatattctttctttaaaagtttcaacaaagttttaaaggtctaacttttacttttgacttattcgttttgcctggaagcactaaggcttacagtctgtggtgactggcagtaagaatcaacatggttttcctttttctttttctccagtgaaaactatttccactttaagtcttctgcacacggcaattaatgagaggaaataatactccctgaccaaatcacaaacattctgtataatcatataagttacttttccaagctgcacaaatgatatgtttcacatgctgagaattgttaacaagtacagtactcaatacgcaatgttagaacttactttgtttaaagcaaatagactgagataaaatatctatcccctaaccccaagatgcttattatctgtattgccattcattgcctcttattgctttgttgttgatgttgttgttgtttttataagcaagccttgaactctaggaagattgtaaggtcgacg

SEQ ID NO: 122997 - DNA, 335 bp, Homo sapiens
aaaatgtattctaaacctgcaaaataaagccctagatagaatttgtttacatgtactgattaattagaaggcttgctttgtaaggaagcactatgcaaattattttttctcagttattagtctaagaaagagacaaaaataacttttattacaaagaaatctctgcttgcatccatattttacatctttataaaaatgttttaaaagagaggtatggccaggagcagtggctcatgcatgtaatcccaacactttgggaggctgaggcataaggttcacttaaggccaggagtttgagaccagattcagcaacatagcaagatcctatctctacc

SEQ ID NO: 122998 - DNA, 436 bp, Homo sapiens
caccatcgagaaagtctgtcagccccgggatcttccaggaaggggtcccgtagcctgagcagagaatgcagcagagaaggcacctgagccggccagggctgtgtcaaaaagcagcagagacctggcgcttcaacagcagaagtgtgtcctcccacagtcctgggggctgacgtcagagccatgtccgcagggcgggctccttctggcaccatgctccctggctctttggcggtcatctttcccccactcttcccatcatcatccctctacttgtctctgtccacatttcctcttcttgtattgggctagggcctaatataagaccctagcgaccctcattttaatttagttacctttacaaagatgctacctccaaataagatcacactgaggacctggggctaggacttcagcagatgaattttgtgggagggac

SEQ ID NO: 122999 - DNA, 505 bp, Homo sapiens
atcatgatgaggacagcaccaaaagtttggtgttaaaccattcataagaaatccacccccatgaaccaatcacctcccaccaggatccaccttcaacataggagattacagttcaacatgagatttagagggtgcaacatccaaactatatcagcagcactgaacaagccagacaaggttgctgccctcacggagtttacattctaatcccaaggggagggcacaaaaaaattacaaagtatgtggacataaataaacaaggcaatatgatgtgaaagaaactggaagaaggggtgaccattttcaagagtgtggttaggaagggcctctttaaggaagtaagatgttagctgagacacaaaggaagagaagcagtagatcatagggggaattgaagaaaataacgtttgagaagatatagcttgtgacaagatttttgaagtagaaatggtttgacatgttcaagcaacagagcagaacagttgcttggagcatggtgagacag

SEQ ID NO: 123000 - DNA, 676 bp, Homo sapiens
gatgttggtaaatatcacatggagcccctgggaggctaaaacaagatactgttcatgaatattcattatgaactgtgaagagctgttcacatttaaggaatttcaagcctcatgtttggatttgtgcatgcttctaattgcattcataagtgctgtcttcttgatttgtcagaagacagtaaaatgaatttaactctatgtggaattcacttttttatcttgaaaatgaatactgggatattgtagataatttttatcttgttttgatatagtatggaaagacccaccacaatttttagtaatgtattgctgcttatttaggctggggacattgtttttagttttgtttttgttaaccaaattagaggctttatattccctttatctttaaaaaattgtcatcctctctcacaagacctgttttagcccctctaggaggctggtttaaggtgcctatggtaagaggagctatatttacataggtctagttatggaaggtgccatcagttatcataccctgttctctttggggcttattctcttctctattttgatgtgacagcataaatgtgcactgtggaactgtccgataatagaagccactggagtacatattttttcttttattgtttctggtccttagcatctatatagtgaagggattgctttgtgaatt

SEQ ID NO: 123001 - DNA, 167 bp, Homo sapiens
tggttgcattttacttgtctagctatcgtctctttcctgttgactatctggaaatctctgatggggtctttaacagaaaaagtctactccttcagaccttagtttcatgccatataccacatatgacaggtctgggaaggtctggaatgtgtggataaaggcgatgg

SEQ ID NO: 123002 - DNA, 418 bp, Homo sapiens
agattgtaggatttttttgtgctagcaaaacactttgtgaacatgagttttagctagataatgctgatgtcttaagagcaagcatttggacatgtattgtcatatcttggttttgtagctggacgactatatttttattaggtgaaaaacaatgacttcatttcttgggtaatcattactgcagttgcagctagttaccttttaataaacaatcagtgcctttcttttgtggtcctgtgtttacttctaattttggtgctttctttcccagttcatggttaagtttgtggaaagagttgccacactctccttaaatctgaattatccataagctcctgttcatgctacccactgaaactgctccagcaatggtcaatgaggatttgtactgtgaagcctaaatgacacattttggccc

SEQ ID NO: 123003 - DNA, 173 bp, Homo sapiens
atctcttttgctctctccttcaagagagacctcatcccattcagttgcatccatttatttattcatcttctgcctcctgggctcgagagatcctccagcgtgagtctcccaagtagctgggactacaggctcacaccaccatgcttggctaattgttgtaggttttggagaga

SEQ ID NO: 123004 - DNA, 387 bp, Homo sapiens
ttttcctgctgttgcaaataaatgacttactttacacaagtctttgtaagtaagaatcactggagggagaaaggggtgtagaacaggctcttccagcagggacaccagatgatggatcacattcacatcagccgtcagttaacagaaaagaacaaggaatgtagaattccattatgtctcctgctcatgtattttgaggaagcatttcattccattgaatagagtacagttctcaccattgtgacgcaaaaataacacctccttttatgctaaaggtccatttaagaaataccagttaaaaattgaacatttctaacggagagaagcttcagtgtgctttttcttactagtattattgctgtgattacattaaatgcaaaaatattt

SEQ ID NO: 123005 - DNA, 743 bp, Homo sapiens
gttaatctatggccacagaatgtagtttttaaaaatcatacagttttctctggtttgaagaatgattaatgcatcatcacctggccttacatggcattcttaaaatgtatggacatggatcaactgatctttaatcggattttcttctctgagatcacaacattgaaaagcttagatttatacattagagatatagtaagggtgggggaaaagactggaagtgttgattattaattgatctattgtataaatttgggcaagttacacaagtttatataagacaaatcttggaattatataaagatattccttgatttaatattttttattatttatatccatgaaactataattttcactaaaaatgtagcacgagacagtatcaacttactgataaatatgaagtctttgaacttttcttatatctaaaagtcacagcttgagtaggcttttggagtctgaatgaaattatcaggaagatactgataatctagttttcttaaatttatctccatataaagttcatatatatttatctaaattttacgtaagatgaatgagctgtgatattcaatatttaaaagactatttactcttggcatttgcatgggaagtactctatcctatggaaaattttgctttaaaggtgtgaccatattggcaaccttaaggtttttatttcattttatcaatgttttaaaaactaaacccttcaaataaatcaaggtggcttcatcttatac

SEQ ID NO: 123006 - DNA, 348 bp, Homo sapiens
cctgctaagaagtgctgatttctgatcacatcattaattaatcaacaactgcaatctggtaattagcaattatggaaaagcaatcccatcctcagaaagcccaggagatcgcaattccggtataattttaaggtttacattattcgactcaaccaaacagactttctctgctaagcattggtaaccacagaggaaaggcaaatatcattggagatgcaaaaaaaaaaaaaaaatttcagttaaaaaggcaccctgattttgggggaccaggtcttacctttctaaatctatttggattaggacagtatttcccaaacttgcaggtgaaatggaactggggatccttta

SEQ ID NO: 123007 - DNA, 678 bp, Homo sapiens
gctcactgcagcctctgcctcccgggttccagctattcgcctgcctcagcctcccgagtaactgggattacaggcgcccgcccccaccacgcccagctatataccagtgttcttgccacaacccttcgagtctctacaattttaggtgaatagtcagataacactggggcctagaaatggtaagaaagaggttggttggtgtattatcttctgggctcagccttttcagtttacaagtatccctctcccagttttcctttttaattatagggagagttgttttactaatactggctttgtactgaaagaagaaagcaaaattaaccagatgacactattgggggaatgcagaaggtaaagttatagtttagaactttaagaaaggattttgtttctttttctttttttttgagacggagtcttgctctgtcacccaggctggaatgcggtggccctacctcagctcactgaacctctgcctcccgggttcacgccattctcctgcctcagagtagctgggactacaggcgcctgccaccatgcccggctaattttttgtatttttaatagagacagggtttcaccgtgttagccaggatggtctcgatctcctgacctcgtaatccgcccgcctcggcttcccaaagtgctgggattacaggcgtgagccaccgcgcc

SEQ ID NO: 123008 - DNA, 633 bp, Homo sapiens
accaccacacccaactaatttgtatctttagtagagatggggtttcaccatgctgggcagtctggtctcgaactgctgacctcaggtgatctgcccgcctcagcctcccagagtgctgtgattacatgtgagccgccatgcccagcctatcttcattcttgttcctcacacctgccaggtatgtgctcatctcaagggttttgctttggcccttccctcctcctggagtgttctttccccctgtctgaatggatacctccttcatgtcctggaggtctttattgacgagtcactctgaatgagtcttccctaggtgctcacgtatggaaggtctccataccccaccaagtaatccagacgcccgtggcttcctgtgctgctctccttggcttatctttctctagtgcattatatagtttccttatttactacttttttgtctctgttactggaactgtcccactaattacttcatactctctttcatgttttttactttctctttaaaccaacccttctccagtgtactgtataatttccttatttatgatgttttgtgtcttccactagattgtaagcttcacaagcagagattttcgacttactacatttattttgtatcctcagcactta

SEQ ID NO: 123009 - DNA, 348 bp, Homo sapiens
ttcatccttgtgctagctcaggtttggtacctaacatggtgtgaaataagaccttaattgcactttcacagctgtgtttagcacgtaagctgatcatgaacaaattctcttgtcagagataaaagcttgaaattccaagactatgtaaaatcacagacaattagagtgttctgtgtaccgtacaaaataatggtaaaaaaaattcaaacggtcatagcacagtatagtttaaactgctgttttactaattcttctggagtgagaaacattttctgtagtagttaagcacccaaagaagccattttaccttgcctgttaaaaaatgtgtgcaaggtctgtggttcaaga

SEQ ID NO: 123010 - DNA, 397 bp, Homo sapiens
aaggtctactgtcctaagggggaagatggaacacagaaaacacaccaccagagcctacacaggtgaggtgagacagatcttagtggggaagatcagggaggacttcctggaggaggagccatttctagaccagcttgaatgtggactcacattccagcttattcccagctcttctccattcttggttgggggtcccaatactttctcaaagaaagataagctggggggactttgcttctggtggctcacagctgtttagccaggctggttcatcaaaaccaccattttcatcagggctggtaagagggtagagatagtggaggttctggtacccactgagggtacccacatttttgcccatacagggagggtatgcctctctgtttcttaaccctga

SEQ ID NO: 123011 - DNA, 381 bp, Homo sapiens
taacaatttagggagtgctgttacaactcataacttcacggaagcgaggaggaggtgcgaggaaaagccggctggcgtgttaatttgggattttctctctttgaagcagaagaatacaaacacaactcattttggacatgtggctgaggttgaagtattttcagaatactcaaggaaagacgtttaggacgtaggtggtgatataccccagccactcaggttgatttaggaagcaagaaattgtaggaatggatgagatgacctgagagagagtgctgctcaataaaaatataacgtgagccacaaatacaagccacacacgtggttttaactttcctagcagtgaccaggcgtggtggctaacatctctaatccaagtat

SEQ ID NO: 123012 - DNA, 163 bp, Homo sapiens
atttgttctttcctatgtaacagaggacagatgggaattcatgagaatcaaattagaaagcctaaagtgcactcacagttcctaccatatggtaagtacccaataaatggccactattaccatattcctgctcaaacaatgtccaaactcctaaccctagcat

SEQ ID NO: 123013 - DNA, 276 bp, Homo sapiens
aaaaaacactatgataaagttagaaaatctaggacttgctagagatgaaaattaactggtttttaaattaaccggcagagggctgtatctaaaattaaacttatattactttcactagaggaaataccatgtgagagcttttctaaatgaaccctttacttataggaagttaatatttcataatgccaggagaaatacagcagtaatacattttcagcaagtaggcacttttcgccttaagaaaaataaaaataacttgtcagttacacaatccta

SEQ ID NO: 123014 - DNA, 744 bp, Homo sapiens
aaacaccaaagctggagaagccatcagcaattgtggaagattttcttttgctttaatcgttctgtacttggcagacactttgaaatgcgtatgggaacgtaagttgcagtccagatcaatccagcataagttgcagagatgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctac

SEQ ID NO: 123015 - DNA, 606 bp, Homo sapiens
atggaattaatgcttaattaattttcctagattgttttctgaatgtagttttttctaagaagaatgatattaaagttacagaagtaatctgtataagaaatctgagtctgtgttaaatagaaattttttattgttttgaactgatttccttcaagtaaatgtaatgaaatgtaaacctaatccagattgtttaaagaaacttgtatgaagacatcttttcttccttaatgaccaaatgtgatctaatagttcctgtacgttacttttcaactctaaatttcattaataatcatattaacggccgggcatggtggttcgcgcctgtaatcccagcactttgggaggccaaggcaggcggatcatgaggtcaggagatccagaccatcctggctaacatggtgaaaccccgtctccactaaaaatacaaaaaaaaaaaaatcagccaggcgtggtggcaggcgcctgtaggcccagctactcgggaggctgaggcaagaggatggcgtgaacccaggaggcagagcttgcagtgagccgagatcgcgccactgcattccagcctgggtgacagagggagactccatctcaaaaaaaaaaaaaaaaaaa

SEQ ID NO: 123016 - DNA, 351 bp, Homo sapiens
gaattctctctgctcagaactcttcgatcatagggcatatttgagatcactcataacaaagaatagatagcaagccagacacagcaaaaacaaagtcggcctaaattcactttagcgagtgaaggtggctcgcgagaggggctcagatgataggcactgcagttagggcagcaacagagctcacaggaggccagctctggccatgaggccatctgctaaggagacttccagcataagaggccggagggcgttgaaggcctgggctgtggctggcactggggcaggtgcaagagacacttaggagtttcaatccgatgcacacagtgcctgctccatctcctgctctcttct

SEQ ID NO: 123017 - DNA, 306 bp, Homo sapiens
cagctttactcttaatttacatatttttcccttgctctaatgcacatgctagaatctctagtataatggtgaaatacagccatagatgttccaatattaaaccagtatttcttatttcaattagctaatattttgctaaagcttttctggttctacaattttgcatctatgtatgtatcaatttttacatctgtgttttctaatttttctgattttggtattatggtaatcataattaaataagtgaaatattgtggaatcaggaggaccagaaagagaccttggggtgtatacaggaggatatct

SEQ ID NO: 123018 - DNA, 430 bp, Homo sapiens
aaaagtggattgggggtaatacattgtgatagtctttgcaacttacagggaatgggacaggccattagggtgtatttcccaggtttccaactgagaacctaaacccagagaagtgagacaaaccatctaatgtctgtatcctactattgacaggctgtgtgatgttggatttctcatttactctctctgaggtccagggtccttatttgtaaaatgatgacattcgtctagagcagtggttctcaaagtatggtctgggggtcttcaagagcctttgaagagtatcctaggtcaaagctattgttataatactaagacataatttatcttttgcactctcattttctcatgagtgtccagaggaatttttgagcagctatctggtgtgatattataacaggctgaataaagaagtagataagagaatcta

SEQ ID NO: 123019 - DNA, 261 bp, Homo sapiens
acactaccattagcattaacactgcactgcctctactactactgctattttattagcagcattagcattttagatgtttaggtaaatgggagggaactgtagtagcttaatttgaataaataattcagcccactttgttacaaatgaaagtataggaaaaatgtatttttcttgacttacatacctgaaattaataaattctgttaatatggtgtacatttctgagtttctcatttttagaaaggcagtaaggggttcttg

SEQ ID NO: 123020 - DNA, 401 bp, Homo sapiens
ggggaaagaaagtgcccccagcctagaggaggcctcattctggcttgggtccccactctggggatattctctaggtcttaactgaacatgtgaaatgaagaaccgcagctgcctactctgatacccctttcaactccatgattctgtacaaaattagttccctagttctcccaaagtgctgagtgatcaaggggaagggaagccctgctcaatgctgtgagagaacaggtaggaaaaattaggtgtcttttaaaaatatttatctctggctgggtgtggtggctcatgcctgtaatcccagcactttgggaggctgaggcaggcagatcacgaggtcaggagatcgagaccatcctgcctaacatggtgaaaccccgtctctactaaaaatacaaaaaaaa

SEQ ID NO: 123021 - DNA, 320 bp, Homo sapiens
atccctaaaaaataagccatttagtttttgaactttctgttttctttctgaggcagggtcttgctctgttgcctcggctgtagttttgaactttgacgtgagggaattctcctgcatggctgctcctacactgcatggctctgagcacctgctctgtgtctatttttgtcctccattctctccctgagacccacccacactgacatggctcattttcattgctgcatggtctcccgtcgtctgaggggagcatgggaaatgtcttcatcttcccgtggatgagtggttggccaggttggggcccttaggactgtgttttg

SEQ ID NO: 123022 - DNA, 165 bp, Homo sapiens
gtcaattgactcctcaggcttcctgacaatgtcacctttgaggaaggcgccctgattgatccactttctgtggggatccatgcctgcaggagaggcggagttaccctgggacacaaggtccttgtgtgtggagctggtaagaaacagaagccaccctgttgcggg

SEQ ID NO: 123023 - DNA, 455 bp, Homo sapiens
attagcagagaagacagagggctttcagagctggctgtggacatggcatggccatggctgagtaggaacagatggcctgtgtagaagaggtgagaagaagaccatcctgaaaaggtgggtaaaccgttgacacaaacgttccatatttgggtagtttggactttatcctgcagatccttcagtagggcagcaggggagctactgaagatattttgtatggagggtgtatgtgttattacgtaaactatttcagatacaataccaggtttccttttgtaatgcgattgtacattcaggtggacatgagagatttcaagatttctgcctcacctcatgttgttgcttttttgaccctttagcttgctttctctactctgttaacctccctttgctgtaattaaagttaaaattattaggggaggtttggtattattttacttatgtttttgagatag

SEQ ID NO: 123024 - DNA, 579 bp, Homo sapiens
cttaggtgatctgcctgccttggcctcccgaagcgttgggattacatgcatgagccaccgtgcccggccttatttttctacacagccaaatgcacacagaccatcttactgagctgtcttcacttacatttttgctcagtggtcttctttttgtaatggcctttagtctttttaaggctcagctctgttaatactttcttgagggagctttgttacccatttccttaatgagaattattttttctgtcttctgcttccatagacttaccatatctttcttgtcttatgcttatttgttgactgcttcttcccgtagagtatgtgttctgtgagagaatactttttcttacttaacctgtttaagtgcttgggattgaggggaaataaggatttaagaaaccatgaaagaaggtctctgtccttagcagtttactgtttataaatttcttccactgtgtttattaccaagtcactttatcattaaagcatttgattatctattccctttgaagtcaggaagagaccgaaagcgaatctgagattcctcacatgggggcgtcgagctgatttgaggccatt

SEQ ID NO: 123025 - DNA, 258 bp, Homo sapiens
cagggcatgtgtcgttgatatatttttaatcctggtaaaaggaggaggttcaaggcagaaaactcatcaaagcttaatgacaacaatagcagctaacatttgtgaggctctaaggtaaaacccaaggctaagactcttcatgcaaactaggtcaagcagcaagctacaggttagaaacaggcaaggcagcaaaacagtcacatgggtgaactctgggactctgcagtcacactctgactctcctgcttgcactgggtg

SEQ ID NO: 123026 - DNA, 402 bp, Homo sapiens
agtttccccttccaccctactgggctccgaagccagcattgcttcagacaccaaaggtgcccatgtggggctcaagcctggtgtccaataaatatgtgtgtcattgacctaatgcacgtccagccaatggaaacctcacacttctgacttcggttttaaggttctaatcctgaagtcttaacagtttacacatattgacctgaggatattggatacttttaattggagagggttgaattcctctaaaggacttcatggacgaagaagacagctagaacccctggtttcctgctcctcagtggagattccaggcaggaggcaggcagcaaacacttgcattcctgcgaagcgccaggcatggtgctgggcgcgggaaagacaccagtgaagacgcagaacgcg

SEQ ID NO: 123027 - DNA, 414 bp, Homo sapiens
ctattgcagagaccacgtcttcgccagcagctaagagcagtgcatggcagtgaagggacacaggtgacagacgaacccgcagcaaggacgtctcaagtgtggcggctttggaaaataaggcacaaacttgaaggcggggcgggggctgggtcggcaaggtccctgacagcaacacaaacgtccatcccctccccgacagacacggaaccagcactggtggctgcaaaccacgccctctccactgggcctgcgtccctcctccaggaaccagagctgcaaccgtgactccacttttgggtccatgccacaaccctgttctcctggaccccacggctgacagcggtggcaagctgggtagcagggtggtcagagacacagctctgtgcctgcccatcactcaccctggccgagtgt

SEQ ID NO: 123028 - DNA, 637 bp, Homo sapiens
taatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtag

SEQ ID NO: 123029 - DNA, 362 bp, Homo sapiens
aggaaggcagtgaaaggcatgagctggagtgtatcaggaatacaacagggaaaggtgaagactgtgattaactgcaggtgcctttccctgtttagagtgggcaggggcccctcatcatggttgattgttggcatttggaaatccatgctaacttttcagatactccaatttttcaaaacaagccagaaagccaggtacttatgtgaaaacactcatatttaaaaatattggctcagtattttttaaaatcactcaaatgggcaaaataaaacataactgaattgtgttttttttttttttagattgggtctcactctgtcacctaggctagagtgcagtggcatgatcatagcttactgtaa

SEQ ID NO: 123030 - DNA, 662 bp, Homo sapiens
tgactctaagcatccccatgtcgcatggctcattagctttgtgtgtgaaatgactcaatttttagttgactatgatctcacagacactggtatggatgtggggaaaaaaaacaacaattttttctaagtccatacaaatctcattatttgaggttaaattcatgtagtttttgtttatcctttattcatttctttatttattactatttgctcaggaaaggtcatttcctcccctcctctcaggctcccttcaagttatcaagaaaaataaaccaggtctattcaacctcagggtaaggatggattggatcctggccagaattgtcttcccaactgggagtcgtcccaatctcccacccacagagataaaaccaaagacagtattgctggccttttccaaggagaacagaagataagctgactggctggcaagatccacgtaccgactagagtgaccatgtgactcactctctgttagccataagagttacttagttgttatagagccctgtggaccttacatgccagtgtgtacagaaatcacaaaggatgcttgttaaaatgtagattcctgagattgtgtttcaatacatctggaatggggctaagaatgctacatttaaataatatatagtagacttactttgtgttcatttatatgc

SEQ ID NO: 123031 - DNA, 218 bp, Homo sapiens
tgcctttttctcgtacgtgtttttctctacctctaaaatgattgcttgttcatgtgttcaatgcaccgtagaggatacggcaagtgccaataccataatcttgccctcagggaggactggggaaggagggcaagaacacatttagaaaggtataataggctgggcacggtggctcacgcctgtaatcccagcattttgggaggctgaggcaggcagat

SEQ ID NO: 123032 - DNA, 397 bp, Homo sapiens
atataacaacgaagccaaaaggactaagcttgtacctaacatttaccaagcactggctacattcaggttgtttatatacaatctctccccgagacatcctgtaagctggttatgattattggccaattgaatagatacggaaacctaagttttggaaatttcaaggagcttgactaagatgatgacaagcttttagataggatactgaagcccaggcccacctatcagagtccaagctctcagacactatgctttgttgcttctcatagtatttcatgcttaacagcacagactcacataaataaacttccacaatatagtatagatacatggaggctaaggccatgaactgaaatttagtgtttccccaggttgaagtaagtcaattgtgttgtag

SEQ ID NO: 123033 - DNA, 902 bp, Homo sapiens
cagtggtacgggaagatgctaagacaaaatgggaagctcctactccatgtaagtaaccactcagtgttaacatcaatcaaaaagacatcccataaaagtgataaagtatcctggtagttcgaagagaataatataaagatagaatttggaaggagcaaagatgatgacaaatcttcctaactgctttttctctgagcagatttagaaactttcagaatatttataatcctgaagtttcagcagatccaaattcaaagtaatgaccaagcagggctattaactactccaagactagatctccagatgctggtgaagaatcacagatcatgcagaatttgaaaggtttgtttttgtcatagatagtatatgttctaatgattaataccggaaatctgacaaaggtcaaattctgataatgagaatgttaggtaataatatgcatcacacatgtaattaacttcattttactggattttatagactataatgaaggtcagaagactatcacactcaagtaggctattcaaaagtttgtttgctactaaaataaaacatcactgcttaatcttgtaaaatgtccagaatttaattgcaggccaattaagaatgtacgtaaatggcagaaatttcactttgaaaaaaacaagccaactataaaggacaaaataaagtgaattaaaaagtttccaattttggttgggcatggctgctcatgcttgtaatctcagcactttgggaggccaagatcagaggactttttgagcccaggagttcaagaccagcctgggcaacatagcaagaccccatctcaattttttaaaaaagtacccaatttttatgtgttgagatctctttagttatgaggctaacatcacctgcaagtgtcttttaaaagtaaacaa

SEQ ID NO: 123034 - DNA, 497 bp, Homo sapiens
tccacgatgttggaagtggggcctggtgggcagtgactggatcttgggggcggatttcccccttgctgttctcgtgatggtgagttcccatgagatctggttgtttataaaagtgtgtagcacctcccccttctctttctctctccctcctgttctagacacgtaggatgtgcctgcttccccttcaccgtctgccatgattgtaagttttctggagcctccccagccatgctttctgtaaagcctgcagaaccgtgagccaattaaacctcttttctttataaagtagccagtctccggtagttcgttatggcaatgggagaacagaccgatacagccctcaatcttgtataaccagttatattttctggcaatgctatggaatggagttattcaactcttacttgccaaaggagcagaatttctgaggcctttttgatggctgatggagatgactggatagaatattaaaagcgagactttcgggaagacaggtt

SEQ ID NO: 123035 - DNA, 1943 bp, Homo sapiens
cgcgcgcgccgcgcgccctcgccctgtgcgccctgcgcgccctgcgcacccgcggcccgagcccagccagagccgggcggagcgggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 123036 - DNA, 1964 bp, Homo sapiens
ggagcaggctgcctgggtggttgtgggacgcgactcctcctaagccctggacacacttgccctccacccccgccctcgggcatccaggcgcccgtttttgagatagacgtgcccagagggaccccagccccattgcagtgtttcctaggccctgtgggtggaacccccactgggaccccccggggactcctgcaatgcgggctctgtgttcactggagtcctgaggaggtacctgcagtcaccagtgtccattccaggaggccttcaaggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 123037 - DNA, 109 bp, Homo sapiens
gtacaactcaatgaattgtcccagggtgaacacatccatatacccaaaataaaggcagaacccttctagcactctaaaaatcccctcacagatcttaatcactaacacc

SEQ ID NO: 123038 - DNA, 220 bp, Homo sapiens
catttagtgctttttatcactattttgccactctaattgctctacacaattagagaactagacttaatagtaaattgaattatcacaaaatgtagacaatggctcagttcagataacatttaaggtcagatgccgtgataggtaccgtacttgacagtgaaaagccattaaaagattctaagtaggattgggagtagggtgaagtgaagtttataattag

SEQ ID NO: 123039 - DNA, 158 bp, Homo sapiens
tattttgtaagttattaataacaccatcaacctaaatatgcaacaagtgagtgactagttaataaaattatcttaaaaaccaactcagtgtgaagagtattaaaatttttagcttggaccatggtaaactgctcatgataccattaaaaaaagaatta

SEQ ID NO: 123040 - DNA, 559 bp, Homo sapiens
gttctgagggtcccggatatgcggtctcatattacattaagaattagagcatctagaaattgatgggaaaaagactaataattcatttgaaaaacagtcaaggatatggatagacagttcacaggaaaggaaccatagtggctcaaacatgcgaaaagatgctcaagctcacactattaagaacctaaatattcaacttacactgagataccattttcctactattagatgggcaaaaatccaaaagtgtgatcacacactctactggagaggctatagagaaccaggtgttctcttgctcttaacagagtgcaaactgctatgaccctttgtgcaggacatcttgtttgtgcttattacaacacagacacagctattccaattctgagaatttatcctgccaataaacttccatatgtagaaaatgacatatctaaagggttatcacagcaatatttgtgtttttttgttttttgggttttttttttgctgttgttgttgtttttttttttgggagacggcatatcagggacccgagctcgaatccgaaaccggggcc

SEQ ID NO: 123041 - DNA, 1006 bp, Homo sapiens
cacaatactcatgccatctttcaccttgccaaagaccacatgctgtcatccatcctctgtcttggcagtacagaagaaaaactgggaaccatttgtggtgggtccagcatttgccgtggacaagacgccaggagctgtatgcttaggatgaagttctcatcatcaaattccttgctgtagagggacttgccaccagtgccattatggtgtgtgaagtcaccaccctgacacacaccccggaataattctgtaaaagcagggacctttatcaccaaatactttctctccagtgttcagagcacaaaaattttcttccatctttagaactttgtctgcaaatagcttgaaggagatgcagcccaaggactcactatcaattgcaatgttgaagaacacagtggggttggccatggctggtggcagggagttctgggcagcagcgatgtctgcaaatggaagtcttttcagaataacacgagtttatctttataacaaacctatacatgtatccctgaacctaaaataaaagttttttttttaaaaggataacttattatttcagaaatttctaagaattcccaggaattccaacttctcatttgtatatcctgatgaatatccactgggtatttggaaatgccaatttctgacatatgattgcttagctagagactgcatttccagcctcctttgcaggtaactatagccaggttctaagttttggccaatgagatgttagcagaagtgaaatgtgtgccttctggattttatttttatgagaaatttgcctgtcttctattctttttccctcttctctctggctcggaaatgatgaaaagtacaggactcactgggaccaaaattcagaaattacatgttaaggaagagagggctgctcctctagcctgttctccttatgaccttgtggaacggaattgcctacctgccctggactatcctaagattgtcgtatggagagaaatacattctattttatttaaaaaac

SEQ ID NO: 123042 - DNA, 981 bp, Homo sapiens
tgatctctcctgcaataactaggaatcgagattccacagtagacgtcccttgccgtgctcgctctctctctcgcgcgctctctctctctctctctctctctctctctctctctctctctctcctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagttt

SEQ ID NO: 123043 - DNA, 829 bp, Homo sapiens
agagagagaaagagaggagagagagagaacaaaatatagagagagagagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagttt

SEQ ID NO: 123044 - DNA, 514 bp, Homo sapiens
ccctagttttgcacctagaagtttagccattaattgtgttcatagatttaggggtccatgtgcatgtttgatactttaggtatattgtgtgatgctgacatttggcatatgaatgattctgtcacccgggtagtgaacatagtacccagtagttagtctttcaaccccagtagtccctagtagctattattgccgtctttatgtctataagaatccacagtttagctcccacttgtaacatgtggtatttggttttctgttcttgcattaatttgcttaggataatggcctccagctgcatccatgtcgctgcaaaggatacgattttattctcttttatggctgtgtgattttttcccccccagctattctgggagctactctctttagggtaccttcgcatatgtagtacgtttttctcctgttaatctgtgtattgtcagttgattcacaggccaccgaccaattggacctaaattggtagagaagttttttctcccaacagtttatataa

SEQ ID NO: 123045 - DNA, 330 bp, Homo sapiens
gccccaaaccagcatatccaatccaattgttgaaaaagcttaattttcctgttaaaaagacaaaagcctaaaaatctcacagcttttggttcactggccgatcgtcctgagggttaaaaacaaactgcgtgctttgggatggccccaagcaggcagagccttccctggagatggagttcctgggcactaactgtgttccaggggatctgagcaaggctgggactgggttttggcttagtagcaattggaggaactgcgtcattgacttcatccctgcggtcatgggaggtcacaggaaaatacagcaagtaaagtgctcccactggctgg

SEQ ID NO: 123046 - DNA, 289 bp, Homo sapiens
gttttgctagagtcatggagacaaaacctgtctgacgtaggcccaagagagaactgcaaatggttatcagctgcttccccgtggagctctgctgccaaggccatgagctggagaggaaaaaaggtcagcagagcggcttggctttaagaaggagaaataacttgattttcacatgggaatgatggtcctggccaagcagaaaatgaagctgatggcaggtcttatcgctcaggattttaggaacagggtaagtgggatcccaccacaaagtctggccagttccttccgg

SEQ ID NO: 123047 - DNA, 193 bp, Homo sapiens
cattttactaatatgctatttaatggaaaaccctagagacctaactagaccatagcctcattgtgtcttagtctagttctgtgcctgagtcatacatttctgcccttctccttgcacaaatttgctctttgttctaccagcctgagctgccctgcttcaaacagtatttatgcacttcccacagaggtacctc

SEQ ID NO: 123048 - DNA, 432 bp, Homo sapiens
acgggtccgaaattcccgggtcgacttactactactatattcgcggccgcgtcgacccagattccttctatctggttgctctggcttcctaagcacgtgccttccatgtcatagcccaagatggctgcctgagctcatgccatcatgtctgcgttccagacatcaggagggagaaaggaccaagaagatcatacctcgtttctttaagaacacttgtttgaagttgtcataccactcctacttacatcacattaactaatgtggtttttcttttcagtggccttgtgatcaattaaaatatgggagttctttgactagagaagaatggctattgggggctattaatgatttgtgtcacagtgtggcccacaaggggactgtgtaatgcttctaccacaaaccgttggtattaaaaaatatcaggtgaagtga

SEQ ID NO: 123049 - DNA, 410 bp, Homo sapiens
cctaaaggtctacggaaaacccataaagcccctcctgggacttgggagtttgtttggtttaatttttcataaacacaaaataagctagtaaatttataattttacctaaaagttaagtaaacctaggacactttacgtcatatttgttcattttgaaaacatattactttcatacacataaaacgtctgtggctcaaaaactgttgctatggactggattatttcctcccaaaattcctatgttgaagccttaactccttagtgtgatggtatttgaaaatggggcctttggcaggtgactaggtttacatgagatcatgtggtgggatgttcgtgatgggattagcgcccttacaagaagaaatacaagaggccaggtgtggtggctcatgcctgtaatcccagcagag

SEQ ID NO: 123050 - DNA, 376 bp, Homo sapiens
tcaaaaaaaagtttagctgggcatggtggcacatgcctgtaagcctagctactcagggaggctgaggcaggaggatggtttcagcacaggagtttgcaccactacactctagcctgggtaacagagtgagaccctgtctaaaagaaaaaaagaaaaaggtaattaattgggccatttggacacttaaaaaaaaataaaggggtaattaaggtaaaatgaggtcatttggatgggccctaatccaacatgatcggtatccttgtaacaagaggcaatttggacatagacacagagaaaagaacatgtacagagagagggaggggccaggtgtagaggctcacgcctgtaatcccatcactttgggaggccgaggcgg

SEQ ID NO: 123051 - DNA, 131 bp, Homo sapiens
ctgggactacaggtgcatgccactgtgcctggcttaaattttataattatttctatactcagctaaaaatgatctctaagactaaccttgcctcattaacaatcttttcctctttaaatttctatagcact

SEQ ID NO: 123052 - DNA, 511 bp, Homo sapiens
aattatctaagaaattgtgagtggaattggactgaacgtggatgagtcagggctcttgaaaaagaaagtggccgtccctctttgagtcagttctgcaagagtggacagaaacttttccagactcccaggcctctctgctccctcagagcttgaaaagattaaagtcattcctcctcaaggtcttcagtgaaaccctggaaatctttccttcaattttaagagattacagttcttcccattgtctagcctctgtcactacttgctgtagcatgaggtggcttccctgggggaaagtgtaccagtcccgctcattggtcgtctaagacctcccagcattcctcaagacatttctgcctcatgatgtcagaagaagggctgtcaaatagattttaaaaccccaggctcggccaggcacagtggctcacgcttgtaatcccagcactttgcgggaatcacgagagcagaagatcgagaccatcctggctaacacgatgaaaccccatctctaata

SEQ ID NO: 123053 - DNA, 494 bp, Homo sapiens
cgtttgtgaaaccagcagtccttggtttagggcccaactaatggtttcatgactcctgtgttagcttcctagattgcagtaagaagtatcagaagctcagtggccctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaactccatccctacaaaaaaaa

SEQ ID NO: 123054 - DNA, 304 bp, Homo sapiens
tgttgcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgac

SEQ ID NO: 123055 - DNA, 326 bp, Homo sapiens
gtcagaacagcacctgcagatgtcaaaactaactgggaaaaagactaatcaaaagtaacatgaggccaggtgcggtggctcacacctgtaatcccagcactttgggaggccaaggtgggtggattacttaaggtcaggagttagagacaagcctggccaacgtggtagaaccccgtttctactaaaaatacaaaaattagctgggcgtggtggcgcacgcctgtaatcccagctactcgggaggctgaggcacgagaatcacttgaaccggggaggcagaggttgcaatgagctgagattgcaccactgcactccagcctgggtga

SEQ ID NO: 123056 - DNA, 735 bp, Homo sapiens
atagcttctttctttattcttagtgtgtggctttgtgcacaatatggctgctgcagctccaaccatcacatctgagtttcttgcaggtctatagggaaaacatggaagggaaaaagtcatctgttaaccgggccagtcttctttcaaagaatgtttcccggaaactctactcacaaacttggccagggaaccatccctaattgcaaaagacgttgagagatatactgttatgtctggtactttactgcctctaaaaaactggagtttacttagtaatgaagaaaggcatactggatattggatacgtagctatcagtctttatcataggagccaaataatatgacttatctccttaggttttgtgaggattaaatgagatgatagaagtgaagcacttagctcagtgcccaagcatacagaaagcgttcatctaagaggggaggataatccctgtcttcaataaatttgcccatttattggggaaatggatatacacatgaaataataatatgatagtatcatataagacaaatgtaaaattcagtcacctcacagcccttcttccccactgccatctcaggactgtgtaacaaaagtcctagcatctgacttttgttgaatacttctcattggtcagattctttgatattgctttatacatgcatgatctcatatgaccctcaaggcaacccatatgggataggtgctatgaggcaggtactgaaaactaaggt

SEQ ID NO: 123057 - DNA, 482 bp, Homo sapiens
atgcatgaaaacacacctacccttactcttcaaccacccacacacacacacactgggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggtcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgagga

SEQ ID NO: 123058 - DNA, 355 bp, Homo sapiens
tggaaagatgggggattggggagggtgaccgagggatctcggctctgccaccagagggcagaagtgtgccagacacccagaactgcgggattagccctggtgcccaccccagacacacaaccacatactgtgggagcccctggagccaactggtccccctgcttcaacaagagcaaggggcatgtccagagccaggctgtgtgttcatgatgggactccttcgcccaccagcatttctcaatacagaagcagctgcgtttcgtacttcattatcgaacactcttatgcatcaaagaatagcagcaccctgggaacttggccctaaatgccagttgcacccacacaggttgtgata

SEQ ID NO: 123059 - DNA, 377 bp, Homo sapiens
acgaagtcaggagtttgagaccagcctggccaatatggtgaaacactgtctctactaaaaaaaatacaaaaattagctgggcgtggtggtgcaagcctgtagtcccagctactcaggaggctgaggcaggagaactgcttgaacctgggaggcggaggttgcagtgagccgagatcatgccactgcactccagcctgggtgacagagtaagactttgattaagaaaaagaaagaaaaaaagaaaggtgggaggggggcatggccttataggctgtttttctctgtaatatcttacttagtttctccctactagactggaatttcttccagtataagcatggtggtaccttcatttcttaaaagatgtttcatagctc

SEQ ID NO: 123060 - DNA, 203 bp, Homo sapiens
gataaatgtgaaaagattctgaattttgctaacaaagtcaggttttggagatctaatttctagtcagtaaaattcatcctttctaggatacaatgctaagagttttgataaatgcatagaactgtgttacactgttgtgtaattaccacaatcatggcttagaacatttccatcgttcacccagattccctcctgtcccttca

SEQ ID NO: 123061 - DNA, 325 bp, Homo sapiens
aagtcagggctgtggggaacccagggcccacttcatttccctggctgctccagcctcagcttgcagggaaaccccacacaggccaggagcccaggccaaaggaggggaaccctttaaaagacagaacggaacacaggaacacacagactccctttctaatcagggctgattgcaaccttaagtggaatagcaggcgagagtgcaaccccatttaatttacagctggagccagggcttggaagcagctgctaaactccttgcaaaactactggctggcccctggggagctgagggtggaatcaggaaacctggagaatccacgatg

SEQ ID NO: 123062 - DNA, 116 bp, Homo sapiens
acacacacacacacacacacacatatatgcataatcacaatgcatgcacacagctggcacacatgcatgtgcacattcccacgtgcggccatgtatttttatgcatgtatgtgcac

SEQ ID NO: 123063 - DNA, 334 bp, Homo sapiens
tacacaccaggccacagacaatggggctcggggggccaacctctccagtccccaaacacagtccccaacagacaacttctcctgtccccacatgcggctcccaacaaacaatttctcctgccctcacacgcggttcccaacgacaacttctgctccacaacatgacacccacggtgggagaagctgggggcacttcactacatcatcctgcacactgcagcatggcctgctccaggcagaaggcaggcctggagaagagcctgggaccaccgcggactgaccaacagcggacaccaggtactttctcaaatgggagaggggcctcatggtggac

SEQ ID NO: 123064 - DNA, 317 bp, Homo sapiens
aagaaggggtttaatttgctgagaaagaaaaaaggaaatggtagcgggaaagaggaaaagggcacccctgcaagagagtggtggttgtaaagaaacacaacagaaaagggtaaagcaattggctttcacgactgaagacaaaaatctttgaccctaccagggagtactattagatgaaggggcatagaagttggggaaagagtgtgctgggtcacgtgtattctgggaggtgatgggaattttctattaaagatctgtatcaggtcattgctaaaagaaagaaacagtatatatggctttaagatccagcccatatt

SEQ ID NO: 123065 - DNA, 400 bp, Homo sapiens
gcctggctcctgccggctgccctgggagaggccacaaaatgccctccacggagacaaggcctgagaaccttcgggacgcccgctgccgctcactgtgttgaagaactgcccgttccgcaccccgggccctagacacacggctctgcagaggacgaggaagtgccgtcaggtgagacttcaccgtgaaatatcttctgagacacaacaatctccctgaattaaaactgcagactctaatttgtaaaaactgtgtgtttcaaaagctccaagtgtttacattctccgattcatcattccttcttctaatttattttaggaaataatgcaaagtactcacaaaaatttatatagaaagatgttcattgcagaattcattataataaaaacctttaaatgctca

SEQ ID NO: 123066 - DNA, 1504 bp, Homo sapiens
  misc_feature (1475)..(1475): n is a, c, g, or t
  misc_feature (1486)..(1486): n is a, c, g, or t
tgcagaaccataagccaaataaacctctttactttgtaaattacccagcctcaggtattcctttatagcaatgcaaaatggatgaatagtcttgatgccaaagccctacaaagatgctataagaaatctatggactaatagttctttcttttttttttttttttttttttttttgagacaaaaagagtctcactctatcactgaggctggagtgcagtggtgcaatcttggctcactgcagcctgggcctcctgggttcaaatgaatctcgtgccaaagcctcccaagtagctgggattacaggcatgtgccaccatgcccagctaatttttaaatttttagtggagacggggctttgccatgttggccaggctggtctcaaactcctggccttaagtgatccacccaccttggcctcccaaagtgctggctttacaggcgtgagccactgcgcctggcctatagactaacatttcttagaaacattgatgtaaaaatcatcaacaaaataccagcaaaccagatttaacagcatattaaaaggattatacaccatgaccaataagcacatgaaaagatactcaatgttgctaattaaggaaatgcaagtcaaaactccaagatgctacctcacacccattaggatggctgctatcaagaacagcagaaaataattgttgggaaggacatggaaaaattggaaccactgtacactgttgttagtcgtgtcaaatggcatagcctatgtgaaaaactggtggttcttccaaaaattaaaaataaaattaccatatgtatcaggattttccagagagacaaaaccaataggatatagatggatggatgggtgaatgagaggggatttattaggggaattggcttactcaattatggaaactaagaaggctgtgataggccatctgcaactagagaaccagggatgccagtagcatggctcaatctaagtctcaaagcctcagaaccagggaaaccaatggcataactctcagaccgaggctgaaggcctgaaaacctgagaggctactggtgtaagtcctggggtccaaaggctggagaacttggagtactgatatcaaagggcaggagaaggatgtcccagccccaggagaaaaaatgaatttacctttactctgcctttttgttctatctgggcacccagccctttagatgttgccctcccacattgaggatggatcttactccctcaatcaacctactcacacaccagtcttctctggaaacactctcacagatacagtcagaaatcatgctttacccgctttttaagtatcctttaatccggtcaagttgacacctaaaaatcatcacaccatatcatcctgtaattctacttgtggaggtttagtagttcccccttatcctaggtttcactttctgagatatcagttacccaaggtcaactgtggcctgtaaaaaaataggtgggagaatcncctgagcctgngaggtcaaggctatagtg

SEQ ID NO: 123067 - DNA, 1010 bp, Homo sapiens
tgcagaaccataagccaaataaacctctttactttgtaaattacccagcctcaggtattcctttatagcaatgcaaaatggatgaatagtcttgatgccaaagccctacaaagatgctataagaaatctatggactaatagttctttcttttttttttttttttttttttttttgagacaaaaagagtctcactctatcactgaggctggagtgcagtggtgcaatcttggctcactgcagcctgggcctcctgggttcaaatgaatctcgtgccaaagcctcccaagtagctgggattacaggcatgtgccaccatgcccagctaatttttaaatttttagtggagacggggctttgccatgttggccaggctggtctcaaactcctggccttaagtgatccacccaccttggcctcccaaagtgctggctttacaggcgtgagccactgcgcctggcctatagactaacatttcttagaaacattgatgtaaaaatcatcaacaaaataccagcaaaccagatttaacagcatattaaaaggattatacaccatgaccaataagcacatgaaaagatactcaatgttgctaattaaggaaatgcaagtcaaaactccaagatgctacctcacacccattaggatggctgctatcaagaacagcagaaaataattgttgggaaggacatggaaaaattggaaccactgtacactgttgttagtcgtgtcaaatggcatagcctatgtgaaaaactggtggttcttccaaaaattaaaaataaaattaccatatgtatcaggattttccagagagacaaaaccaataggatatagatggatggatgggtgaatgagaggggatttattaggggaattggcttactcaattatggaaactaagaaggctgtgataggcccttctggggggggggaagccccggattcccccttacatggggttaattttaaaaattaaaagcgcccaggaacctgaggaaaatccatgggg

SEQ ID NO: 123068 - DNA, 1150 bp, Homo sapiens
gactcttgtttttctgaggctcacaaagactagactcacagcttagttctatagtgtctatttagctgtacttaaagcctacatcaagtactttattgtcaaataaaaagctatctatgaggagcttagtaacttaagtagctctccagagtttggtaaatattttgtgtctacttttgatctctattgtctaggaaaggttctgtcaagttgtaaagtgctagaaagtgttattttaaacctttaaaaggtagtaagagtactacaaccctgggatccttggttgcaacaaagaagcacaaagccaactactatagttttccaaaaacaccatttcctcagtccctgccccaaggaaataaaaaagcatccaggaagtcccatctttaaaaaatacttagctatcagcctggggcttctaaaattcaggccctgaaaaaacgataggaaagacttcaaagtccatccctattaattaggtttagagggaaatgactcttcctaaaaaaaagccatccccgattgttgctttgctcaccatacttcttcttctattttctttttttttttgagacggagtcttgctctgtcacccaggctggagtgcagtggcgcgatctcggctcactgcaagccccgcctcccaggttcactccattctcctgcctcagcctcccgagtagctgggactagaggcgccagccactatgcccggctaattttttgtatttttagtagagacggggtttcaccgtgttagccaggatgctcaccatatctcatacatttggactgttttcccctctcatctccatccgtccatccaatatttgtccatactttgaattcttattcaaaagccaaccccttccatggtgactttcctaagttcctccatcttagctctccccgcaaccttagtgttcaaatcactttgtcatagtctgtattgccttttaattatctgagtatgtctgttggctccaagtaactgggtcaacattttttcctttctttactgtccacttagagttactcaataagggtttattaactcactgaggtgagtaaggctcttgactcataatacccccattctctacttgtcttagaataaaccaggacagggattctagagcaaactctgaaa

SEQ ID NO: 123069 - DNA, 879 bp, Homo sapiens
gactcttgtttttctgaggctcacaaagactagactcacagcttagttctatagtgtctatttagctgtacttaaagcctacatcaagtactttattgtcaaataaaaagctatctatgaggagcttagtaacttaagtagctctccagagtttggtaaatattttgtgtctacttttgatctctattgtctaggaaaggttctgtcaagttgtaaagtgctagaaagtgttattttaaacctttaaaaggtagtaagagtactacaaccctgggatccttggttgcaacaaagaagcacaaagccaactactatagttttccaaaaacaccatttcctcagtccctgccccaaggaaataaaaaagcatccaggaagtcccatctttaaaaaatacttagctatcagcctggggcttctaaaattcaggccctgaaaaaacgataggaaagacttcaaagtccatccctattaattaggtttagagggaaatgactcttcctaaaaaaaagccatccccgattgttgctttgctcaccatacttcttcttctattttctttttttttttgagacggagtcttgctctgtcacccaggctggagtgcagtggcgcgatctcggctcactgcaagccccgcctcccaggttcactccattctcctgcctcagcctcccgagtagctgggactagaggcgccagccactatgcccggctaattttttgtatttttagtagagacggggtttagtagagatgttggccaggctggtcttgaattcctgatctcaagtgatccacctgccttggcccctcaaattgctgggattacaggcatgagctaccatgcctggtcctgagcagtgcttttacgtccag

SEQ ID NO: 123070 - DNA, 931 bp, Homo sapiens
gactcttgtttttctgaggctcacaaagactagactcacagcttagttctatagtgtctatttagctgtacttaaagcctacatcaagtactttattgtcaaataaaaagctatctatgaggagcttagtaacttaagtagctctccagagtttggtaaatattttgtgtctacttttgatctctattgtctaggaaaggttctgtcaagttgtaaagtgctagaaagtgttattttaaacctttaaaaggtagtaagagtactacaaccctgggatccttggttgcaacaaagaagcacaaagccaactactatagttttccaaaaacaccatttcctcagtccctgccccaaggaaataaaaaagcatccaggaagtcccatctttaaaaaatacttagctatcagcctggggcttctaaaattcaggccctgaaaaaacgataggaaagacttcaaagtccatccctattaattaggtttagagggaaatgactcttcctaaaaaaaagccatccccgattgttgctttgctcaccatacttcttcttctattttctttttttttttgagacggagtcttgctctgtcacccaggctggagtgcagtggcgcgatctcggctcactgcaagccccgcctcccaggttcactccattctcctgcctcagcctcccgagtagctgggactagaggcgccagccactatgcccggctaattttttgtatttttagtagagacggggttttccactaactaatctttcacaattttctacccaagggcctcctttctgagtgaactactgctcaaatatacagtctaaaattggtactgaggtacattccaagtctaatatttttactcgctgataattttgaagtaaatttttcctttcttttccttttcctttccttttccttttttttt

SEQ ID NO: 123071 - DNA, 507 bp, Homo sapiens
gtttctgcaccacacacaaacacacaccacacacacgcgcacacacacacataccacacacaggcaccttgattactaaatgcccttggcacagaccagccaaggcataggcacaggcattcaggaagaagaaatcccttgactcagattgcagccaggcttcctttgtgacttgatcccttaaactcctatcactcaagcttcctagctatacacgaagcaaaagcatccctgctccccttcatggagcccagtgccaggcacacacacacatatacacacacacacacacacaaaccacaaccacacacaccacgtatatacacacacccaactgtctggcaagaacttgacacctcgcccctccatgcagaaaatacacaagacagaagtatttctacatggcagacaaagacggagtcttctttggtgaatggggcttgcctaagcataccagcagttgaccagatgaatcagaggaatactcaggtcctagtctgtactttc

SEQ ID NO: 123072 - DNA, 848 bp, Homo sapiens
tgaaagagggtgccatgttgcccaggctgctcttgaacttctgagctcaagcaatctgcctgtctcggcctcccaaagtactgggattacaggcatgagccactgctcccagccaacagataatgtatttttataagatgtgtatgtcaagactcaaactgaaattattaaatgtttattagtcagcatcagttgggatcaaaatttccataatggtaaagtgaatttttatctagaatgagtctggtaacgttttttctagaatttaactggagcatttacttggaagcaacagtgttctattgattttaaactttattatgtttatattttgttcttttttccaaagcatttttcttctttacctattttttgactttttaatggatattaatatatgtaaacccttaaactgcagtactggggaacattgtaatttattcttataggatgaattaatgtgatttctttttgtgataacattaatgttcccaaatagcccacatacttttctgtaatacctgaaatacgaatgagaaataagatataaaactcatgattcttttatgtattttatcaacttttacagagaggtgaagattccagtttaaggaagaaagattttcaaatactttagattaatttgtgaaaaaaactcattttaattttaaagtagtaattctgtttaaattatacttaattagtactttatttttatggtggttaaaagttcacctctgttgtaattctctatgccaaagaattgtacactgctattgccttcttcggttaactctaaaagaagttcagtctgttaactaaatccaacagtgattcaggggtagaac

SEQ ID NO: 123073 - DNA, 733 bp, Homo sapiens
tgacaatgttttggccaagcaaagataaaaagtgcaggttggcatctgggaaggagcacatgtgccctcctggccgggatctctttcctcctttttcctccttcctcctgactgaacacaacaactgcccagacacggaagacacatgttaactacatcagttatccctccacctttccccagctacagatgggaagtagatacttatcttgtttaagccacataaaaagaaaaaaaataaaaaccaagcatcaactgtgtgtcaggcactgtcctgggcagttgagatgtatcaatgaacaaaacagatgcaaaatcctgccctcatgaagcccaactgctaacagcaggagacaataaacaagatattatagtaagtagattgcgaagctatcagaagaaaaagtaggtaagaatcatgcagtggccaagtgtgggagatggcgtaggggttgcaatttttaagtagtcagaatacaagttgtcaaaaaacttgacatttcaacacagattggaagcaagagagtcatccaggtggacatcaggagtaagaacattctagccacaggaagggtcaaggaaggcccgaagtggaaacatatctggcatattacagcaacagcaaggcgataagcaacatcataacagatgagcaaggaaacggtaggggaaaaggtcagaaaggccgagaggggccagctcaggtaaggcctgtagacaactgcactccgag

SEQ ID NO: 123074 - DNA, 382 bp, Homo sapiens
atacatctcacaatcacatatatggaatgagtgatatgcaaatataaaattgcattatttttatattattctcattttatataaatcctaccacgaggcatagtctgtctcattcattcattcatttatccatcccttcatttattccctcatttcctcaggaaatagcttcctttgtggcaggtgctattccagactctggagatactacagtaaacaaaacagaataaactcaaaaactctaaaatgcaacaataaaaaacaaggaaatttcaaaaaggatcaaagttttgaacagacctttcaactgaaatatatatgtagttaatacacacacaaaaaacaagtaaataacaagtgggatatttggtagtgacaaggg

SEQ ID NO: 123075 - DNA, 167 bp, Homo sapiens
ctggtggaatctgaaatctgaacaaagttaatgggttgtatcaatgctcattttctagttgtggcattgtactatggttttgtaagatgttattgttgggagaaactggtgaagggaattgcatgtgaatctacatgatctcaaaacagggttttactacattgctt

SEQ ID NO: 123076 - DNA, 124 bp, Homo sapiens
caagggccttgctatgttgcccctgcctcttaaaacaaaaagagggaccttgccatgttgaggctggactcaaactcgtgcgctatagggaaactttcacctcagcctctcaagtagctgggac

SEQ ID NO: 123077 - DNA, 788 bp, Homo sapiens
attttatggtttgctcacaagtcagttttatatgccagctaacttcggaatgatccacccctggctaaacatctctaaaaaccctgatggtctccaattaatctatgattgccttattactacagcactgccatttgaaaatgctgggtctcagattttcaaattcccttaatggacagctaaaggggccaataccaaagacttgcaatgacctccaattctacagccttgggctgttccaggaacacaattacactccacttccctgcaggttccacccttctcgaagcttctattcctacatctgtaaaatgaacacatttctactaactagtaacacatgccacagtggcactgcactcattaagtgctgtgttgtatactgcaatttaatttggtgctgtttatatcttatttcctcaagtcaacaggactctttctaaaaaagtcagaaactgttttactcatgtcccttcacaacacttagtggtcatttccacaaaatgctagctcaacagatacttgattgattgattaattgatgaacctctccatttctcagggagcctctaaacagttatcaacaagagtatgtttaattccagtctctgtctatatggtcttaggtgaggtgtttggcagtttgtcatctataaaataaagggatagcaccgaatagctcctaagttccttccagtgcaatttctgaatctcattagacaaaacaaaacccaaagacagcactacctctattcacgttagcactgtactttttttggaggaaagga

SEQ ID NO: 123078 - DNA, 309 bp, Homo sapiens
cttttgggtctttgctcttttgtggtctttgctcttttggggtctttgctcttttggggtctttgctcttttggggcctttgctcttttggggtctttgctcttttggggtctttgctcttttggggtctctgctggaaaactggagcagagggtgggtagtgggaatcagagccagcttcttcgtgggaggaggcattggcacagtgaggtttgggccgtgagctttgcagacagaggcctgaattttagtcctgtgctctgctgcctcctagctctgtgaccttgaccaagtgaattcgtaaactct

SEQ ID NO: 123079 - DNA, 217 bp, Homo sapiens
tacacagtatcagggacttcttcaccctgagccttggtttgcctacctgtaaaatgggggtaatacaatatttaactgtgaggactaaatagaccagggtcagtgtgtgtgaaatggcagttatggcaatgactaatgccccagaagatgtccctcacgtctggaggccgggtctcctcccaggaatggttacccggaacccatgactggctgtgac

SEQ ID NO: 123080 - DNA, 327 bp, Homo sapiens
gaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcatattcttactgg

SEQ ID NO: 123081 - DNA, 553 bp, Homo sapiens
agaagggaaggtgggggactggggagaaggtccttgtgacacaagcatgggaaatctctattctgaaaaaaaaaaaaaaattcacatatgtcataggtttttgccccctgatctataagaagaaggttctcgaacacaaatcacctgtagtgcttctgaaagcaaagagttcagggcccaagaatgtgtgtttctaagaagttctcaggtgctgatggccggtccccacaccgcatcacgctgcctcgtatccgcttctgagaccctcaccactgcacacttctcttattgtattgattaataatttaggaatgtagaatgtcttaggcctactgtcatactttccacatgggacattcaaaatgtaaataactctgttcataactaaaatatattcctagaggcattctcatagctagattcagtcttctaaactttctcaactgtaaaatgggaatgaagcttacagggttattcctgtaattatctaacttaggtttatagaaacatgagggataaagcaaatcattgtaaaataaatcctgttatctcc

SEQ ID NO: 123082 - DNA, 362 bp, Homo sapiens
ctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaaca

SEQ ID NO: 123083 - DNA, 405 bp, Homo sapiens
ttcaagcgattctcctgcctcagcctcctgagtggctgggactacaggagtgtaccaccacggcccggctaattttttgtattttttagtagagacagggtttcaccatgttggccaggatggtctcgatctcctgacctcgtgatctgcccacctcggcctcccaaagtgctgggattacaggagtgagctaccgcacccagcctactctctgatttatgagggcagccaatagtggtaaccattatcatcccatgagctgggctccctggaccagttacttaaccttttttttttttgagacagccttgccctgtcacccaggctggagtgcagtggtgcgatctcactcactacagcctccgcctcccaggttcaagtggttcttgtgcctcagtctcccga

SEQ ID NO: 123084 - DNA, 742 bp, Homo sapiens
tcactttttaaatgtttttgttttggtttttgttttgtccccagagcacaagaaaggaaatctctgggacacctgaggagacatttcagaggagaaagagaatcaatttccaagtaatttggaatggaagcaagtctggccgcattctttatctgggagctcctctaaaatcctcccaccaccaccagggtttgatggttaggagacttagcaacagaaagagtaaaaagagaaaataagcagcgaagcctgtgcttccatctccccagggcatgccgaaatagtcactcctagttcttcttcaggtgtctcctgatgcctatggttttgatattgctattttgtcatcattgtttaatttcggatcctggtttgcaaacttgcatctttctaaagaccagtaatgatttctacgtttcaacgagctattaagtgtgtatgtggggggcaagtggaattgctgctgaatgcataaattgatttgcacctacaatttgcatttattctctgggtatatttgccactaatgttgtgactgaactgccataatgaagattaattatataaacattttttgctgactttgtgagcagctgagttggttgttttgcttgattttccaagcttggtgcttaagagtatgataggaaacatttcttggatttgctcagcaccttcatagatgacgtgccccagaccagtcttatctaataaacatttgtggtgagcttttcactggcta

SEQ ID NO: 123085 - DNA, 432 bp, Homo sapiens
gaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacacaagatggttcatcccaagagtcatcttaatttaaaaatcttcacatcttaagaagctacacgggaggctgcggcaggagaatggcttgaacccagcaggcaggggttgcagtgaagcgagatggcaacattgtactccagcccgggcgacagtgtgagtctctgtctcaaaaaaaaaaa

SEQ ID NO: 123086 - DNA, 385 bp, Homo sapiens
gaggatcaaaaaaatcatgtgcctaaataatattgctggtacatattacttatctactacattttactctccaaaactcttagctccatttccatttctggctagaagagggacatgtacctctgtgctgagtttagaaaaaagaacactgcatcacagctgatataacaagcagtaaagaacgtctatatccaaactggtaaggagaattcagcacagttgttagaaaaaaggcaatgctctcttaaccaagagcaactgtaacaaaatgtaacttttaaaaggatacaataaaaaccagttatctagaaataaatctagtaagtgcaggagctgtatggagaaacttaaaagtgcactaaataatattatgctcaagagcaca

SEQ ID NO: 123087 - DNA, 355 bp, Homo sapiens
agtaaaaggaaaacatttacattgatgcaaaaataaagtcaacaaggcttctgtgtgcatgaggccaaaaaattacatttaaaaagtctttgtattccaaacatctaaatatttgagaaagtctgcaaaacaaatgctatttggatcaacttctagggggactgatggtatcatccatgtttctctgatgtgttagcataatagagaatgcagcttccaacaatcaagccagtaactgggcacaaacacagccagctccgtctttgccatcactggaaacatgtgctgggcaagtaacataactgactctttgatggccttctggagtcaaattgtaatactctgattgttcgta

SEQ ID NO: 123088 - DNA, 412 bp, Homo sapiens
gggttcccatagcaacgagtcctccaggggaagtgggcgggtcctcttacccttgggtttctgaacaggactcttccttttcggaagaatttttgaatcaccctttttcatttcttggcctcagcaggtaagggtgagcttatgcagttccaagatgttctttctgagatacttacagattattaacgccgttgtatgggatgataattactagcagccatgttctttcttgatttctcattctttcccaatccttgcactgataacttgtttaacaaacttccaaaatgaagtggaaacaatgttttcttttccttttttagcatgttttcttggaggtgcacatgcctaagaattgtatgcactatttctctaaagccctaagttatatcttatatttaaaaatttaaaa

SEQ ID NO: 123089 - DNA, 501 bp, Homo sapiens
ctgatacaaaagaagtgaactcaaaagaagtaaaaataaaagctagcaaactttgcaactggttaagctggttgtaaacgtacctaatcactttctactgtgaatgatatatttgtattgtgatattttttagctggttattagatacacaaaaaaggtatttcatttttaaaaattgagttagtaaccactcaccttacttacaaattatttgtatattattttgtttagtatcctttctaaatgaatgttttaattgccacgttataaacacatggaaaagtgattcagatgaatgtatatcttagctttgggtgtctagaactagagccaatgtctgattttacagtgatgacatttatttgggaaggcaagtccagggcagcaatgagggatacatgtggaaactgaggcaaaggaagatgtaaaatcatgtgtcatgatgttgatatgactttgccagttgtcgcttcacaatgaggtgagacagacagcatggtg

SEQ ID NO: 123090 - DNA, 394 bp, Homo sapiens
agcactagcagtagctttcggcttgggggagtttcttgactatatcaattgcctgtcatggtggtttccgacccgggcaggtggcatggttctggggctagcagctgtggccaccgtttccctacgccactggtgtctgctgaattcgaggaggggcattagattctttagttcttcagggtggctttgggtcgtgttcttaaaagatcagtctggaatctgatccttcagtcttcccaaagagtctgtaaaccacttaatatcctgccgcaaatccctttctgcttaaactaactagattgaattccgttctctgcaagccagcctgggcgatagaccacagaaccctctgcgctgttcctctccctgtggattcttttttcccaaaccaagt

SEQ ID NO: 123091 - DNA, 243 bp, Homo sapiens
agaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccact

SEQ ID NO: 123092 - DNA, 340 bp, Homo sapiens
gacaagatcctgcatgtatttttaaggtagagccagtatttgcagatagtttagacattgtggtagatatgaaaatgtgctgcctatatcccccttctaggaaggacttgctaattagctgcagggagtgtgaagaacagaaatccaccagtatcagcacttcatctgcaacagctatagaaaaagcttcacctgaggttaccctcgtcttagatctcagggcagccctcagtggagatgtaaggccttgctacttcagcctcatttattacactgtcaggcaaaaccttcctcagagctccctctattacaacttaatttcttcttctgcccaatcctg

SEQ ID NO: 123093 - DNA, 606 bp, Homo sapiens
tgtgtaagaggaatgaaggacatagtcagaaagggacgggcctggagccagcacagagaggacccatgcaaaagagaggccacactgaaaaggggactgcagatgcacctgctgatttttagtttgggggaaatgtgtaacaaacaccatgcatgccaggccttgagccttggtgttgaactcactcttaccaacttcactctacaggtgagagattcccacagcatacagctgatagtcagtgagaaggggaatcaggagagtcagggcccctactccaggatattaaaacaaactaaatggctgagcgcagtggctcacacctgtaatcccagcactttgagaggctgaagtggctggatagcttgagcctaccaggagtttgacagcagcctgggtaacacaggtagatcctgtctctaccaaaaatttaaaaattagccaggtgtggtggcgcacatctattgtccctgtatctctgtctggtacaacctggctactcctcaaaatccattccattctccttcgtggagcttaatccattccagaacgtgcgtgcgcctaagcgatccttatggcgggcatcatcaaccgggaccgagccga

SEQ ID NO: 123094 - DNA, 538 bp, Homo sapiens
gataaactgctttgaagagtatctgttctaacagtatctacacatagtaagcaacggatagatgttagctgctgtcatttgtcatcatcgttgtcgtcgtcgtcgtcatcatcatcatcatcatcatcgtgctcctgccaacctctccggcagtccatgttttcaagtctttgcaaagtcacctacctggagtctccctttctttatttagtgcataattctgtttttctactcagctcttgagtcacctccaagatgccttccctaataaggccctccctgttacactcagggatatgcctctctattcgttcctaatctcagacatactaggatggcaacattaacttttctgggcttttgtcctcccatctgtcaaatgggcaaaatacagcctgtttcgtagattatgctgagactcaaatacaaagagatgagatggtagatgccaaagctttgtaaactctaagactctgtaaaaatattagatttcacttttatttctaaaatatatataccctcttcttgcttttccagg

SEQ ID NO: 123095 - DNA, 377 bp, Homo sapiens
cgcactctagtctgggcgacagagcaagactccgtctcaaaaaacaacaacaaaaaaccaacacatggccaaagtgcagtgacttacatctgtataatcccaatgttttgggaggctgaggcaggaggatcgcttgagtccaggaatttgagaccagcctgggcaacatagacctcatcaccaaaaaaaaaatattttttaattagctgggtttggcagcatgtacctgtagtcctagctactcaggaggctgaggtgggaggatcacttaggcccaggagtttgatagttcgaggttatagtgagctatgatcctgccactgcactccagcctgggccacagagtgagaccctgtctcttagaaacaaaacaaaac

SEQ ID NO: 123096 - DNA, 365 bp, Homo sapiens
cgcactctagtctgggcgacagagcaagactccgtctcaaaaaacaacaacaaaaaaccaacacatggccaaagtgcagtgacttacatctgtataatcccaatgttttgggaggctgaggcaggaggatcgcttgagtccaggaatttgagaccagcctgggcaacatagacctcatcaccaaaaaaaaaatattttttaattagctggaatgcaggtggcacgatttcagctcactgcaacctccgcctcccaggttcaagcaattctctgcctcagcctcccgagtagctgggattacaggtgccctccaccatgcctggctaatttttgtatttctagtagagatggggtttcaccgtgtt

SEQ ID NO: 123097 - DNA, 710 bp, Homo sapiens
gaacgatgtggattttgcctggggcagtcagaggagagccagggctgctgaacggccccaatccagggagaaaccaatctcctttctggctcccccatctgctgagagctacttccactcaataaaaccttgcactcattctccacgtccacgtgtgacctgattcttctggaatgccaaggcaagaaccctaggatacagaaagccctctgtccttgtgataaggaatgtgtctaattgagctagttaccacaagttgcctataaatggcaaaactaaaagaccacacgaccactggggcttcaggaactgtaaacatccacccctacacactgccagtatgagaaaaatttgctgatatgttttctgctgacctgatgacaatgttcctatggtcacactaaccactgctgggtaattttcatcatgactctcgttttcatctgctgaaaccagcctccccaagaaagacaactattttcaaactgaggaaataaagtgttactaaaccacagtgttctctcatggctgttcctggagttcttcaaaacacttgatattataaaatagaattattacagatcactgtatgttatggatttagtcaaaatgataatttaaaatatggtttaaaataaaaaactttattttccaaagaagatagttttttaaacaagaatatccaataaagacagtatgaggtcagctga

SEQ ID NO: 123098 - DNA, 361 bp, Homo sapiens
taatacagggaagttaagatactctagaaaaactcctgtgatgaacttgtaagatttacagaagagaaacgagagacaatagtatttctataactaagtgagaagaggatgattaaccactggcctcagtaattatactgcctctattcttcaggactattagaaaccactccagatcatttctcctttttccattctctactcccagataaaccccaaagtagtagctggatggagcataaacagggttgagacagtatattactgattaatagcacagactttagagctacaacacttatgtctgaatcctagctgtacaacttattcgcgtgtgactatgggtgagttactctgcctc

SEQ ID NO: 123099 - DNA, 459 bp, Homo sapiens
  misc_feature (45)..(45): n is a, c, g, or t
  misc_feature (64)..(65): n is a, c, g, or t
agtgtcagtgtatacatctggggtgattgtgacccaacataggcnactgaaacaatatctatanngggcggatggaaggagaggtgaagttatataagagaattaaaccatccactagaatctgaggttaaaagaatgtggatttgcaataatattaactagcctaatacaacagaaacacagaaattccgatgtggatatgaagaaattttcctttgagcttcaaaatatcttcccacactgtcaagttatggtatcttaaaactatttaaataattacattctatatgactggagttgggaatatcaaacatggttcacttctggatagaatataaattttaaaatcagaaataaggaaagatgggtgtaagtgctgatcctgttaatgactcattatttgaacttgaatcaattgacttacgtctctggggcttctggtacattctgagaatcctt

SEQ ID NO: 123100 - DNA, 341 bp, Homo sapiens
acagtaatttaaaaaaaaaaaaaaaaggtggggggagaaggctcgctatttgataactggcttcttggcgattctgacaaagaaataaactaaggttaaagaacttgtgtaagacggaaatagagtagaagggtatgagaacaagagatggaaaaatacgacgattaaagaattaaatattgaaatagtcaactatgggaatgttctcaattaaaaaaaaaggaagcaggcaaagaaacaaacaaaaaacacattgtgctggccaacactgtgaaagctaaagtaactctggaaatgtatttggatcagttactgtaaatttataattttcctttaggaag

SEQ ID NO: 123101 - DNA, 283 bp, Homo sapiens
ctccgcctcccaggatcaagcaattcccctgcctcagcctacctagtagctgggactacaggtgcacaccaccacgaccagctaatttttgtatttttttagtagagacagggtttctccatgttggccaggctgatcttgagctccagacctcaagtgatgcacccacctgggcctctcaaagtactgggattacaggtgtgaaccaccacgcccggccctttgctaatgtccttttactatcccgcgatccaacattatatttattcatcctgtttccata

SEQ ID NO: 123102 - DNA, 318 bp, Homo sapiens
gtctgaggcaggagaattggttgaatcctggaggtggaggttgcagtgagccgagatcaagccactgcacgccagcctgggcagcagagcaagactccgtctcaaaaattaataataataataataataaatcttaaccaaatgccatttattgacaaatgctgggattacaagtgtgagccaccatggctggccacctttttgtgatatttgaactccagcaatattttttttttctcagaagacaggcataaaaagataacataattacagaaaatcaggttttatatcattgactattgttgcagtacttttcct

SEQ ID NO: 123103 - DNA, 666 bp, Homo sapiens
agcgtgtatgtatgggatgagtgtacataagagtagtaggaaatgagctgtaatgggaagactaaaaactgggaaatattctcaaagttgaaagaggaataatggtaaaaagtacagtcatgcattgcttaataatagaattgtgttctttgggcaattttgtccttgtgtgaacaacatacaatgtacttacacaaacctagatggtatagcttactgcacacataggctgtatgatataggctattgctcccaggctacaaatctgtatagcatgttgctatactgaataccataggcaattgtaacactatggaaagtatttctgtatctaaacacatctaagtatagaaaatgtatagtaaaaatatggtataaaagataaaaaatggtacacctgcatagggcactaaccataagtggagcttgcaggacaggaagttgctctggatgagtctccgagtgaatggtgagtgaatgtgaaggcctaggatgccactgtacactctgtagactttataaacactgtacacttaggctgcactaatttataatttttttctttcttcaataataaattaaccctagcttacaactatttcctttataaaacttgaattttttaactttttgactcctttgtataacactttgattaaaatacca

SEQ ID NO: 123104 - DNA, 325 bp, Homo sapiens
aaatcaatctggactgtgtggaagaatgccataacatgaagctattagcaatctgggttaatgttctacaaaaaaaaatatgctgtctatatacacagaaagtaatgaagaaaaaagcgctgaagtacaatgcatactccttaggttctaaaactctatcagtctaatagaaagcaccaagatacagatgccaaagttagaaaaaatacaaagcagctcagaatcaatatcatatatcttattcaaggtaaattttatgttagattgtttgtctggcatttaggaggctagaaatcccatctctacttttttttttttttttttt

SEQ ID NO: 123105 - DNA, 396 bp, Homo sapiens
ctaaaacaaaacacacaaagccaacaaaaataacaaaaatttaaggttggtggaaaaaaataggtcagtttaacatccacttttatccgtaaggtatgctagacagttaacttctagtcttttgtgtaactggtaccacagaacattactgtggttatcacagtcttggaagaaaacttagagagttatggatggtgaaactagctcagagcaatagacaccctctatattttagtgaaaagaaaattcaaagaattagatatgcgagtctgatttgggccacacctgtggacagcactgttgaactgaccaggttccttcacttttcatacttccttctcctccccttgacaaaattctgagtagacatttgaataaaataacaaaaaagaaagg

SEQ ID NO: 123106 - DNA, 377 bp, Homo sapiens
gttagtgtgggttcattagtaaataggagatcagaaagaagtggaaataaatatagacaactttttcaaggacttttgctataaaatgagggcagaaaaattgagtgatagctgccagggttatggattttattgaatgattgtaggatatttatatattggcaggaattatttagtaaaaagggtatgttactagtatgaagagagagcagaatctttgattagggaaaagagtctcctgtgcgtaagtagaacagttagcctaggaacagtttctagaaattaagacagcagtaaatatgcaagtaaatccatcttgtctccttttggatttcctccatttgaaaattttcttgtaaactttcaaagtagtttga

SEQ ID NO: 123107 - DNA, 392 bp, Homo sapiens
agaggcattcacgtctccacttttcaaccaacccatgtgacaagtatttcttaagtacctcctatgcaggccaggcacgggggctgatgcctgtaatcccagcactttgagaggccaaggtggacagattgtctgagctcaggagctcaagaccagcttgggcaacatggcaaaactctgtctctacaaaaaaaaaagttagccggtcatggtggcaggcacctgtagtctcagctacctggggcagtgtggcggggaggtggtgtgagatgggaggattgcttgagcccaggaggtcgaagttgcagtgagctgagatcacaccactgtactccaatctgggcaacagagcgagaccccatctctgaaaaacaataaaaacttggtgactt

SEQ ID NO: 123108 - DNA, 703 bp, Homo sapiens
gaaggtgaaatctgtgtattcctggggccccgactttggatgttcttgcagataccttagcataactaacagagatcataatgaaaacactggcattgtgtgcattttaaaccatcattgtcacttgtcaagccctacagtcatgcctgaagaaggcaggcagcctcagcaactgtacgtgacggggcatgcttgccttctgcatgtagcaagaaccttgcagacagctgaaatctgaggcattcacacagacaggctaaaagctcaggaagactgcatgagggttattttaaaaagtgctaaggaaacagtgctcccatttaaatagatgaagattcccttcctgttttactataaatatttccttttctctttcagtccagaactagtgcttttaacctttggaagatgtaaaaaaaaaaaaaaaaaatgccttctttaaaggaaacatttctatgggtttatcagtattactgcctaatgtgagaagcattttcacacctattattcatgaactgaggtggcaagaggagggagcagttcctgccaggtgcggttaacaaatatgtcacacgcatcatctattacataggtgatatctcacgtaatcctcagaataccccttttgaagtcgcttctattagtatcctcctttgacagacgaggaaatgaagcacagagaaggtaagaaacttgcccagga

SEQ ID NO: 123109 - DNA, 456 bp, Homo sapiens
tgacaaaactcaccaccctggccaagccatccgcatctcaggagataaccatcttttacccttctcgcggtgctgcagtgagctaatggtcctctgcaggagctgggggaagggatcgaccccgacctgctagctgcttttgcagctttagcagagacctgtagggtgtgaatgcaaagcctggagactcttggttttaatgaaagcaattacagtctgtcggatatgggcctccagacagctgtagcacagtcacctgtagggttgactgaaaatgcagactcacaggccttctcccctggctgccagaatcagcgtctctgggagtggggcccaggaatcagcatgttagacacattccctgggtttctgtggtgctctctgaagtttgagagccaccacctaaaagtctgaaaaagcttcaccaacccctaagtcagagggtgccagatcagg

SEQ ID NO: 123110 - DNA, 143 bp, Homo sapiens
ctcatttatactacttctaggaattttccctaaggcagctatcacaaaaaggcataaaaatatatctgcaaggatgttcatagaaaaattgaacaaaactcaggccgagcacggtggctcacgcctgtaatcccagcactttg

SEQ ID NO: 123111 - DNA, 329 bp, Homo sapiens
tagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggc

SEQ ID NO: 123112 - DNA, 545 bp, Homo sapiens
  misc_feature (159)..(159): n is a, c, g, or t
tgacgttactgaaccagatgtgtacgtatttatttattagaaagctatatcatcgcggttaataatccttgtcaagttatatcccacatctctagtcatagtttgtatgccatgcactgattgtcttttcacccgttgtgtggtcatcctccatatgtngatataaaaggttattagctattgaaatgctggatcgttttcgatattatgtcattactagaagcctggtagcggtggaacggctgtcactatatacacagggagtgaacagtgtgcaaatgttgaatccctctgttagcctccccagaagagagagagagagagagagagagaattgctaaaaatggcatattataaaatcaacaatttgcacatcagtaagaacttttgcttccaggaagatggataattttccctatttcttctactaatttcaactacctactgtggacattatacatagaacaaacctaggacgactcccaaggtgcagagggaaaaacaggctgacctcagcacccaagaaacagcttggtggtgagttt

SEQ ID NO: 123113 - DNA, 574 bp, Homo sapiens
tattatgaaatgacataggtagaatctgagtaaagagcttaaatactatacttaggtcagaatgatgtgggttcaaatcccatcagtttcatcatctaagcccctcatcccccactgacttttcacttcaaaactgcttttggactcaagctcagactgcttacgtgaagttcaaaggctctctacagtttgatctcagtcttttttttttttttttcctggctttagcaagaattttttattccagtcgtaactactcaggggatgtctttgttttagggaagctgttccattctctgtctttggtatgtgcttgggtaggcctttgtgcctctgtctgtgttttaatctgtattctagcatgtgtcagaattcccttcctttttaaggctgaacagtgttccattgtacgtatctacattttatttatctattcatctgtcgctggacacttgggtgacttcctcctcttgggtatagtgaataatgctgctataaacatgggtgtgcagatatctgtttgagtccctggcaaattgtacttaaaaaaatatattttgaagaagatagctta

SEQ ID NO: 123114 - DNA, 548 bp, Homo sapiens
tcattttccccccatctatagaaggctgatgtagaattgctccaaatcactacttaagaatacataactaaggtttattaagtactaacgaggtctcaggaactgttctaagaactttacacatagtaattaaaagaaggcccacagaagtaatgaaaaacatctaccaaatgggtatgtgcatacaggctctcgggaggggacctaggtatcagctcaatggacaggacatttatggagaatgaaacaaatattctcatgtcctaagaaataagaatgcatttcacagaagaaagcagaaacacccactcgcctcgaccttgacttaaacaggcaacagcaattcattcctcctcccgctcggaccccttttcttaaagaattgggcaggactggctaataagggaaccaggcttttcttgcagcccagcctcgcatagggcacaatgcccccaccgcccacccacacataaccagagtaacataagagagatggtgttgttaactcttcccagtatcaaagaaaggccagggtcatggatgcccgg

SEQ ID NO: 123115 - DNA, 528 bp, Homo sapiens
tcagggagacagtatatacagggcagtagtgttactacccaggaaacagcaattaccaggatataagcatatagcgcgcgactatcctctttcccgcagtccctggcaaccaccaatctgtgttccatctccatgggttgacctatcctaagcattccatacaaatggaatcatacgcacaatatgtgatcttgcgggtcttgtttacttcacttagcataatatttttagaggttcatcatattgtagcatggattagtacatttccttccttttatggctgaatactattccattgtatgtatataacacacttgtttatgcattcatccatttagggacatttgggttgtttccaccttttgactattgtaaataataattccattaaaatgtgtatataaacattgatttgagtacctgttttcaattctttggttacatccctaggagtggaactgctagatcacagaataagtctacactgaactttttaaggaactcccaaattgttttccacagcagctg

SEQ ID NO: 123116 - DNA, 391 bp, Homo sapiens
cctcagagacagggttctgagcagaggctcccagagcgctttgttctggtagttatcctgacaattcttgcctgttctcactctcactccttggaataatacaaacagacatcaaagctagcttctgctcagatggctgtagaaaagagagcacctcggaccagagataaggtgacccatgtctctgtggggccagccaggtgggctgtagatggcagtgctgtctcaggctgttcctcagggcccaggtgtgtctgggcggcacaggtggaggaaggacaagagcgctgtgcctgggcgctgcccccctgtctgccatcctgcttcttgtgggggaatacaggtcaagcctattcctggtggagaaatggcctgagggtctcagcggggc

SEQ ID NO: 123117 - DNA, 508 bp, Homo sapiens
ggttcagaattttttcatcctactggatgtttcttttattagtttcttgtcaaggacaaaaggaagattagtttaaacttcttgagtcagttatacctctgatttgtgtgtgtgaatgtttttcagtcccagttagggaagtcaagagttttgtgtaggaagctcttacaggaccatgttgttctcccctgcaactgtgcctttccactatctttggctattaagagtgtgtttacctccatggggaaatgcacatcattgttacgaacagctatggcaaaatggtagtgtcagagatcctcagacaacaaaccgagctgttagtgccggggcagttttaatattcatgaaaagttgatcagcagtgatgttaccataggctgagaaaatatacaggattatctttacacgtaatcagtttcttaagcttcaaatgaccctcttagccacaaaaccggaggcacaaattcagctccagtggttagaatatcaagacctatatcataag

SEQ ID NO: 123118 - DNA, 474 bp, Homo sapiens
tttctcctcacctgttcccaaacaccttttatctctttgtctcccttttcttacagtctctctcttttatactatctctctccccaggctcactttctgtgtctctctctgatctctgtctctttttctttctcttcctctccctggctctccacatgtgtcgttttcttggtggttggcaacttcatctgttcttctgatatcaccattttgttcaccctgcgagtcgatgatgctcgattgcgggttttctgtctctgcggaggcactttcatttgcatctctgatgggttcattatagaacttcaaatgtctagtgggtatccaaacaggaagctgattttctcctggtgaaacacaagcaaaacctctcccccatattatcaccttacctatttcccatgttttgtttttgttgtctttccaccaaatcagttttcctcatgtgggctgttctttttaccagtaaaatgt

SEQ ID NO: 123119 - DNA, 739 bp, Homo sapiens
gtgacttttttaagggactggggtctcactctgtcacccaggctggagtgcaatggcatgatcatagctcgctgcagcctcaaactcctgggcacaagtgatctcacttcagcctcctgagtagctaggactataggtgtgtgccaccatgcccatctaatttttaaattttgtgtagagatagagggcctcactgtgttgcccaggctggtctcaaactcctgggctcaagcgatactcctaccttggcttcccaaagcattgggattacagatataagacaccacactcagcctctgactttggaaatattcataagtttttttttaattgaggaattcagcgttaataagtgaggcaataatcatagaattttacagttcagtttaagagtaaaatgtatctattaaaatggtctctttgtttgatttatacaaaggtgacatatagtagcaggccttggatgtatcagtggtaacaaatttggaatccgttgtaaatataggatctcactggtaaatatactgtgttcatttggataggctaattgtttaaccaacaactcccaaatcactgaggcttataaaaagaaatttatttctcactcacctaatagtttgttgccaaaattggtgaatggccttccaagggatgatgattcaatgatccaggctcctttaatcttgaggttcctagatcctttagtccaggctcctttgatcttgagatttctagatcc

SEQ ID NO: 123120 - DNA, 375 bp, Homo sapiens
caggcatgaacaaccacatacggctctatttaaatgctttctgaaagtagattcaaataaacacaatttccaaatccacagggacaaagcagtaagggaaactcagctatgatcatttctcatgcctgtccattcaccttccatagtagcactacctgggaagaatgagtgtgcatcaggcaaggtgagatgaatatctacccgacattaacttcccacgattccactcctatataagaggcaggtatattctctttttcttccacacatgctttctgtggcatactaaccagcaactatactctttacccattgttttccaaatttaatagtaccttggaaaaaatgtccaagttttataacactaagaagttt

SEQ ID NO: 123121 - DNA, 338 bp, Homo sapiens
ggctgggaagtaaagggcatgtcacatctggccataggcttcttggtgcaccgttccagggaagaaggtagaagaacaaaagagggagagagggagacaaacgcattcctgtatctggagcccactcctgcagtaatggtgtggatccactcgtgagggcagagctctcatggcctgatcacctcttcaaggccccacctctctacactgttgcattggggattaggtttccaacacgtgaactttgggggacacattcaaaccatagcagagggagaggtgagttctgagaaagtgacatttttgttggggtgggagaacgaagaaccaggaggatt

SEQ ID NO: 123122 - DNA, 139 bp, Homo sapiens
ccttaaaaaggagcagctctgaaccattagcagctcaagcaggttgtgaacaatcacacaaaaagaaacacctggtgctctcatcgattttaattttagggtctgaaactgttgagagcatccaggagaggctgagaca

SEQ ID NO: 123123 - DNA, 1072 bp, Homo sapiens
caataagtttcatgaccctgcaacaatgttaaattcttatctactgttttgcttaaagttgtagtattcagacctgttgcagggattctttcacttcctgtaacagtttgcacttcagggttctttaacaagcagaatactgatttaagagcctaactggaggaaattcttgtttcttttttctttttcttttttttttttttttggagacagagtctcattctgtcacccagggtggagtgtagtggtgccatcacagctcactgcagccttgacttcatgggctcaagcaatcctcctgccttagcctcccgaatgctggggatataggtttatgtcaccatgtccagctaattcatgtgctttttgtagagatgggttctcactatgttcccaggctggtctcgaactccttggccaaagcagtcctccttttatgtttctcccctcaactcctccgaggtccaataagggaaatttcaagattttgtaaaattaattatttacttttggcctcagttactttttctgtgaaccacagatgttctccacataatttctaaagttcatcccagttctctgattttatgattctgaataattctggaaatccttggatgcaaatattagcttgtatacagacctgtgaagatagaggccttgcttctgccaggtatcttctataggtatcttatttaccagatactttgtcagatttattagagacctgaaatacaatgctttttcttcattcagacttaatagattcaaatattatggttaattctgccatagaccatttattcaaatattttaaaatctcattttttgtatgattatgtaaaacttaaaaataattagtataatttgaatttattaacacaattatgtaagacacctattgtgagtttttgtaccacatatttgtagcctaataataaatatttattgagttctttatgtttttcaaaggacttttatatccatttattttacttaatcttcagaactgcctagtaagtatattttgtagatgtaaaaattgaggcttagagtagtaaagatacttatc

SEQ ID NO: 123124 - DNA, 471 bp, Homo sapiens
gaaggccttcacgggcagtaacacgcgtggagctgtcacctcctgtgacaatgatgccttcttctggatgccgcctgaaggacctgcctgaggctgttgtacagttacttttttaaataagtaagatgagtactctaaaaatcacgatgaaatgtctagtatagtaaataacctaaagcagtaacatggtcattgatgagaatatcaggtattctgtactgtacataattgtatgtgctggactcttccacgactggcagtgcagtaggtttgtcaatgccacatcaccgcagacacgggagtcatgcgctgagccacggcgctgtgacagctgctgtgataggaagtgttcagctccactagaatcttgtaggaccacattgtatatgtgacctgttgtggatggaaacgccatgctgtgcataactggaaaccggcaggaacctgtcacatggtacaaacaacatgggt

SEQ ID NO: 123125 - DNA, 406 bp, Homo sapiens
catgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgttttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttactttt

SEQ ID NO: 123126 - DNA, 424 bp, Homo sapiens
ctacagcaggtaactaataaaacagactctcccagaaaatgttaaaaggataagatcattgatacaaattctacaagttatcatctcaacttatgtctatgagtacacctaagtttgaaactgaaccaaagttgtcctgctttgtgatacaaaatctgatttgttccttcttcttaaactatatttattagaagaaatcagtctattaataaaactagaattgttttaagcaattaaataggcatgtattttgagggaggagaaaaagacatttatcagattcccatggacacagcagaaagacaatccatctagtataatcaccactatgaaaaatagcacaattttaactagcatgccttacaggtaaaggtatcatatagacacattgctactcacactattctagcctctgtatcaccta

SEQ ID NO: 123127 - DNA, 433 bp, Homo sapiens
aaaaaaggaaatagacattataaatactgggaaaaaaagaaccagaaagacctttataggtgatatgcttgaatacctagaaaactcaagatatgctaccaaaaaaaatctttcagacacctaaaagaatttagtaaggtggctaaatataagatagcatacaaagattagcagcttttctttatgtcttcgtaaattagaaatcaaagttagggggaaaatgtcatttatctttgtaccacacatttaaatatacagtaataaatatcacaagaaaggaacagaatctatgtgaagaaaattgtgaaatttttattaaaggatagggatataaagcactagggtggatagtacaggagataccatgtttgccaaataagggaaattttatggatccaaattaccctgtctttaaccttgaaatcgatgttaa

SEQ ID NO: 123128 - DNA, 875 bp, Homo sapiens
catcttaagcaagtgacgtgatctctcgcctaggattgttgagagaattaaatgagttaatacatgtaaaacacttagaatggttccgcaaacattgttagagcttgataaattattattaataagttgagagaagggagaatgcatttcagatagaacattgagtgataatgaaggggagatactctaggtttgtttgaagtgatgaagccaaattggttagagggatagcttgttggaaattagtggatgaatatgtcggggcacagttatgaataggtaagccaagaagtgtgacatcttttccatatgtactgagggaacttggaaagactcttgggttacttgtcaactcttatgtgttacagataatttctaagtctgtatctccagcatttctaccttccttgatttcaaaataactgaaacttctattcaagctaattttgatagtaaagctcataatcttctaaactgggccattatgcttctttatttgctcatttatttttgtaaatgtttttggctttctctttttctctgtattctagttgtttacataatcctcactccttttctccaaagtttagtgggtttctgctagtgtttcctctctgtcctcaaaaccccagtctagatcctaaatcatcaagccataaggtggaaaggaccagagagagggagaaagggaagaaggaagggaaccatcctctagtccagccatcttgttttacagatgaggaaattgaggttcagaggaagtagaggcatatgctcaagatccacagctaccgaatgagcagggctgcccctttcaggactagatgaaggctgttttatactctcatctcagtgtgattctcagctatctgggt

SEQ ID NO: 123129 - DNA, 308 bp, Homo sapiens
cagatattaaatctcacagaaaggtgttccttattaatctttacaaaattgtcatttccccggtgaagccaatttacattaaaaataatgttcagaaaatgctgctgcctgctttctctcctcttttacccaccccttgttctcccagcaatcttcgccctgtatgtttatgtggacaatttctattgtaacattctccattccattaactctgcctcttcctctgaggggggaaaataaaaccctaaatggctctaatagttatgtattttattttgtctcagaggtttccaaacttctgcttttag

SEQ ID NO: 123130 - DNA, 294 bp, Homo sapiens
tatgccctccttatgctattcctctcaccagaaatgaatgaattcgaatgaatgaagttgctcgcctcctcactcaaagttagctttaaattctctcatcgtcgcaaaggttttcttgataaaagaaaggtacagtataggctgttgatggatctaaattaacaatgctctgttattatttataataataataataatacatctatcttaaactagctaaaaattagctgcaggtatatatagcttgtcttaccttatttatttatttttaaactactacttggtttgtttgtt

SEQ ID NO: 123131 - DNA, 473 bp, Homo sapiens
cattacctgtaattccattacccactgttaaaatgttggtatatttccttctagctgttcccaatttgtatctgtttatatagtggagatcataatgcattatttataattttatatcctgttttttcacttaacattgacatttgtgcattatgttgataaaatcatttaaatggttgcatagctcagcgcaatggctcacgcctgtaatcccaacacaggaaggctgaggcgagtgaactgcttgagctcaggagtgtgagatcagcctgggcaacatggcgaaaccccatctctacaaaaaacacaaaaattagctgggcatggtggtgcacgcctgtagttccagctactggggagtcggaagtgggaggattacttgagcctgggaggcagaggtcgcagtgagccaagatgatgccactgcactctaacctgggtgacagagtaagaccctgtctttaaaaaaaaaa

SEQ ID NO: 123132 - DNA, 318 bp, Homo sapiens
ggggttcacctaaatctcagaaatcaccactaaagaacttattcatgtagccaaacaccacctgttccccaaaatgctattgaaataaaataaataagtaaataaaaggtagattatgaaacagtgtatacacggttgatcccaactgtaatttgaaaaacatgtgtatgcctataaaaaagaacagtagactatacatcagaatattaactggttatttctagtgttgggatcaaggagaattttagttttcctttttatctgtatttttttactagtttctgtcttacgcttaattatgataaaagatttttttta

SEQ ID NO: 123133 - DNA, 603 bp, Homo sapiens
gttccccttctggtgactcaggtggtttgttttttgtttgcttaactgtcctgttgtcttctcctcctccccttggtgaaacttcgctattctcagagcgtatgccatttccatggaggtcccaggtgtttggctgtgagtgggcagtagtggtgctatagaatgaacaagaatgggctcactgggaggatagggcagctgaccatggcctcactctgaatactgattagaacccagtgcctctagggtaggggttctttacctgggagtgggaaggaagctggggggtggagaggattgggaagcctcccagggaagggaggcaatcaagtggtccaggaaccaaactagaaaattgtgtgtctgaatgtgcattttcctggggaaaggatctgttttttgctagattatcaaagagattgaaacctcccaaaataagaatcatcatttcgtctggttcagctgcttctcagcaccctgtgtccatttttatggtctactgctatgctggagaggtcaaggaaatagtcttggggacaggaagctgcccaaaaaggatctctgggcctttttttgtaagacctaattctattactagaaaaa

SEQ ID NO: 123134 - DNA, 434 bp, Homo sapiens
cagaagaaaatgcgtgtataagtggacccacatagttcagacccgtggtgttcaagggtcacctgcacaccaaagaaatgaaaataggacctgaagctggttgattagtgtacattgttttggcctttatgaaaccacattgaatgataattcatgagatcagggtatccaaatcatcttcttctacattgttcctccttaaaaataagccccgttataaacctttggtggactcggtgctgtctgaatccagaagtatgtgccaacagggagcgtcctgccatgtgcatgcattttcattagtattgcctgtaccatttagcttttgctcaagtcctggagatgtctttttccagtcatgcatttttttttcaacttataaaagtaagatccaaccgttattcttaaaaagaaaaaatattgggaagtctaaa

SEQ ID NO: 123135 - DNA, 367 bp, Homo sapiens
atgcttttttagtgagggaagataatgttttagagaagtagtgctagaaaatataagtcaagtctctggctatctccagctaaccatatctgtgcaaagcaaatcatttttccctaatcagttcaaatcaatttctgtaggatgaaagaggagtctgagaagactttttgagaagtaacaaaagagttaaaaatttaccagcctggctaacatagtgaaaccccgtctctactaaaaatacaaaaaaagccaggtgtagtggcgtgcacctgtagtcccagctactcaggaggctgaggcaggagaaacacttgaacccgggaggcagaggtggcagtgagccgagatcacactactgcactctagc

SEQ ID NO: 123136 - DNA, 195 bp, Homo sapiens
gaaaagaggatgcagtttgagtctgagagaacctggatctttctgttaattagcattgcctttgggcataacgtaactaggaaaaaatttttaaagaacaatcctgccaactaaatagtgaagcaattagatgaaagtcaatattaacaagcttctgcaattccagggagccaacggcagggattcagaagcctc

SEQ ID NO: 123137 - DNA, 824 bp, Homo sapiens
ggtaaaaggaaatggttcaattaaaaaggaaagggtcatttaagtaagttactaatttttgtgaacacctatatgtcttagatatgacctgatgggcagagaaggcatactagctttaaattaggattaaatcccggttttacaattaccatgtattgcatttcccaaaataaactactctgaatcttggtttccttatccataatgtagggatgataaaacttgcagtataagctaatgttttaggatgcatttggagactgcattataaggttacagagaagataacaacagaaacatttgagagcttactttgcgcctgacactgtgctaagagatttcaagtattaatatagttataatatagaggttagacagcaagcatcatgtctagcatataatatgcaatcaattaaaatttccatttgtcttcctctcaattttaatttctcatttaatttacattcagacaaatagtcatctagcttcatggttctcaaacctggctgatcattatatatagctttgagctttcaaaaaatactgatgccaagactctaccctgaaccaattaaattacagcctaaagtgcagctgagtttgagaatcatggcttaccttttcttgaactccttaagttagggaatacatactcccttcccagttttgtcaaattgattcaaatttgccaccttataaacatccagctattgcaaagagcctggtatatcgtagagtttcagtatatctatttcatagtttcccccctgtggtcttgcagaatggaattaacctgaattcaacaaaagaggtctttaaaattc

SEQ ID NO: 123138 - DNA, 235 bp, Homo sapiens
cattatcctttgctatggactgagctgtgtccctcccaaatccaaatgttgaggccctaacccaccgtgtgattatatctggagatagcatctttagggggtaaagtcaaataaagtcataagaatggaaccctgatccaacaggactatggccttataatagaaagcaagagaaagatctctctctctctctctctctctctctctctctctctctctctctctctctgccata

SEQ ID NO: 123139 - DNA, 682 bp, Homo sapiens
  misc_feature (499)..(499): n is a, c, g, or t
  misc_feature (512)..(512): n is a, c, g, or t
  misc_feature (520)..(521): n is a, c, g, or t
  misc_feature (525)..(525): n is a, c, g, or t
  misc_feature (539)..(539): n is a, c, g, or t
  misc_feature (543)..(544): n is a, c, g, or t
  misc_feature (547)..(547): n is a, c, g, or t
  misc_feature (551)..(552): n is a, c, g, or t
  misc_feature (554)..(554): n is a, c, g, or t
  misc_feature (556)..(556): n is a, c, g, or t
  misc_feature (560)..(560): n is a, c, g, or t
  misc_feature (563)..(564): n is a, c, g, or t
  misc_feature (569)..(569): n is a, c, g, or t
  misc_feature (581)..(581): n is a, c, g, or t
  misc_feature (593)..(593): n is a, c, g, or t
  misc_feature (598)..(598): n is a, c, g, or t
  misc_feature (603)..(603): n is a, c, g, or t
  misc_feature (606)..(606): n is a, c, g, or t
  misc_feature (614)..(614): n is a, c, g, or t
  misc_feature (623)..(623): n is a, c, g, or t
  misc_feature (630)..(630): n is a, c, g, or t
  misc_feature (632)..(633): n is a, c, g, or t
  misc_feature (637)..(638): n is a, c, g, or t
  misc_feature (642)..(642): n is a, c, g, or t
  misc_feature (644)..(644): n is a, c, g, or t
  misc_feature (657)..(657): n is a, c, g, or t
  misc_feature (659)..(659): n is a, c, g, or t
  misc_feature (661)..(661): n is a, c, g, or t
  misc_feature (668)..(669): n is a, c, g, or t
  misc_feature (673)..(673): n is a, c, g, or t
  misc_feature (676)..(677): n is a, c, g, or t
gcggccgcctactactactactactactacgaaattcgcggccgctcgaccagggattgaggtcttggatactcaaagaatctttcatttctaccagggcaccagatcccttccatggagcaggccatctcgggttcactgggccagggctggtctctgttccccagcccacctggctcacacacagcctcgtgggtagggtcagcagaccagattgcttgttatgtaagacgagaggtctggttgatgatctagcactttcaccaagaaatggacgtggagaggatcagagtgatcaagagtgtatgaagtgcattccaatggtgggcaaaacaggctcctgctcttgtggaggtcacaatctagtggaggagggatgttactagaaatgcacaaagtgggctgaacacagtggctcacacctgtaatcctagcactttgggaggctgaggtgggcagatcacttgaggttagaagttagagtccagcctggccaacntggtgaaaccccntctctacnnaaantacaaaaattagcngggnntgntggnncncncctntanncccanctactcaggagnctgaggcagganaatcncttgnacntgggaggnggaggttgnagtgagncnngatnncacnantgcactccagccngngngacaganngagnctnnatctc

SEQ ID NO: 123140 - DNA, 2042 bp, Homo sapiens
  misc_feature (178)..(178): n is a, c, g, or t
  misc_feature (1177)..(1177): n is a, c, g, or t
  misc_feature (1859)..(1859): n is a, c, g, or t
  misc_feature (1872)..(1872): n is a, c, g, or t
  misc_feature (1880)..(1881): n is a, c, g, or t
  misc_feature (1885)..(1885): n is a, c, g, or t
  misc_feature (1899)..(1899): n is a, c, g, or t
  misc_feature (1903)..(1904): n is a, c, g, or t
  misc_feature (1907)..(1907): n is a, c, g, or t
  misc_feature (1911)..(1912): n is a, c, g, or t
  misc_feature (1914)..(1914): n is a, c, g, or t
  misc_feature (1916)..(1916): n is a, c, g, or t
  misc_feature (1920)..(1920): n is a, c, g, or t
  misc_feature (1923)..(1924): n is a, c, g, or t
  misc_feature (1929)..(1929): n is a, c, g, or t
  misc_feature (1941)..(1941): n is a, c, g, or t
  misc_feature (1953)..(1953): n is a, c, g, or t
  misc_feature (1958)..(1958): n is a, c, g, or t
  misc_feature (1963)..(1963): n is a, c, g, or t
  misc_feature (1966)..(1966): n is a, c, g, or t
  misc_feature (1974)..(1974): n is a, c, g, or t
  misc_feature (1983)..(1983): n is a, c, g, or t
  misc_feature (1990)..(1990): n is a, c, g, or t
  misc_feature (1992)..(1993): n is a, c, g, or t
  misc_feature (1997)..(1998): n is a, c, g, or t
  misc_feature (2002)..(2002): n is a, c, g, or t
  misc_feature (2004)..(2004): n is a, c, g, or t
  misc_feature (2017)..(2017): n is a, c, g, or t
  misc_feature (2019)..(2019): n is a, c, g, or t
  misc_feature (2021)..(2021): n is a, c, g, or t
  misc_feature (2028)..(2029): n is a, c, g, or t
  misc_feature (2033)..(2033): n is a, c, g, or t
  misc_feature (2036)..(2037): n is a, c, g, or t
ttttcagtgggccccagataatgcctgtaggagaggccagtactccaaaggtggccagggccttcaggctgccagtctcagcttccactggaattccagtgatgtctcatattggggaccctacaatgccttaccctggcctctcgacagtaccttctgatgaaacattgttggcctngaccatgccttccactgaggcccaggctatgccccctccgtggctcagatgttgcccccacaagatgcccatgatcgtgggatgccccgagctgagtcccagtcattgctggttttaggatctcaggactctcgtaagtcagccagactcccaagcaggcccattcctaccggagcatcccagacctgctccacagacagcagagcagaactccaggcctcaggaaaggactggtagacggggctcctcagaggcaaggccttactgctgcaactacgagaactgcggaaaagcttataccaaacgctcctaccttgttagccaccagtgcaagcacatgggtgagaggccctatttgtgcaacgggaaaggtgtttatggtctttcttccgttctaatgagcgtagatgacatacgtgggtacacaccagacattgaccatataaatgtgatcagtgcagccaagagttcatgaggtctgaccatctcaagcaacaccagaagactcattggccaggaccctcagacccacgggccaacaatggacagcaggacggtcctgttcctggtccttaggtgaatgaaggaagaggattctaggcagagaacactggacctggcaactgctcagaggagaggcagtcttcaagttctatattcattcagcaaatgttttttgagcctacaatactgagagcaccaaggctgtggggacccatggcgaggagcatggagataactaaagaatgtgtcagggaagaaagacttctcaaggaggtgcctcagtcagatccaaaggactcatggcggctagctgcacctcccatttcttggacatataccattggacatgtctctatcttctgaaaactatggcatggacagtaaggattcagaggtgtatgaaggcaccctgcctctgcagagcagaaagatcatagacaaaatttctgaatgtgcccagtgctgccaaggagataagctggtcctctacaggcncaagcttatctgggcctctagagaagcccacagccttggctgtgtctgccctgctctcccacccctaccctgaccctgtcctactttgctgcctcggtctgtgttactagtggccccagtatacctgggatggacatccaggtgccctccatccaagctcccaagtgaggggagtggacatgattaaaagaacaggagcagaaggggctcatttttgacccattcactagccccagggattgaggtcttggatactcaaagaatctttcatttctaccagggcaccagatcccttccatggagcaggccatctcgggttcactgggccagggctggtctctgttccccagcccacctggctcacacacagcctcgtgggtagggtcagcagaccagattgcttgttatgtaagacgagaggtctggttgatgatctagcactttcaccaagaaatggacgtggagaggatcagagtgatcaagagtgtatgaagtgcattccaatggtgggcaaaacaggctcctgctcttgtggaggtcacaatctagtggaggagggatgttactagaaatgcacaaagtgggctgaacacagtggctcacacctgtaatcctagcactttgggaggctgaggtgggcagatcacttgaggttagaagttagagtccagcctggccaacntggtgaaaccccntctctacnnaaantacaaaaattagcngggnntgntggnncncncctntanncccanctactcaggagnctgaggcagganaatcncttgnacntgggaggnggaggttgnagtgagncnngatnncacnantgcactccagccngngngacaganngagnctnnatctc

SEQ ID NO: 123141 - DNA, 441 bp, Homo sapiens
ccagggtttgttatgttatgtatacataaggtgcattagcatgaagttaatagctatgctgtaaaaccaccatgggtgatgttcctgaaagaaacaggatgcagctgggcgcggtgactcaacacctataatcacagcagtttgggaggctgaggctggcggatcacctgaggacaggagttctaggccagcctggccaacatgtgaaaccctgtctttaataaaaatacaaaacttagccaggcatggtgaggcatgcctgtagtcccagctacttgggaggctgaggtgggagaatcactggaacccaggaggcaaagcttgcagtgatgagatcgcaccactgcactccagcctgggtgacagaacaagacgctgtctaaaaaaagaaacagaaagcactggggtcatgtgacagcctctactgttctggatattgtc

SEQ ID NO: 123142 - DNA, 797 bp, Homo sapiens
gtctttggagagtctaattgcctctgactacatttcaaatcagtacacatttatatttgataagggaatgcatgccttttgttgcaacaaataggtgcactgaaatgaagacactcaagatcacggggtgtgtcaggagctgtcaggaccaccaccaggttccttgtttctctagatggactcaacaggactcaccatctagacctactcgtgaccgatttattccagtgaagggatacaaagcaaaaccagctgagggagaggttgcataggacaggttagcagggcaccaggctccctcttcctcagtcctctcccaggggcatcacaccggatgtgcctggctcatccagcatcacattgtgacaacacctgttccatgttatcgaccagggaagctcaccagagtctgctggtgcaaggtttggtttggtttggtttggttttgggtcagagttttgctctttcgtccaggctggagtgaagtggcatgatctcggctcgctgcaacctctgccccctgggtgcaagtgattctcctgcctcagcctcccaagtagctgggtttacaggcacccgccaccaggcccagctaatttttgtatggtagtgcaaggttttgatcagggttcatgcacacactgcctcgcacaatctgaatcttctggactcccggaggaaaccaagggttccgtgtaaaccacattgtttatactgattattccagcgaagggatacaaagcaaaatcagaagagggagaggttgcataggacaggttagcagggaaccaggctca

SEQ ID NO: 123143 - DNA, 362 bp, Homo sapiens
ttgggtcccaaacctaggtgatgtaactctactgcttaggccctgcctacagaggacattgtgacatatccctgcatccatcacacaggtaatgcagctctcttctgcttggcccctactcacagaaaggattgtgatgtatcacagggctcagcacctagctaacatgacttttctcctcttctaggtttttgcccacaggggatattgtgacatgtcactgggcctaatactagggtgacagtactcttgtgtcatggcactgccctcagcaggtgtggtgatatattactgggcccagaacaaatgtgatatgagtctcctgcctggaccctgcctacaaggtgcattgtaacatatct

SEQ ID NO: 123144 - DNA, 534 bp, Homo sapiens
tgcttctggaagagggagggccagtgagcctccagaaggttgtttgtgtttctccacacccagagctagacgtgcgacacacacacacacacacacacacacactttaagcaaacattggactaaggcatagctggacggcacctctacttaggaaacagcgaggagatgtcaattctctttgttatctggggtcaggatggacatttctgggagcactatccttcttcctgtcaaactgtagaacttgaaactccagctgggcaccctggctcatgcctgtgatcccagcactttgggaggccaaggtgggaggatggcttgaggccaggagtttgagaccagcctgggcaacacagcaagactccatttcttcaaaaaataaaattagacgggcatggtggtgcacagctgtagtcccagctactggggaggctgaggcaggaggatcgcttgagcccaaaagttcgaggttgccgtgagcaatgtttgagccactgcactccagcctgggcaacagagagagatcctgttt

SEQ ID NO: 123145 - DNA, 335 bp, Homo sapiens
tcataactatcagaatgatcatgcaattttaagtatgtacaaggcatatctatttggtgagctcatccttcctcattaatggcaacttctccgcttagggtcccaagaatgtactctgggtgacaatagtctttacctactctaacttctttccttaggcagaatctccaattagaagtgaaacagtgatcatattcaggattaaacacaaactttctggtggctcatgcctgtaatcccagcaatttgggaggccaaggcgggtggatcacaaggtcaggagatcaagatcatcctggttaccacggggtagagaaaccccatctctactaaaa

SEQ ID NO: 123146 - DNA, 371 bp, Homo sapiens
tgaaggattacacatttaatttgagtaaatggtttgatagactgatgcacatgaatgcttctaggaggtgttctgtttcaacatccagtaattaaaaaaaaaacccacacgcacacagttgatactagaaaaccgcacacttttaagaatttcatcctatgtaaatttgtcctaaacctttttctttaaagtgattagtagaaaatttttttctttcttcagtgtgggtaaatcagtggatgaactattttgttcaaagtttagctccattgtgattcgccttatcctgcgactaacattgtaaaagatcccagtgcagttccgagctgagtgtggccctcgtgcccgaatttcttggccttcgagggcca

SEQ ID NO: 123147 - DNA, 1774 bp, Homo sapiens
tgaaggattacacatttaatttgagtaaatggtttgatagactgatgcacatgaatgcttctaggaggtgttctgtttcaacatccagtaattaaaaaaaaaacccacacgcacacagttgatactagaaaaccgcacacttttaagaatttcatcctatgtaaatttgtcctaaacctttttctttaaagtgattagtagaaaatttttttctttcttcagtgtgggtaaatcagtggatgaactattttgttcaaagtttagctccattgtgattcgccttatcctgcgactaacattgtaaaagatcccagtgcagttccgagctgagtgtggatatgtttaccccagtgatatcattagtgtaagatgatggagtaaaatgacatttagttattttgataatgcaacctgtgtcgattctgctggcatcctcaatcagtccaagtaaaagaaatacaggaagggagagggcttttatttttaaattaagatggcagcattaatttcactaagtgttcttttagaagtaaatgttggaaaatcagcaggaacatgggtgtaatgctttctggtcctccttccaagtaatgccatgagctttgacggtgctgtaattaaatagaaagcaaaactgtggtaagaaaggagtgtggtttgaagtggaaaaattgacagtgctgttaagattccgtgaatggtacagattcatctcttctccgagtgccttcaaaaaaaaaaaaacaaaaaacaaaaaaaaccctcgcttctgattacaactaattaaaaagaagatgggtccgcttgtattcccccaggacaagtttaggcaagtggcttcctgggaattgtgtccattcttttctctattcttggggccaaatgtaaatggccttttggtgttttcctgtgccctaatggagcaatggaggatgtgtgcccagccctgagccttaattaatggcatctacgttcttacttccttttttccctctgaatctggaaactggagccaggctcgctcttgaactacatgctaccccgaggaccttagatctttctaggagagatgagttctagctcagtacgaaattgatggcctcacacttagctcagggctaccagcagctgagcgccccttcccctccaatttaagagattactgaagtcttccttcagtgttcctctctcagcccatcaggatgtccaaagggtgggaaggtgcagacgttgctgttcctctcagctaccccctctccaatgtccctcaagtccacttgttggaggagctttcaatgccgcagggaccgctgcagaagagtggagtaatctgctcgcccgccgccaggtgaaggggaccccttggtccgactgagaccacatagcgatttactgaggggcttttaaactgtcttgactttgagttgtggttttttgaaaacaaccaaggtcttgctaaaaagctgcgggagagctgggaaaggccggcctgagcgcgggggagggggctgcaagatgagggggcgctttcaccagtcccctccccctccgcggccaagtgtcgatgggcagagctgggcttctgcctcctctccctccaagatttcagataaagcggctgccttgctgcagcgaatccgcacaattaaaagctttaattagtggctcctccattttcttagttctgatgggctttatctaatgagatctggtctctggcttagatctgctccgaatgacgtgtccgcaatgaatgagagctgcgtcgcaaaca

SEQ ID NO: 123148 - DNA, 1560 bp, Homo sapiens
  misc_feature (1559)..(1559): n is a, c, g, or t
tgaaggattacacatttaatttgagtaaatggtttgatagactgatgcacatgaatgcttctaggaggtgttctgtttcaacatccagtaattaaaaaaaaaacccacacgcacacagttgatactagaaaaccgcacacttttaagaatttcatcctatgtaaatttgtcctaaacctttttctttaaagtgattagtagaaaatttttttctttcttcagtgtgggtaaatcagtggatgaactattttgttcaaagtttagctccattgtgattcgccttatcctgcgactaacattgtaaaagatcccagtgcagttccgagctgagtgtggatatgtttaccccagtgatatcattagtgtaagatgatggagtaaaatgacatttagttattttgataatgcaacctgtgtcgattctgctggcatcctcaatcagtccaagtaaaagaaatacaggaagggagagggcttttatttttaaattaagatggcagcattaatttcactaagtgttcttttagaagtaaatgttggaaaatcagcaggaacatgggtgtaatgctttctggtcctccttccaagtaatgccatgagctttgacggtgctgtaattaaatagaaagcaaaactgtggtaagaaaggagtgtggtttgaagtggaaaaattgacagtgctgttaagattccgtgaatggtacagattcatctcttctccgagtgccttcaaaaaaaaaaaaacaaaaaacaaaaaaaaccctcgcttctgattacaactaattaaaaagaagatgggtccgcttgtattcccccaggacaagtttaggcaagtggcttcctgggaattgtgtccattcttttctctattcttggggccaaatgtaaatggccttttggtgttttcctgtgccctaatggagcaatggaggatgtgtgcccagccctgagccttaattaatggcatctacgttcttacttccttttttccctctgaatctggaaactggagccaggctcgctcttgaactacatgctaccccgaggaccttagatctttctaggagagatgagttctagctcagtacgaaattgatggcctcacacttagctcagggctaccagcagctgagcgccccttcccctccaatttaagagattactgaagtcttccttcagtgttcctctctcagcccatcaggatgtccaaagggtgggaaggtgcagacgttgctgttcctctcagctaccccctctccaatgtccctcaagtccacttgttggaggagctttcaatgccgcagggaccgctgcagaagagtggagtaatctgctcgcccgccgccaggtgaaggggaccccttggtccgactgagaccacatagcgatttactgaggggcttttaaactgtcttgactttgagttgtggttttttgaaaacaaccaaggtcttgctaaaaagctgcgggagagctgggaaaggccggcctgagcgcgggggagggggctgcaagatgagggggcggctggtggctcggcggggggtcctctagaacgnc

SEQ ID NO: 123149 - DNA, 189 bp, Homo sapiens
ggaataaaaatgtattaagacttgagctgtatgtgttttgaatctcatttttataaagcaggcctttgtgagtagggacagtgggcagtgttatgacaggtaagttacatggcaatgaattttgtctgcatgtttgccaaaactttctaacagagatataaaaaagaagagagtgggctgggtgcggta

SEQ ID NO: 123150 - DNA, 556 bp, Homo sapiens
ttccccattttgaggctgtttgagatcacctgattttttttttaattgtgttacaaaaaactaactttaagttttaactgttttcaacagggaaaataacacactcctcggggaaaggtgaagggttgagaagacaggccctgggtaaaaatttttacaacacctggagttgataggcctacctaggagagaacacaggcactgccacaccagcacaggggacagctgctgtctggggtcagcagaccagttcacacgccacacaaggttgctatagatccaaatcataaaaatcttccagctcatcatgaaacaagtcccactcatcttcagagtctgccagttcatcatccccacctgcagccaaaagcataagcaacatctcgcccacctcaagaggtgacaacctcttcatcattgtcaaaagggttgctgctatctctttcctcagtgagttctcagaagtggttccttcattggacccagtttctgcttgatgttcccactttctgtctctgtggcttctctgtaaggccatcagggtacgcatgcttgt

SEQ ID NO: 123151 - DNA, 403 bp, Homo sapiens
catgccagggcccccaggcagccagcaccagcccaaaggccacagggctggggaaagctgatgtcctgttaggatggctcccagggacctctgactcaaggaagggtgaccttttgtttcctactctgctgagaaatcacttgattcttcctcaaatgaatcaccttcctgaaccccagattcttctccaggaatatgggggccatcttgttatggggactatcttgttttccagtttcctgcctaccctaaatactttgaggctgaattgcagattttcagtcattttaccttctcaggtaaaagccatgaaagaaacaagcctactccaccagccaaagcacttgcccatttgctggcttcatgaaccgcaggtgggaggtgtttgtgttaaaaaacagca

SEQ ID NO: 123152 - DNA, 419 bp, Homo sapiens
agtgttcctaactgcccagcgcccatgcagaagggccagggggtagagcacccatgtgatgaatgccaaccaacagtgtacttgccatgccttcaccttgcaagcagggttcttttgtaattagctctcgaatgacagcaactctgcccctgaaatgggtgctctgcagtgattaagggctagtgttagctgtaccagggagatactgctgtgaggaggtgcctctgtttggtgtctgtgaaacattagatgctatttaaagtgatagcggttcttagctggctacttggcctctgccatctgttagtgtgattaggctggtctgattcacaggtgcagcctggggcggctgagattaagcagctgtggtctgtgtggacagaggaatgccacggccggggtaattggcaaggcaggaa

SEQ ID NO: 123153 - DNA, 542 bp, Homo sapiens
agcaaccgccgcccccggacctgcggagtctgggcttcggccggagggtgcggcctccccaggagcgggccctgctggtggtattcaccagatcccagcgcaagaacctgttcgcagagatgcgcgagcagctgggctcggccgaggctgcgggcccgggcgcgggcgccgaggggtcgtggccgccgccgtcgggcgccccggatgccaggccttggctgccctcgcccggccgccggcggcggcgcacggccttcgccagtcgccatggcaagcggcacggcaagaagtccaggctacgctgcagcaagaagcccctgcacgtgaacttcaaggagctgggctgggacgactggattatcgcgcccctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatc

SEQ ID NO: 123154 - DNA, 162 bp, Homo sapiens
aacagtgacaaaaacagaggagggggcagacagagagaagagacaggagacagagaaagaaaggagatggaggaaagagaaagagttcaggcacacatttgtatgtgtgcgtgtgagtgctcatgagtgtttagagaaacgtcagggagatgaagagagaca

SEQ ID NO: 123155 - DNA, 551 bp, Homo sapiens
ctctagagtgatcccccttttcacaggacaaaaagagggagtaggttttcaaatccctggcatgaaggagaaaacacacttgttgatgaggagccaacagaagattcacaaaaaagaagctggaggaagaggagttgcgtagaaggagaagcacaaccaagtgttccttcttagggttttggaagctggatggaaagaacgtacttaccaaaggttacgagaggaatgctgaccctcttctgtgaggtccctgtgtttgatgtgtttccagctctgatttaggcttatgctgtccttgctgggcctttgtgaagtatccagcaaggctggaacaaagcactttattgtagtgcatgaaaaatatctttgctgaaagagacaatgccaaggctagggggactaaaattagaccttccggtgtgtttgacttggcaagttgtatggcctcctccacctgcctccctcccagccgtgggccttctgagagcacaggtagcatgtgctgaaggagaggaagtgccgcttcctctggcaacctgtggggatgacaa

SEQ ID NO: 123156 - DNA, 387 bp, Homo sapiens
ataacatcagggaaaatatagaggagaggtcacattacatttcatgggtcaaatgcagcctgccgcatgtttttttatggtccacaaacgaaggatggtttttatatttttaggtggctgagggaaaaaaaaacaagaattatatgaaattcagatttcattatatataaagttttattgggactcagctatactcatgtatttatgtgttgtctgttggtactttcatactatgagggcagagttgactggttgcagcagagactgtaatggcccacaagcctaaaatatttactgtgagaccctttacagaaaatgtttgctgatttctgataaagagttgatgaagagtaaaacaaaaatgtcatgtaagtgaatgcagatctt

SEQ ID NO: 123157 - DNA, 215 bp, Homo sapiens
agggggtaggagccttgtagggtggaccagtgcattgagggtgacagcagcggtggttgtattggcatcagcgctagtggtagcagcagcagcaaatctggggtcagggaagtgggagtgggagagctgtggcagcctgcctggcctggcctggcatcagtaggaacctgtgggtgctgtaccgtgggcctcagtggcagcggtggaggagcagc

SEQ ID NO: 123158 - DNA, 350 bp, Homo sapiens
gacttcatgtcacagttggaaacacatctccaattgccaaatgaaatacaattaggaaaacaaagtgcaatagaagaacttacttctacttaagacaaattttcatgagtgcttctgttttatgtaccaaggtattcctttattttccagaggttaccaaatgaagagagtaaaaagagctttcatatgatttgacgatggtaatttaagttctattttaatttctattcctcaaatctatacccctccactcccaaagtcaaatgccacctatttggattctacctctgtgtactcaaagagaagctggagacaatgaaagttcaagcatgtagactggcatctggaat

SEQ ID NO: 123159 - DNA, 556 bp, Homo sapiens
tcacatactataagtgttctaactttgttcttctttttccaaaattgtgtttttgaatcagcaagtcaaattctacaaaacaaagagccttctggaatttcaattgaaatcatgttaaatatatagatcaatttggggagaactgatatcttaacaatattgagtcttccaatctatgagcattgtatatctccccatttcactaggccttatttaatttttccagcaacattttgtagtttccagtgtagaagttttacacatttttcctcaaatttatccccagtatttcataagttttgatgctatcataaattgtattgttttcagtttcaagttctaattgcttattgccagtacatagaaatgcaaatgatttttatattggcttatatactgcattctcactaaactcacgtattagttcagttgatttttttttcagattccctacgattatccacatagacaatcatgtggtctgtgaatgaaggtagttgtatccttcttttctaatctgtgtgctttttattactttctcctgccttactgcact

SEQ ID NO: 123160 - DNA, 272 bp, Homo sapiens
ctgtatgtgcatgccacgacgcctggcttaattttttatttttttagagatggtttctgcatgttgcccaggctggccacagactcaagcaatcctcctgccctagcctcccaaagtgctgggattacaagcgtgagccactgcattcagccaaagacttcttcttaagacctttatatatttgcaaacattctcttaatgccatagtcattataatgaaagccatgagtcccacagagtctttctgagttctactccatgagaaccactgg

SEQ ID NO: 123161 - DNA, 297 bp, Homo sapiens
tcgtctctaaggttccccccccacgatcaccgcatccaggcccaggcctctgtccctcctctgtggtagaaaggtggaatagaatgtggggtgtgctgaggtgtgagatgtggtgatggtgctggtggtgctggtgatatgatgatggcagtgatggtagtgataatagtgatgataatgtgatggtagtgatggtggtggcagtaatagtgatggtgatggtggcagagagggtggtgacagtgatgtcagtggtaatggtggtggtgatggtaatggtgatggtggtggtggtga

SEQ ID NO: 123162 - DNA, 402 bp, Homo sapiens
tggctatatgctcaactgtatttgtgatgtgtacacacaaaaagaaattctaaaatcttcaaactccaaatgttaaaggcatcatgtatattattctgactctgttaatactagcaatattatcattcctaacttagaactcccaaaaaaagtcaagtaggcaagaaatgtgtcctgtcaatcttaagagagattcaagaaacatgttgtaattataaaacaggctgcttaggaaattattaccctgcatacacaaatagcagcataaattctatgactgttaacagaagtattcagtatatatttataatatcacaggcagatttctcttaagtaaagactatcacaattatcatttcagtaattttccccaaagctattatatgcattataatcaaaaaa

SEQ ID NO: 123163 - DNA, 1034 bp, Homo sapiens
tagaaagctgtctcaggggaacacatggctaagtagattggcattgtttataaacataacataataaaatccctttttaaatatgtttgtggaatagtaggagatacttcccacttgggaaacaaatactttaaccacaaggattccttgcaggtccctaccctttctccattggtcttctaaaagtgtgcttagaggcacttgatttgaaggtgagttaaaataccaaggacctcctgtactattctttcaacagcaaagcagaattatctggaatcattagcagaggatgattggttgtgcctggtaatgggtagtaaagaaccaaagtaatatcaagataattaaaacaaaaccatatctgaactgtctaggaaaatggttgggttcaagctttattaagttcctagtgtggacctggacataggttcttcagtttcacttgtgtctttgtaaaaggtgtattccagctcctcttatgatgccttgattagttgaatgacattgaaacacttccagtttggtgggcaataggaatgtatgtcacataagctgagtcctttgcagaatgtctgtgatactgaccatggcaaatgtgtgttattgaatttttggtcagggatttttagtgcaatatagaagagtttagtttgagttttagatcccaagtattcctttcttcccaacccatattatacttggtcaaataaagtcagggtaatcaggcagcctgaaaggaagcagggcatctacctgcctctctggtcagatggagtaattaggaacaaaaaaggccactctgttgttagccacacctatttatcaagaacaaaggagcatagcattttaaattcatttgagctgaaaccctggctggctcagactcttacttgtcttatcacgcaagatcagctttgtatatcattttaaagaggtcgtgtggcgtgttttcctgacttctgtcatctcaagttaaatatgtcatcagaaaatatatatcatccagaaaatggtggctctctcttcctgtgaga

SEQ ID NO: 123164 - DNA, 340 bp, Homo sapiens
tgttgctctgacgggagtccttttcagtggatgtctcatccttcttagtgcctcaaactagatctagttcagaaaggttatcagaagttaggacaagtttattttagtgcaaaccagtggaaatccatgcatcgtttcttcaccatgtgcattttctatgaacctttggaagaccacctgtgttgaacattgcccaagtcctgggagagaagtgggtgcggtccgcttcctgtcctcaatttgcccgcagcggcggagtgcacagagcagggaaaggcagccccagagggatcccgccctccagcatgcagcagactgctggcccagtcctggctccaag

SEQ ID NO: 123165 - DNA, 479 bp, Homo sapiens
ccctgcacccagtgtacccagcctttaaaacctgcgccccccttggcacaatgtctaagtcttgtgccttcggaggggctgttgggcccactccaggggtgcccccttgcttgccagtcgccctggcttctgcatatctctcgtagcccagatgctgtgctttacttcttgcagtttatattccaaaagtcaaatgtatttttgtgttttccgaatggaaatgtttgagtgtagtttgagtatggtttttcaaactcccatcgtcccaccttgacaatcactgctgtggttgtttctctgctgcccacctacgctccttgtgcctctgcctaagctgctttgacatcatctgcttttgctatctgtcattttcctacatccttcatttttagcatgttacacagcctacatatatttatttatagtaaagggtactgagaaagaaattaaaagtagatggggaaagaaaggtaggacta

SEQ ID NO: 123166 - DNA, 557 bp, Homo sapiens
atttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaa

SEQ ID NO: 123167 - DNA, 457 bp, Homo sapiens
aaggctatagtaaccaaaacagcatggtactggtataaaaattatacttggaaaaatagaactgaatagagaacccagaaatattacttacctataaacaactgatctttgacaaagttgaaaaaaatatactctgggggaaaggacaccttattcagtataattttttttttcagagacagggtcttactctttcacccaaagctggagtgcactggtgagagctcaatgtagcctcaaattcctgggctcaaacagttctccagcctcagactcccaagtagttgaaactacaggcatgcaccaccatcctggctgataccctatccaataaataatgctggcataattggagagccatatgcagaagaatgaaactggacttctatctcttaccatatataaaaatgagctcaagatggattaaagacctcaaactacaaaaatcctaaaacct

SEQ ID NO: 123168 - DNA, 337 bp, Homo sapiens
tgatcctcatgaagtgtttcaaagaaatagagcacctttctgtaaaaatagatccacgtaaagttttcaaaatattcctgagtctggcaagggtgggcctacctgaagtttctcctgacacactgttaattagctgctttgtaggtaggcatgtattcttcagtttgccagaaccccttgcatgccttcatttagtctacctgtaggcattgttgggtgagaaagggttttgaagtgggaaagcttgcaaagactgcttttaacggaaagtttcatgggcaggattgagaccaagagggaagaaacttcaagttaatggactaccttgaaattttag

SEQ ID NO: 123169 - DNA, 160 bp, Homo sapiens
catgactttaccagagatcattgcttacttttgtagatatatattaaaagcaaatatattccattcccagatgttcttttctgtatcaaaattattttttaattttatgtcatttttttcaacttttatgttagattcaggggctacacgtgtgggtttg

SEQ ID NO: 123170 - DNA, 797 bp, Homo sapiens
atggggcggtgcggcagcgcgaagcctgcagtcctaaacgctgggtagctccgggcttccgagggggtgtgtctcccgcctctttaacctggcaggggcggttcaagtggccggggaaatcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttaccca

SEQ ID NO: 123171 - DNA, 366 bp, Homo sapiens
ccaaatgtgagtttaatggaggcagatgtacaagggttctcacaagcccagggaactcaacttctagaaggaaacggggccacaccaaacaagatgatggggcaatcaagagatactcccataacagcaagaaacaaagagcattcacgcctcctatgccaacgccctccaccaccaacgccaaaaatttccgtatttcataacaccagctgagataactgactcaaatctgtgcacttccacatttgcatactgggttctgacatttgcctaccactgaacagtcaccaagtaagacgcaaggtggagacgtacccacaaagcaatatttaatgtctttggatcgccactagctaaaacctcctg

SEQ ID NO: 123172 - DNA, 516 bp, Homo sapiens
ttgtgctacagtattactgaagagtataatggaagtaatgtcctgctgaaaattttctttgagatattaatcattaataatttatatattgctatttaatacttacataggtctttagccttttaaaggatttctgtttgacagcttttataattgaaagttattccattttttttttaattttgcatgcttgaaaaagatgaaaacagtgatttaaattatgaagtatggggccaggtgcagtggctcatgctggtaatcccagcactttgagaggctaaggcaagtgggtcacttgagcccaagagttcaagaccagcctggccaacatggtgtgaaaccccgtctgtactaaaaatacaaaaattagccaggcgtggtggtgcatgcctgtaatcccaggtacttgggaggctgaggcacaggaattgcgtgaacccaggaggcagaggttgcagtgagccaagatcacatcaccgcactgcagcctgggtgacagagtaagactctgtctcc

SEQ ID NO: 123173 - DNA, 904 bp, Homo sapiens
cgctgcagagggacggcgtgtaccgctggttctcggagctgccgtcgccgcagcgcgtggagttcctgtgcggcctgctggacctgtgcatcccgctcgagcttcgcttcctcggctcgtgcctggaggacctggcccgcaaggactaccactcgctgcgcgactcggagatcaaggccaacaacccggccgacctgggcagcctcaccaacctgacggacgaggtggtgcgcagcaagctgctggtgtcgctggcgctgctgggctcggagcagcgcgaggcggcgggcgtgctctaccgcacgctcacgcacatcgactccatcatccacaactacgggctgcagcttaacgagggccgcacgggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaaggtcactccaagaactgaggcccctgtcagccagtgtcagtaatagtttggagaatgccctgcacacatcagcacattccacggaggagtcgctgcccaagaggcccttaggataacacagcacagtgagctgtcgagcaagactgcacctgagcggcgcttctcacacacaaaaaaatgacagaaactgtcgcctggtccctttcagcgcctggtgggtctgattcttcaatacacatcagtaaaccaaatccttcctctgaacgtgacggcacttactttccaacgctatgtacagcactatcctggaaggacgaccttggacaaactcatcccttgcctacccatgggtcc

SEQ ID NO: 123174 - DNA, 256 bp, Homo sapiens
cagagtgattaaggaacttgcccaaggttacacagctaccataaggcagagcacggagtcaagtcctaggcagggctgctccaggtccccactcttgaccccatggcccactcctggcagaggctcaggcctaaggagccttgggaggacgaatcccaggagggttccctagaccttctttttttaaaattttatttattcactttttttaatttcttccaaaaaaatgggatacatgtgcagaatgtgcaggttt

SEQ ID NO: 123175 - DNA, 304 bp, Homo sapiens
cagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactga

SEQ ID NO: 123176 - DNA, 418 bp, Homo sapiens
aagctgtgtgtcctcatgcctcactgtataccagaaagatacactcgcttcctatcagatgaaatgttgaccataaccaggagatttttgaggtacttcatcaaatcatacaaaagggaaataatatttcttggcaggctaatagggaataatcactgagggaagcaaagtactgattttaaaagaaaacatccttattcagccaaggttgaacggcccagggcgatatttcaaattaactacacacgtttcctaaaattagttgtcataagcagttgctattgttggacacctttgccgacaaagatcagctaaatgtatttcagcctgaaagccaggaggccaccactgccattttccacaccatgagaaatgttcttggagcaaacactccatgtgtatcaccagctgattcttt

SEQ ID NO: 123177 - DNA, 360 bp, Homo sapiens
taaagtcctgggctttgcatcctgttcttggctttggggctttcagatttaggttgaaagagggctataaagagggcatgctatattgggtcaacagtgatcccaaagacagggaaatactctgagtacacgtattgtctcttctagacttttatagaaccgtatgagatagggaaatgtacttttatgtgggatgacaaaatgctcacactgggactttcaagctaacattgcttcttacctctcacactaataatagataaatggatcattttcctcctccttttgtccatggcctccttgaccactctgagccatttcctacaggaagttttgcatgtgttctatgttaactgatgc

SEQ ID NO: 123178 - DNA, 784 bp, Homo sapiens
cttttatttgctttttcctacttactttcagtttactttgctgttctttatctagcttctcccccgacattttattatgaaaatttttgtataaaacaagtaaaagaattgtaggttgaacacccatataatacctccacctagatttataataactataaaaggcctaccccaggctttgctatatttatcccctgtccatctgccaattcctctgtccttccatcaattcgatttattttcttgtggtgcatttcaaaggaagttacagagatcagtacccttaacacctaagtacctccacaggcatatcattaattagagttccatatttgttagtactttatcattagtgctcatgaagtattttaataaaacaaaatgcccttatggcaccatatgatctttggccatacatgttaatgtttgaacataattttctatatgtgtttttatgtgtggtcattatatatttatgttgatgtgactgcattccttttattttttcaaatgaaattgattaaggtataatgtacataccatggaatttatctttcttaggtgtatagttgtatagttttgacaaatatatagctgtgtaactactactacaatcaaagcattggacattttcatcccctgcaaaaaactccgtgtttccttttataattcagtctttctcctcatcccaggcttgacctcttttccttctagtttggttctttctagaatatcatgtggctggcttctttcacttaccttaatgcattttaggttcatctat

SEQ ID NO: 123179 - DNA, 256 bp, Homo sapiens
ttttgttctttttgctatgctttgttcaggctatttgggatttttgttgttgttgttccatatgaattttacttcttttctatttttgtgaagaatgtcattggaattttgataggaattgcattacatgtgtatatctcttatggtatggccattttaataatatgaattctttcagttcatgaacatgggatatcttttcatttatgtgtgtcctcttcaatttctttcatcaaagtttatagttttggtatag

SEQ ID NO: 123180 - DNA, 297 bp, Homo sapiens
cagtagaatggaagcttcaatatgctaagaaaaaataaccatcaacctaagctctatactcacataaaatagtgttttagagagtaatataatttaccatattaacagaataaaaattttaaaatcatacagtcatctctacaaatgcacaaaaagcatttgacataattcaacatccatccataattaaaactctaggtgtactagaaatgcagagaacttcctcaacctgataaaggacacctatgaaaaagccacagctgacatccttcctactagtgaaaaactgaatgtctt

SEQ ID NO: 123181 - DNA, 422 bp, Homo sapiens
agccgtgggggaagccaacagcaggagtggaaccaaggagggaggcagaaggcggccaagacagggaggacccatacgatggccgtctggggggtgaatttacagaacttggacaccagtgggaggcaggctttggcacactcgtggcttcaaatccagctctgccacttcccggtgaacctccctgggcctcggtttccttgcaatggggatgatgctcattgtcatcttcctagcattgccatgaggattaagggagttagagtcggacagcaattcgcacctgacccgaacccagtgagcattcagcaggcattcgccacaatccgcgtacactgtcgcatcccattgcaagagcgattgcccacgatccatgctcactgtagtgtcccattgcatagcgaatgagcgcacagaacaaa

SEQ ID NO: 123182 - DNA, 320 bp, Homo sapiens
ggggtgtggtggcacgcacctgtaatcccagctactcgggggggtctgaggcaggagaatcgcttgaacctgggaggtggaggttgcagtgagccaagatagtgccactgcactccagcctgggcgacaagagcaagatttcatctcaagaaaataaaaaccaaaacaaacaaacaaacaaaaaaaacaaaaaacactgtcagaaaaggaaagatcatccagatgtaatctgaatacacggaggcagcaggactggggtagaagagggccgagccaccgggaggacagaaacctgacttagaaggaagcaaacatgaaaa

SEQ ID NO: 123183 - DNA, 402 bp, Homo sapiens
agcatgtgattcatcagttcccccaaatatgtctcttcccatagtgtgcgtgtgatgtgaattaaatgaataaagcataaaaatgtcatctttttcataagatgagagagctctccatgcattgctcaattagaatgggagaaatggagaatggttgacagtgtcaatcaaaacacaccagcgacgtgttcttaggagggttgacttctagagggcagatgaacacagcaattaagtgcatgggatctggaacctgaccaacttggttcaaatatcagttccactacctgctagctagctgaacctggctaagtgactccatctctcagtgcctctgcatcattctctataaaacaagcataatcatgaagatgaatggaggaagtcaggctatgtaaagag

SEQ ID NO: 123184 - DNA, 437 bp, Homo sapiens
gggttgggggtgaaggcttgggaacgtgtgggagagcctggttagggcccagactgtaggcctaggagacctcatgcagggcaagcagggagattctgcccaaagggataccactttttgaccttggcctgaaataatccagagtacactgagatccttgaaaagactcaagacaggtaagatgagggggcaactgaagatgccactgtggaacaggaagcaactggattccagtgtttccaaaacatagctttcatgggttggatcaacagtgcataccagttccaagcaaagtcctatataggcctacaaaaggcttggcatttgcccctgccagtaacctctaagtctagattaggaacagctctggggttctcactcagtaaaggattaccagagatcccctcagtaacctgtaagggagaagcaagccagga

SEQ ID NO: 123185 - DNA, 421 bp, Homo sapiens
cagaaagaaggacaggatggaaagagaagtttctccactgaacacctgctgtactctgggccaagtgtctttgctgatcactaccaactagggagttcaagactgctaactttagttttttagatgataaaactagggctaagagatgacaagtaacttgtcctaggttctccaggtaagtaagtaagtaggtgagttaggctttaaattcactcttgtgtgactccaaaggctgtggatgctctttctactgtggctccaataaaagataaactaaactccaacttcagactcttgatgtcaagccaccgcttgcctcccagcgcaaaaatcataccttccagatgtcaccatagtcatcattttgaaccttgtgtgcaggctgatgagaacattcagagccctcctgtccacctcaaag

SEQ ID NO: 123186 - DNA, 296 bp, Homo sapiens
cggaatctcatagaacagccctgacaaaacattaatatccctgctaatgatgcctggctgtcaaagctggggcagaagcctcagtccaggtggcggaaaacacttggaagggctttgagaacttgcttacagaaaaggcaccagctcaacaggtaaagttgtttcctgtcatcaaagccaaagggaaaatgcaaagtttcaagtctaccttccctggcagcttcttcagacgaggtctccctggctccctggtttttctcctggcatggccctgcctcacgacgcctaccattgtt

SEQ ID NO: 123187 - DNA, 309 bp, Homo sapiens
agatttgggttaaagaaaaggaaatcccttttgcagtttagaggtcttaatgattggggccgggcacggtgggtcacgcctgtaatcccagcactttgggaaatcgaggcaggcagatcacaaggtcaggagatcgagaccatcctcgctaacacggtgaaaccctgtctctactaaaagtacaaaaaatagccaggtgtggtggcgcatgcctgtactcccagttactcgagaggctgaggcaggagaatggggtgaacctgggaggcggagcttgcagtgagtggagatcgcgttactgcactcccc

SEQ ID NO: 123188 - DNA, 270 bp, Homo sapiens
agaggagcatacagtatgtagtctgttgtgttttatccctttcaatttgcctacttttttgaaattgattcatgttgagtaattccttattactaagcagtatttccaaatgtagatttgccacagtttgtttatctgttcaccagttgatggacatttgtgtatccaagttttggctattgtggataatactgttacaaatataagttgtcccacattctcctcgacatttaatattatcagtctattgaatttagtcattctacttag

SEQ ID NO: 123189 - DNA, 364 bp, Homo sapiens
gttttccacggtgattgtgctgctactcatctccactgcaaagtgagaattctcagtgttccacttccatgccaagacctagcattgctagcactccctgtttgacccattctggtgggtgtacactggtatctcattgtggtttcaattagcattttctagattattagtgaggtttgataccttttcctgtgtgcattaatcagttggaaattctcttttgtgaagtgccaattcaagttttgtgcgcatttttctatctggttgtctttttttctttttagtcattcatgtgagtgttactgtgtatttgggatatgaacttttggctctatttctgatggagctttttctctcactcagg

SEQ ID NO: 123190 - DNA, 475 bp, Homo sapiens
ggagcaaccccttggctaactaaagaatcgttccaaagtagatcccatagaagcagtttaatttactaaggttaattttctgaattgagccatatcaaatgccaacctggtaaccgccatttgtgtgtttcttcagtgagttgtgctccacttgggatgtgagcccagatagctttagtcttagcagtgaaaagacccttccagatccatttagatatggatgacagctaagattcccaaaatggaagtgattaatgtgaactaagtgtagggtgctgttattttggaggaccacctgtagctactctctagaaaagactattatgagcccatgtattatgattccatgttctatggaattacatgcttggcactcctttaaaaattaagattaccagaccaaattagctagaggaacagatgtttccttttccaggaaataaaaagacagtaggttattttcagatattagtac

SEQ ID NO: 123191 - DNA, 900 bp, Homo sapiens
aattggaggcttctgagggtttcctaggggttttgctgggttctttctagcttaatttaaaaaaaaccctacttgagggggctcttcagcaactgcttgctcgagcccactcccactctgtgaccgtcttcaataaatctgtgcccactccgtggtgttgtgttcaactatttgtccaatacgccaagaacctggacatcacatttaggactttttttttttaatttgagatggagttttgctcttgtcactcaggctggagtgcagtggcgtgatctcggctcactgcaacttccgcctcccgggttcaagcgattcttccacctcagcctcccgagtagctgggattacaggcgcccaacaccatgcccagctaatttttgtatttttagtagagatggagtttcaccatgttggccaggctggtctccaactcctgacctcagatgatccacccacctcagcctcccaaagtgctgggattacgggcgtgggccaccgcacctggcagcatttaggaccttctctctggtaacataagtaggggaagagacaacacacacccaaaatggcaagaatccgctggcacggacaggctggacccaggacatgggtgtggaggcaaagaaccatgaagtacacaacagcacaggcagatgaagcatattccatcggccccggtccctccccagaagagctactatctatggagaaaatcattcaggtggcaagacctctggtgcacaggttatccatccaggatgcaggttttctttcagaaaactgggaattggctgaactttggaagcagaaggacttatttgatagggcctcctcaatctggaatagagacttggtttaagaggccattcaatccaataagggtgctgcggaataccg

SEQ ID NO: 123192 - DNA, 401 bp, Homo sapiens
tccataccccaagactcaaacatttatctctagctcagtactctccctcacacttcagacttgtatatccagctgctgctctgcactccatgtctgatgggcactttgggcttaacataaccactgctgaccttccccagaaggtatttctccacagttctgtccctctcactcattagcaactctacctatttactctgaccaaaccccctgagctctacctggagtcttctctttctcactcaccctgcatatgaacttctgctagatccagtgtgctctcccttcagaagatacccagaatccagacacttcgcaggtcatggctcccaacatggtcagagtcactatcacctttcacctgcgtcaatctcctaactggtctccctgcttctgttctt

SEQ ID NO: 123193 - DNA, 461 bp, Homo sapiens
gcacgcgccaccactcctgggtaatttttgtatttttggtagagatgggattttaccatgttggccaggctggtctcgaactcctgacctcaggtgatccacctgccttggcctcccaaagtgctgggattacaggtgtgagccaccacccctggccctttctacctgttttattaaaagagctggaatgtgctgggcaggcagtgcactgagtgcttttatctggactctctcatttactccttacagccactcactgacatagatacttagtattttgttgccatttcatagatgggaagatcgaggccaaaagaaatgacctaatttgcctcagaagttaatggggttgccactactcacccacaggtatctctgattccaaagctgagctcttcacttctcggatacagacctcccttttctgggctttgagctggagtagggtatgtgtctcaggg

SEQ ID NO: 123194 - DNA, 463 bp, Homo sapiens
tgcaacctccgcctcctgggttcaagcgattctcctgccttggcctcccaagtgggattgcaggtgtgtgccaccatgcccggctaattctgtatttttaatagagatggggtttcacccccaggctggtcttaaactcctaacctcaagtgatccacttgcttcggcctcccaaagtgctaggattacaggtgtgagccaccgtgcccggccagcaatctggttttaaaggaggctttgacccctcatttggtaaaaggttccttctttgactaattcccaaaggacatctcgatctgtcttcaaaagaaggggtattccgttgtcagtattcctagctagctctgggagaagagagaacttgattgttttcagggccctggtcagagtctggttttatgcccaagggatgaactgccttttgtccttctacctcctgaagttcagagccctgtgaaaatga

SEQ ID NO: 123195 - DNA, 700 bp, Homo sapiens
gagggaaggggcggttcccagcggtgaaatggggtcacattgagactgggaatctggagggtgtttttgttagttttttatttttattttcttgtgagacagggtctcttgctcgggctggggatcctcccacctcagcctcccaagtagctgggactacatgctcctgccaccgcacccggctaatttttttatttattaaagtatatatatatttataatgtatatatttgagacatagtctctctctgtcgtccaggctggagtgcagtggcgtgatctcggctcactgcctcagcctcccaagtagctgggattacaggcgcgtgccaccacacccggctaatttttgtttttagtagagacagggtttcatcgtgttgaccaggctggtctccaacgcctggcctcaagtgatccgcccgcctcggcctcccaaagtgctgggattacagccgtgagccactgtgcctggccataatttttttgtttattttttgtggagacagggtttcactgtgttgcccaggctggtcttgaactcgtggactcaagcgatgctcccacttcggcctcccaaagtgttgggattataggcgagagccaccccgcttggccgggtttttgttttttttaattatttttcttgtagtttttttcatctttattgagcttgaatacaataagctttaaagcgtac

SEQ ID NO: 123196 - DNA, 142 bp, Homo sapiens
tgtataaggtaagagatgaagatccagtttcattcttctacatgtggcttgccaattatcccaggaccatttgttgaatagggtgttcttttcccattttatgtttttgtttgctttgttgaaaatcagttggctgtaagtg

SEQ ID NO: 123197 - DNA, 162 bp, Homo sapiens
tatgactgagcaggagatcagaattctggatgtactgagcttcagatgtgagcaagcatgaatcattacctcattttcgagacctgtcaactgaggctttgaaaagataagatcaaatggcaggtaactggcagagcccagtcctccttcttgacactgtgc

SEQ ID NO: 123198 - DNA, 202 bp, Homo sapiens
ggcgagcccttgggccgcatctccttcgagctgtttgcaaacaagtttccaaagacagcagaaaactttcacgctctgagcactggagagaaaggagttggttataagggttcctgctttcacaggaacattccagggtttatgtatcagggtggtgacttcacacgccgtaatggcactggtggcaagtccatctatgggg

SEQ ID NO: 123199 - DNA, 462 bp, Homo sapiens
tacagaaaatcaatggcacagccctggtctcagctctgccgtcactcaacttgtatcttgagcaagttcctccccatctcaggcctcagtttcctcatcgcatagagagttggtcttccctcaccgggcttcctacttgccctccagagttgcctgaagctcacatgagcgaagggacatgaacatgctctgccatctcccaataggacataagtccacgctggagcgctgagcatcagactcaagaaaagcttgcgtggatattgcagacccaccaacaagggctccaggttctggagttgtggaggcaaaactgcctagtgagaaccctacatattccctctggtccttgcagctgccacccccattcccaggggtggagtgtccctccatagacttggatcctgggccctctgctccttcaccactgtccatctgaagcaagcctggttgctccggcac

SEQ ID NO: 123200 - DNA, 398 bp, Homo sapiens
tttccaaacctgggacaaaacatcaatctactacagattcttcaagaatgtcagtgaaccccaaacaagacaaacccaaagaaatccacatcaagtcatatcgcactcaaacctcaaactaaatatactcatgctcaatctgaaaactaaaggcaaagaaaacaatcctgaaagcagtaagacagaaagaacatcttacctacaggggacaaacaattccagtgacagcaaatttctcatcggaattatggaggccaaagagggagcaaaaacatttgtcaggtgttgaaagaaaataactgtgaatccagaatcctatatcgagtgaatacatccttcagaaataaagaagaaatgaggccatgctctgataaagaaaaactaggagaatctgttaa

SEQ ID NO: 123201 - DNA, 753 bp, Homo sapiens
ggcgcctgtagtcccagctacttgggaggctgaggccagagaatggcgtgaatccaggaggcagagcttgcagtgagccaagattgtgccactgcactccagcctgggcaacacggcaagactctgtctcaaaataataataataataataataataataataataatgtatttgtaccctagaatatagaaaatgaaatgaattttaaaaccccacaatatacctggcaatccggaagaagattccagaaagtttgcattttctgttgagggactaaacaacagtactttcaaagtaattaatgaacttcttttgtcttttttatttttttaagaaaactggtaccaattggttaccagaaaatggcatgatcttcaagaaaaaaaagttttcctggtgaacatttcctctctccccaacatccttgaggtaaagggattgagaactagatcttttaactcagagaaccatacttgcatggaaggtgttaataacagagggtgtcacggaatcgctgtttggggtttgctattgttgtactctgctactaccagacattaaggtaatgataatagacctaggagaactaagcaattcctgcctcccgtctgctccctgtcagcctcctgaagcccccacaggttaaatatgcctcctgaaattagaacatctgggaataaattctttttaggatgaaaatgctcaaacatacaaaaaagtgcagccatgagtatagtgagcaaccgtgtacc

SEQ ID NO: 123202 - DNA, 331 bp, Homo sapiens
ccaggtggatatctcagaaaccttctgctccagcctccctgacaagcgcgggaagccaagacccacaatcacacagcacagagacacgaagccacacaaccaccagaggaaggagaaagcaggagtctgggggcagagggaggtcagtctgccctgctctcctgggatggagccagagaaaggacaactaatgcgcccaggatgatcaagagcacctcttggccctcctgacctggggctgggcctgccctggcccccctctgtgtaccaagagcccttaactactcaaggttgctaaaccgagcaggaaagctgtttagaggcctctagc

SEQ ID NO: 123203 - DNA, 591 bp, Homo sapiens
tggtttcagattctacattgcaactaacttttgaaactaccacttgtcaagttttagtgtttattaaagaatagccgcaattttttgaaaagctattaaaatcctctcttttctaattatatatctgtgtgaagctggatttcctcaattcaaccaaaagaacatttcgaacaaattgaattcaggagcaaatatgaaaatcagctgtctagcttctcagggttcaaaacaaaacaaaacaaaaaaacaggaatcatatcaaccacactcatggaccacagtggaatgaaaatagaaatcaataccaagtagacctctcaaaactatgcaattacagggaaattaagcaactggctccttaatgactttggggtaaacaatgaaattaaggtaaaagtaaaaagaatcattgaaataaatgaaaacggagacatggcatatcaaaatctatggaatgcagcaaaaacagtattaagaggaaagtttatagtgttaaacatatacctcaaaaagttagacagatctcaaactaatgatctaacatcacatctagaggaactggaaaaatgagaacaactaacccaaagctag

SEQ ID NO: 123204 - DNA, 515 bp, Homo sapiens
cagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaa

SEQ ID NO: 123205 - DNA, 209 bp, Homo sapiens
  misc_feature (188)..(188): n is a, c, g, or t
tataaccactaaatatattaattggtaattctaagtacagacgcggtaaagaattcaaaggaaaagaataaagtactgtgagagatgataccatgggataaaagtccttgagatgtcctgtctatttcaaccaacaggcaatttatagctgcagttttccatgcccagaacaccgtcgaaggggtacncgagctcgacattcgtcaatc

SEQ ID NO: 123206 - DNA, 466 bp, Homo sapiens
taaacaacaaaaccatgatgatgaaactataggaaaatttgtacataatattggaataggaaggcaacactatgaaagagaacactgaacataaaatgtttacaatagcaaagtcatggaatcaagccaagtgcccatcaatggataactgaataaagaaaatgtactatatgtgcactgtggaatactacacagccatgaaaagaatgaaatcatgtcttgtgcagtaaaatggatgaaatggatgaagctggaggccattatcctaaaagaaataactcagaaacagaaaatcatataccacatgttctcacaagcgagagctaaaccatgggtacacatggacagaaagatgacaataatagacactggggactcctcatgtggggaggatgagaggagagtgaacgttgaaaaattacctattggatatgatattcactttttgggtggtgggtacactaga

SEQ ID NO: 123207 - DNA, 192 bp, Homo sapiens
ctcactccatgtgttgttaatcggcgttatctccatgtgttggagatatgttatttccatgtgtttccacatggaaagtcatctccatgtgttgttaattggcgttatgccaaaaaggtgttcagtggtcaatatgtttcagaaacataggtttctccttttttatttttctaaagaagcagggcctttctt

SEQ ID NO: 123208 - DNA, 290 bp, Homo sapiens
gagggaactataacttgggtaaacagatacttggaaaaaagggagcactaatttgtgcttttactaaaagtgatattaaaaaaaattaaactcatgaagcacagcttaagagaagcaagagatatacattattaagttattaacacaagttcatgagttttattttttatactttttttgtttgagacaaggtctcattctgtcaccctggctagagtgcagtggtgcgatctcagctcactgcaacctctgcctcctgggttcaagccattctcttgcctcagcctcct

SEQ ID NO: 123209 - DNA, 222 bp, Homo sapiens
agctggtgtttctttttcccttcgaggcttgggggttagcagctttacaaataaagtgtatcacaaactagtctgcatttgcacaaaacagtagttagccttcctgtcttaaatcctggtgctgacttctcttcctaataaatgacctttgtggcattttttttctccagaattgggcactttgatctgcattaaaaacttgttcagggtcagacaaggcag

SEQ ID NO: 123210 - DNA, 483 bp, Homo sapiens
gcagaggcataagcacaagtgaattcaatggtgccagcacttttcaaaactatgcttgtgttccagatgctgacatcctgttggcaaaagcaagtaacatgacccagggatgaaaaagtatgtcaccctctgtaggagggcatggatgtggcaaaggatggggatagagggaggagtacagatttgaggccattaacacagtctgccaacaagagattaagtcagtttcatcctcttttgaatcattcctcatagaaaccaagttccaaggcggggatgtttgaatggtccagcttaggtcttgtacccactccttgtccaagaattggtcacttgattaagagtcccaacaaaccaatagctgtgggtaagcagtggtttttccaaaggaaaaccaggatgtcttaccagaagaaagaggcatggattctgggcaagtaaatcatatatgtctattccacttatgtccctgactttgtctcc

SEQ ID NO: 123211 - DNA, 675 bp, Homo sapiens
aggagaaaaaggcatgcaaattaatttaacatgcacagcatgggagaatagcaggagagtggttacccagtaatccagtgaggtacagatacttatatgcccttcttcataagggaaagggagattggaaatgtagaagcaaattatttttaaagttaatgaatggacccaatgctcaggcagtggttaataaatagtattcttggagaactgactggagaacaaacaacggtttgggacgaagtttgggctctaggtgtggtgtttaattttcagacttttcctctgtgatatgagttttaagtttctctggttaatgaaatttcagggaagggatcaaaggcaattgtgttcctcttaggggtccagtttctaggtagatcagggagcttccgagcacttcacgtgtgctatggagagacgaaagattgagagagaccttgaggctgctgctttagttccattattttggggtgtcattttctgagccccaccactatgtcaataaagtttaatgttcaaattaaataatataatgtttatttattgcatgtatcaccctgtaaaaaaggataaatcttttttttcagtcagatatttttctaagttacaactctggcccactgctagttttacgatgaggcgagcgcattttgaaaaaaaaaaaaagaaaaa

SEQ ID NO: 123212 - DNA, 434 bp, Homo sapiens
tgccatgtcgtctcctccctgctcttgggcaactggacccagatgctcatcctcacctgccgtctgacctcctccagtgtagtggagtgcagggctgcccaagccctccagtgtacatggtacatacccaaccacctgctgaaacccaggatgcctgtggaacaagcgctgtcctgatacttaagattgacctctactctgccatctgatgggagtgggaagacgggagacacgggaagaattcaatggattaaattcaacaaggcttaaaggttcattacacaggccaggacgcggtgagtgacgcctttaatcccagcactttgggaggccaacgtgggcggatcatgaggtcaggagtttgagaccagcctggccaaaacagtgaaaccccatctttactaaaaatacaaaaaaaaaattagccagacatg

SEQ ID NO: 123213 - DNA, 792 bp, Homo sapiens
aaatgtctttaaatattgggactctgttaaacagacagtggtggatacaaggttttcaaatttctaattttcaattgaaagctagaatgttattattggtaataaatattgttagttgttttcttcgaagtgacagggtttgcttatttttgagaaaatttctgccaaatgcccatgtctgaataaacatagtttgttttattcagataaaatgggattccatgaaaacagttgctagttcagtttacaaatcacaatggctttccctcaagacaactactgtgcattcattcccacttgatatacagaatattaagacgttacacaaggatcaaaacttaataaaattaaagttgatgatttttactgctttaaagatattcttaggtgaatacagcttaaaaaagaactcttaagtaggtagcagaggctactagcaatagttaggtgccattgcctttactatgataacaggccaccagttttacccacaattgcttctgcaccatctatactaaatttcaccacagtagaaaaaacaaaggcaaataataacttgatactagtataaaaatacttttgacttaatagaccacttgaaagtgtcttgggaattcccagagtttgaaaaaccactggtatgttcgtacaaatgcacatgtgtggaaatgcaaaggccccagaatagccaagataaccagaatgaaaaacaaaggtggaggccttaaaatatgagacttcaaaacttactaaacatctacagtaattaaggtagtacaatgtgggtaaaaa

SEQ ID NO: 123214 - DNA, 838 bp, Homo sapiens
attgtgaagccggtcctggcttccttgtctaaaagctctttgggactgaaatggctgtttatgaatccttgtcaacctcgttcgcagtcaacgaccagggaataaattattcgtggaatgacacagttcataattattataagataaggaaatggaggtcctggaggttacatgactagcccaacaagtatgacaactccgatatcggcttgcggttcactcattcagtttgctgattcagagatctgtgcattcactcacctgttccttctccagcaaggcctccccaccctaccacctcctcctttcttagtttggctgtctgtgactcactcaacacacatccccagacctttctggaactccaggttgggcagattggcctccacagcaacctgtggatctctgaacactggggcaagggcctggtctcaagcagcttcgtattctgagatcagtttttactgattattggaccagccaggatactaactagtatttattcagcacctactatgttgagtataaatagcatagtaaaagtaggaaacacacaataatacctcaacagaaaaatgagtaaaccagcgaggtgtcacgcctgtagtcccaggttcttgggaagctgaggccggctaagttcaaggaggatcgcttgagcaggagttccaggctgcagcgcgctatgatcgcgcctgcgaacagccactgcactccagcctgggcaacagagcgcgactgtgtctctaaaaaacaacgcaaaacaaaaaacactgcagaacttaagcattttgctgcactgcccagtgaaatccattccatttgacaaatactgccc

SEQ ID NO: 123215 - DNA, 266 bp, Homo sapiens
tcattatcattatcaactctctatgaaatgactgctgagtaaggaatactctgctaagcaggcagagggaagattctaacaatgtggagaatacaaatttattgttttgcaaaagattgttaacactatttgtccatcctttctaagtgtagattatatatgagtcaaaggtgaggtcttcatagtctgtatactcatagcttcagtatcattgatgtcctatggtttttacggttaaggctgggttattaatttcgtctattata

SEQ ID NO: 123216 - DNA, 504 bp, Homo sapiens
agtcgattctcagattacctttattcgcatcatcagacctatggacgcaatcatttaattgcctttcttttcccctcctcctttgtattttgtagatttcattaatggatcttgtgaatgggttgattgctgtgaaaataatgccccctttccccttttctgggctactttgagggaaaacaatcttaagaaaaataggattaagctattctgttccagtcctcagagaaataatcactttcttaaactttgtgagtttgtcctgttcgggtgaagttacagtatccattacttgtgtttgctcacaacagagctaccttcctgttgtgtaaatgcgtttttgctttagtgcattgtgtgtgcaagcatgaagtagaaacactttttttttctgggtacagtacatgggtatcggtgctctgtatttttttaaactgtgtacacattattaaaatatacattttataaaatataaataaaaacgtggatttgtttttcatgcca

SEQ ID NO: 123217 - DNA, 312 bp, Homo sapiens
ggaggcgatggggaccagactgtgtggggtcttgtgggccaaggtgaggtcttggcttttaccctgagagtgattgaggtatttggagggatggtgagcagaggatgacatgtacagacatattttacagggctcacactagctatcatatgatggatacaaaagccaagacctattagcaggctactgcaactggtggtgttgactcagacccagcagcagcagtgaagctgggcagaatatggtagatttgaaatctgtttcactctctgagatggtggggtttgctacggtattgtatatagggtgtga

SEQ ID NO: 123218 - DNA, 332 bp, Homo sapiens
aacccagatattaatccttgcatttatagccaactcatttttgacaaaggtaccaaaaacatacaatagggaaaggacagtctcttcaataaatagtgctgggaaaactggataaccatatgcagaagaatagaaccagacccctatctcttaccacatacaaaaaataaaatcaaaatggattaaagacttaaatgtaaggcctcaaactatgaaactgctacaagtaaacattgacaaaatttttcatggcattggactgggctaagatttcttgagtcacaccccacaggcacaggcaaccaaaacaaaactggacaaatgagatcata

SEQ ID NO: 123219 - DNA, 1191 bp, Homo sapiens
agcgggggggttgccctgcccggttcgcggaacggacgtttacctgtcgcagctacgaacccaccaacgacaccaagcacttgccgggcagaccaggcgtcgtggaggcgccccagcccccccaacccccccgcaacgacgcgtcccaggggagcaagggatacaatgatgatcaaggcagatgcagccgttaccttcaggttgtggagtccggatacagactggaggcaggcagctgtaagatgtgtgagaaatgctgcgctggatcagcccatggtattaggagagcaggcttcggtagattgcaaatgacctgctttctttcggatcccgggctgctttcggacacctgtcgaatagtaaatcccaagtaaggtacctgcggtcgtcggcagatctgaattttcttcttggacacctaatacccacagtcctccagagaccgagaggttgatgtcactcccaatatcggaggaagtatacacccccgtgtgagatggtccttaataatattccacggcggagggggtgatatgactacatacatggcagaaagtggaaacctcccagggatattgttcccacgatcctggagggaagaagatgatgttactttcaatatgacagaaggtggatgaagtggtggactgcccctccacacctgtggacacgcccccactgatattccttctaattgcagcgtgggagaggaggatatgacacgcgatatcgcagggagtagaaacacccctgtgatactgttcttaatattcagggaggaagaggatgatattactcccaatacagacgggtgtacaccctctgtacaccgagggtgtacacctgtctgtgaaagagttcgtaatctccagagggggagatgatattactcacaatatggtaaagaggctgtgagtccacggaggatcctcagagccagcgggggaagaggggctggctctcagtccccgcctcgcgggggtgactccccccagtgcgatgggggtcctaagagccagtgggggaagaggggctggctctgagaccccgcctcgcggggggtgcctccccgccctgtgatgggggtccgaagagccagaaggcttagaggggctggctctcagtccccgcctcgcggggggtgcctcctccccctgcgatgggggtcgtaagagccactgggggaatagg

SEQ ID NO: 123220 - DNA, 285 bp, Homo sapiens
ctctgtgtacaaagcaaggaaatgtaagtatgtatacacagacatttgtatttatttgcatgtccatttacctcccgtgtgtatgtgtgtgtaaaaacatctatatttatcattcttatacctcttatttcaatctaagaccaaagggttcacttagtcttcctccttttttattaataactcctctttctacctgtaaggtataacactattgttaataaagatatatttatttagctcctcaatcctagaatattcagtgttgtagttttagaattactagcc

SEQ ID NO: 123221 - DNA, 293 bp, Homo sapiens
gctcctgtcaatttaaatgaaaatagacagttggttcagcatatgttgatttcttaaaatcagaaatagattttcccagcaatacgcctcagggaaaataaaatgtgtgggctggtttatccacgcattaaaagcaagcttccagctgatgtttgattacattcatgaagaaaaaaatattgtaatgagaacatccaattactctttccacaggagtaaaaatttctggtctgagaatttgtttcaaatcagtggttagaacataaacaaacaaataaaaaaggggaaataag

SEQ ID NO: 123222 - DNA, 637 bp, Homo sapiens
gcttcaagcgtgctatggaaataagaggcgggaagatgggaaagacagcatgtaaataatcaaatatttattggcccctgattcataattaatttttagaaataccatatccaatctagataagaataaaatactctttatcattctgatattttgtgcatatgtttttacagattataatctcttatacacactttcccaaattttctcactggtcacttaggtaacatacctatattctattgcctgtctcccttgtttttccacacagtggagctgtaactgcactaagatggagcaaacagatttccaaagattaagattcagtaaattatagtgagaattgacaagaagtttctgtttatccattgaccagagaagggaaataattcatcaagtttagtttgaaggtctcaggatgttgaaatcagacttttacatcttaatccagtgagaatgaaaaatgaactacttatagtgtctgcccatgacaagtcatttctttgcttagggatgcaaatcgtatcacacagtggtctgaaatattcctttcaaagagataagctgtttgtttttcaaaatggagcttccaggtgtgctaattctgaacacgaagctttgttatttggagaagaat

SEQ ID NO: 123223 - DNA, 175 bp, Homo sapiens
ccccacaatcacataagccaattccttgaaataagtatctttatttacataatgtatgcatgtgtgtgtatggtatgtgaatgtgtgtatggtcttataggttctgtaggtatctgcccagttctctgagagaagacctactacacaccagtgctgatgataagcacggattgtc

SEQ ID NO: 123224 - DNA, 231 bp, Homo sapiens
taccaatgtacacacaacagcagtcccagaaaggaagaagaaagaaaaggggtaagaaaaaaagtttgaactaaatagttataaacttcataaattagataaaagaattttaatctacacattcaagtatcttaacaaactcagagtggaatagacagaaagtcctccaaagctacatatatcataaacaaattattgaaagccaaactagccatgagaatggctacaatt

SEQ ID NO: 123225 - DNA, 291 bp, Homo sapiens
aaggaagggtatactgtaggatttggaattctagcaaaatagagatggattaagggctcagcaaaatgaaaggaataactgtaaatcagagaaaaaaggctaggtacagtggctcactcctgtaattccagcattttgggaggccaaggcaggaggatcacttaaggctaggagttcaagacaagcctggcaatatatcgagaccctatctctacaaaaacaaaaatgaaaaacattagctggtgtggtggcgcatgcttgtagtcccagctgctcaggaggctgaggtgg

SEQ ID NO: 123226 - DNA, 295 bp, Homo sapiens
aaagataaatcctacacagaccctgcccacaaagcgtccagtctagaagatgcttagtgaaaatgtgcagaaatgagagtggaagggaagggatatgtagagaattgtaggactagatcaggaggcaaaacacataatggggacaagaattcaggctctgaaaaggaaaggggtggaaggcaatactgaaagccacaggcaatgggaaccactgacgcttttttttttttaaatcaaaccagagaaatgattattgctttgcctccggagatgagttggcctgccgcatgcagta

SEQ ID NO: 123227 - DNA, 356 bp, Homo sapiens
gaagcaatttaattatttcaatggaagttactaaagaacattgaagtttgttagaaaaaagaggatgtcactgtaatataccataattgacaagtaataactatttgagtactgactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcagaagaagaataagatggtccacagatattgcaggtgacatgtactatatgcaacaggtgtttgtttaggttatgttatcaccctttgctctg

SEQ ID NO: 123228 - DNA, 395 bp, Homo sapiens
acggtgttctggcagataccatcccttgataactttgaaagaactacagttaggaattcattaggatcaacaggagtcctaaatattagcaataaattaccacataacaagaaacacatgaacatgggttaacaaaatgaaccactgacaagccaacttttctgtgtcaaatttattgtcctattgattttattttaaagagatggggtatcgcacggtcgtccaggctggagtgcagcgtcgtgatcatagctcactctagcctcaaactcctgggtcaagtgatcctctcaccctcctgagaaactgaaactgcaggcacataccaccaaacccacttaatatttttttagagacagggtcttgctgtgttgcccagactggtctcaaaatca

SEQ ID NO: 123229 - DNA, 160 bp, Homo sapiens
tactatattacatcctttccatagaatctggaacctgattctcaatacatagactgccaatgcttggcgactgactggtggaggacaggggattattgataactttctctgattcaactttgtctggagacagaaatattagacaggcagactctcaccg

SEQ ID NO: 123230 - DNA, 296 bp, Homo sapiens
aagatcatcattcattcattctttttagtggatcattttccttactttcctgggacaattcctttttgcatttataatatagcattagaaaaagggatatgggccgggaacggtggctcatgcctgtaaccccagcactttgggagccaaggcagatggatcacctgaggtcaggagttcgagaccagcctggccaacacagcaagaccctgtctcttaaaaaaaacaaaaaagcacacacccttttttacccctcaatagggctgtacacacacacacacacacacccacacaca

SEQ ID NO: 123231 - DNA, 105 bp, Homo sapiens
attgctgtaataatccccaaatcaaagccaccatttgcactgcctatgttcttgggctcccccatgccagacgctgagattgccttcatggacaaggaaggtgcc

SEQ ID NO: 123232 - DNA, 166 bp, Homo sapiens
caggttagggctatcatttttctttactcccatccccaagtcctccagcacaaaggagaatttggggagtacttgaatagcccagaacaacagtcggggcctaatcatttttcttttctcccatccccaagtcctccagacaaaggagaatttgcctttctcccca

SEQ ID NO: 123233 - DNA, 266 bp, Homo sapiens
caaggagttcaaggctacagtaagctgtgatcatgcctggatgacagaataagaccctatttaatttttttttaaagcatttcgttttcatatttcaagaaaggccttgaatttgcctgttccttcagtagtagattaagcttacctttgatgtgtgcacacaaaagttacactccatttactttttagtctactctaagctggttttactctcactttgtaccaatgctactctattttcaaggtcacctcttaacctctgtttt

SEQ ID NO: 123234 - DNA, 658 bp, Homo sapiens
tctggaagagattagtctcactggtaggcagaagaaatttcataatgtaccatcttcaaagaacatggtacctcgtcacatttctcatgtgacatgtatcctggaaacagaagtacttagggccacattgctggagcatctgcctttgtctttgttttgtgtttaacataaatgtgtctttctaatactatgatatttctttagcttttttgaaaacacagctaaacttggtggtacgatgctgcctgcgctgttgactgtggtctagacttctcctttttcagaagacctatttgacttttggcaacgtgcctcttagagtttgtgatttgtttgagacatcttttcctgtcttctctaaaatcaggcacatatgtgtctggggtagtcatgtactttgtaacagtcacttttagccagatcttggggatgtctattcttatggttagtagtgacacatgaaccctctcttccacttaaaattattttatgtaagatgactgcttctccttctatccctgctccttcctctcctcctcctctactctgcctccctcaaacttatagaaaagttgcaagtacagtaaaaaagtgtgaagaagcttttatctccctaagtcaattaagagtgaattgtttacactgatgcgctaacatc

SEQ ID NO: 123235 - DNA, 315 bp, Homo sapiens
tctgggattacagacatgagccagctctcactcttggtgagagctgtggtcaagctcctccagcctcttccccacttttgggaggctttctgggcagtggccaaggctttgaaagatgcagatcttggggccaaggacccacatccagcaggcctagctggctccttagcatggccccccgaccctctcctgcttttgctggaccccagtaagcaggaccaggtaaccctgatgcaaggaacaggccatggctgtgcaaggccatgcagaggctgggtagcctgagcatcctccctggaacaggatgggcaggca

SEQ ID NO: 123236 - DNA, 360 bp, Homo sapiens
tctctccctgagacccacccacactgacatggctcattttcattgctgcgtgatctcccgtctccattctctccctgagacccacccacactgacgtggctccttttcattactgcgtgatctcccgtctccattctctccctgagacccacccacactgacatggctcattttcattgctgcgtgatctcccgtctccattctctccctgagacccacccacactgacatggttcattttcattgctgcgtgatctcccatcgtctgaggggagcatgggaaatgtcttccatcttcctgtggatgagtgtttggccaggttggggccctgaggactgtgttttgttgggaacgttctt

SEQ ID NO: 123237 - DNA, 376 bp, Homo sapiens
tcctggagtaggtaatgtttgaactgagactgaaaaggactagcgagtatggatcaggccaagaagggaataaaggagaaaaggaacttgagcaatatggactgaaagtataattttttttgaactcgggagtctactacccggggccttctctccccgggaggctctggtgccagctgcctgcccctctgtttactgttctgggaggtggccaggccataaaaagtgtgcacagccttcctgacatcgccctttgctcccatgataacagtgcacaaggtggatcctggcctggcacaggcccctgaagtgcagcaggcacttctctctctcctcctaccagtggcctgggagacagcgggcattcattagtaat

SEQ ID NO: 123238 - DNA, 636 bp, Homo sapiens
cccaaaccctccagactcagctcaatccccctcatcttctcattgtctctgtagctcttaccatagttgccaactgattcattatttgttagcagaataggatagtgtttaagtgtcagattctcaagccaatcttcctaggttcaaatatcagttctgtcacctactggttgtgggatcttgagcaagctccttaaccttgctttgcctcagtttcctcaactgcaaactagagatcagagttccatcttctgggattattgagtggaacatgtgagataacgcatgtaaaatatttgggaaagtgtccagtacatagtaagttctatacaggtatttgctattattatttatcagctgtgagcatcactcattatgctgtaaggtgcacaaaggctggaattgtttctgtatttcccactcctcatatctgctttcaaatagtttttggaggaagaaagttgtgaaatcccaaagtttcctctgccatcactaaatctcttcatctcattcacagctctgccacattctctacggtcaccaccattggagttgctgtcaccacagctaccacagcccctttactgacacatccaaataccttaagttcaaaaggctgtggcatcagattcagaa

SEQ ID NO: 123239 - DNA, 751 bp, Homo sapiens
aggcatatgtgagaagaagcaatcagaagattggcaggatttaggaatctatttgaaatattcattacctattttgaattggtcttaaaaatttaaagaaatataaagctggataattaaagataaataataaaggaagaatacaaggtttctatgctgtgaagcaactgagattattatgattttggggcagtgaatttgtttctagaagttttgttggaactaaggcagaaaggaagaagaacaaatgaccttggaatgaaaaactttaagttactccacctaaccactatgaatgatagtcttgtctcaccaaccccagcccatcatctgttggacttggagctcacactttaaaaaagaagatcattctaactgcccctcatgactactgaagaggctatgcctgaaaaagcaaaatgtcctacattagagatcaccaagcaagacttttttcaagaagcaaaaactctcattgcccaacattatgagaaaataaatgagaataaagttcaaggtacttctataaatgtttttagaaagaaacaccaaaaaccgaaatctggcaaatacatacctttggagattgacaaaaaggtaacacgtgatgtggtgcaagaacatcgggccgcactcagaaggatttgctttcccaaggagctttccaaaagcgagcatcttcaggaacccccacaacgaatctccttcaaggaaccacacatttttagtagaagagaaagatgcaggccca

SEQ ID NO: 123240 - DNA, 260 bp, Homo sapiens
actgccatagctactgctgctactggaaccaccatagtagccaccgtggtttcatggtttggcatagtattggcctccaccaccataggggccagagcttctgcctccaaagtttccttccttcgtgggtccaaaatttgaagactgattgttgtaattgccaaaatcattgtagcttccaccacctccaaaattgcttccaccattaccaaatccattatagccatccccactgccaccaaagccaccatgaccactga

SEQ ID NO: 123241 - DNA, 277 bp, Homo sapiens
ttctagaggatcccgtgtgtcgacgtaaggagatgggtagaatagaggcaggaagccactcgcgtcggatgccgttcagccgtgattcgagggtgactgtgcacacgggtgccaggatgggctcactcccggcgcgggagctgcatctgtgcgaagtcctacccgggtgggatctggaggcccttagaccaccgcagcgagccctcgctaggattaaggctcacgggccagagcagagggtactcagctaggtttgtgagatcactaactttacaca

SEQ ID NO: 123242 - DNA, 459 bp, Homo sapiens
tgcaggaaggcctctcccagcctcagtttcctcatctgtcactccaacccaccaaggctgctgtgaggattcagagttaggaataaactgctgggcacagctggcactcagagctcccagccccatccacagacttctcatgtcaatttcccaaggtaaacttggggaaatcaaggcccagaaccggctgcagaggagctgaggacagagccaggatggaggccccttcctggtggctgatctttgtcctctcacctgggccacttcacccactctgcctccagtcacaaggcccagcaatgacctccacaacaaccaacatcacagcagctccaggagctcaagggcaccatgtctgtctgtccgttcacctagcactctgcctctgatggcagcccaagacaggctgccatgggttaaggccaggggctcagctgcaagaggtgcagatccccttta

SEQ ID NO: 123243 - DNA, 585 bp, Homo sapiens
aagtaaaggcactcagttgtacagagtgaggaggtttccctaggcaagattggtggcagcctcaggatgtatggggccggaggctgttatattctcactgggcgagagaaatggatagggaatgataatgatgaatgagttttctttcaaagtactcactaagggaggctctccattttctttttcctcactaaagtgcctcaaaatgcttaaagaattccactttggaattacttccgaactagtttatattttctatcccatgactctacaattgcacctcatttttaaccaaaaaatcatttcctgcttcatcaaccaccttattcatcagacgtggccctggatgattttcggttgtttccaaaaatgaaattcaacctcaaagcttaaagatttacgctatcgcagctcctgaagaaatgtgccatcaactctaaagatgaagaggagttccagatatattttggtattgaaaaaaatttacgtctcattattttgccatctcatacattttcatatcttcttctcttatattgctttgaagatgaaactcagatctgtataaagtatttcaagcatatt

SEQ ID NO: 123244 - DNA, 190 bp, Homo sapiens
ccctggcagacactatctttcagtcaaagccaaacagagatcttccccacctcattcactctaaagaaaatcaagacaacatctgaaaaatctgggcccaggcactccatgtatgctctcaaagaaagcccgacttccaagataccgctttatgcacaaaaagaaaggatgcctcctgtcattaacagtg

SEQ ID NO: 123245 - DNA, 2017 bp, Homo sapiens
  misc_feature (1)..(2): n is a, c, g, or t
nngttctgctcctagacattagagagataatacggctgatagacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccactt

SEQ ID NO: 123246 - DNA, 2169 bp, Homo sapiens
tagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactgacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccactt

SEQ ID NO: 123247 - DNA, 2067 bp, Homo sapiens
tccttgacgcagttgcccgaacccggagctaagttacccgcagggccattggaagccctccctggctttaggtttctcctccagtggaaccgacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccactt

SEQ ID NO: 123248 - DNA, 193 bp, Homo sapiens
ggagagttaaaatatagctagtctgtggctgctgagctgaaaggctgcactcacccaagtccttctaaactgtagggttctgattcacagggtctgatggtaaaacagaaagttaatgaggtatggcagtttcctctgttctgtcactgatctaggtcagccttccttttttttttttttgagatggagtctc

SEQ ID NO: 123249 - DNA, 1026 bp, Homo sapiens
tgtcagtatgtagatatacaattgatttttgtatagtgactttatagtctgataacgtctgtttcacttattacttctagtggtttgtttatatagaactctaagaaatttgcaattatgtttcctgtgactatcgttttacttccttctttctaatccttatgtcttgtcttgctttttattggtttattatactgtccaggacttccatagtgttgaacagaagtcacaagaatgggcataattgcattgtttccaagcttaggcagaaagctttcagtagtccaccatatggtatgatgtctgtaggatctgcagagaaaacctttatcaaaatgaggacattccttttaaactttatttcttgggagtttttatcataacgatgtttaatgctgtcaagtgcctctttctgtatctgttgagatgattacacaactttcttcattctgccaatgaattacattggtttcattttcaacttttaaactcactttacatccctgagataaaccccacttggttgtggtgcgttgtcctttgggatattgctagagttgatttctaggtgctttttttttttttttttaagatttctatattggtgttgatgggagatattggacttttgtatccttttcttgtaatggctttatttgattttggtgtcaaggtgatattgggtgtcataaaattacatgggaattgctgtctccttccctgtttttggaaatagctgtgtaagataggtatgattcttctttacatgtttgataggatttaccagtgaagtcatctgaacctagagggttttctttggtttggtttttgtttttgtgggagaattaagattttttaagagatattttcagatttttctgttgtcggttttggtaatttgtgtcttttaggaaaatttcatttcatccaagttgttggatttattggcataaaattgttcagaatattcctttaatatccttttaatgtctgtagaatctaatctgtattgcagtctcttcatat

SEQ ID NO: 123250 - DNA, 254 bp, Homo sapiens
ccataactcagcttacaattatcaattcatggccaatcaacatcttttcttttaagagacaaaatgtctgtctggagtgcagagtggcttaatcagctcatggcagcctcaacctcccaggctcaagtgatcttcccacctcagcctcccgagtagctgagattacagacacgtgccaccatgcctggctaatttttttagtttttgtacatacaggggtcttcactatgttgcctaggctggtctttaactcc

SEQ ID NO: 123251 - DNA, 387 bp, Homo sapiens
caccatctttgtaatgctgtccttctgatagtgagtttgcttcatggtttaggagctttgagatttgaatactggcctgctgggttttggacgtgcattgggcctgtggtcccatttgtgttatttttctgggaaatttcttccctttggagtgagaaagcttacccaatgcctgtaccatcatcgtaccttaaaagaactccattttaagttcagggactccttggcagaagagaccgtagccttgtatcaggtaagactttgaacttcttacatttgagttaatgctggaatgagttaaggcttttgtaaacatttgaaaaggcatgactgtattttactctgtgagaatgacatgagattcgggggagggggtcaaggtcagaa

SEQ ID NO: 123252 - DNA, 298 bp, Homo sapiens
taggacacagtcagaattggagcaaaaatgcactctcaagtcaaagagaataaactaacaaaagcccttctgccgttggcacagacagaggctgaggactgactatgcagcagtctaaaccacaatctacaaaagttgcttttggcccagcatggtggctcacacctgtaatcccagcactttgagaggccgaggtgggtggatcaccaggtcaggagttccagaccagcctggccaacatggtgaaacctcatttctagcctgggtgacaagagcaaaactcttgtctcaaaaaata

SEQ ID NO: 123253 - DNA, 593 bp, Homo sapiens
agagacttttctaattactaaattggtttgttataaaaagataatagcaaatttcttcttttcataattggacatttcttccctgtaggctaatgcaggcacagcccgtgcatgcacaataagttatgcttttgaaagccataactagctaataacagctacagtgtcatcagagagtaatggtgtgctgattagcataattaatgacaaatggtggtgcggaattggtggattggtttagcggatgatgaatgcggcgaggcctgggctgaggcctgccaactaggcctcgctggctgtcagcccttctgttctcccgatgcagccctcattagtcacgatgggaggtgccagtttgtattccgtttggagcacagaaaacttaataatccaagcaaatgtggctatccccttttcctctgtatttactcacaaaaccctctcactcattcccattgtggctgaaccattaagacacagctatttccagattcctctgcgaggcttgaaggcgaaacaaaagggagcataatagagagaggcacggatcccagagctttcatctgaccatcaatgaattactctcactagga

SEQ ID NO: 123254 - DNA, 433 bp, Homo sapiens
acagagcggcagtctctgtggtagcatctcaggcatgaggaaggttcccagttctctcctgggtcctgctcaggttcctgccacctgaaattctctcctcacaacttctgtcttgtgacttaagcttataagaatttgtcttctcgaaaaatgcaaatgttctcaggatgggatagcactttaaaaattatgactacggagatcttatcatccaaacaccaaatcagaatattttacaaagcacatttcttatcttttttcactggatgaattttattttctagattttttcctatatcaaagcaagtcataaatgttatttaaaaatttaaacaaacataaaaggaaatctactcctagctacacatcatttccctggcatctacttcacgagaagtataaccatggttaacaatgtgtggttgtccttcta

SEQ ID NO: 123255 - DNA, 583 bp, Homo sapiens
tctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaaggggagccgtcgctccaaaagtagagaagacaagaaatgctgtaagataagcaaccaacgcagacaggcctcagctaagagtatagtgtgtgtgtgttaaaaaaaaaaaaaaaaaaaagaaaaaaaaaagctgtatgatatacttgagcaaatcaatgaacctctttgcgattgttttatcatctgtaaaatgcagataattcctaccttaaagggttattgttaaagataaaatgatataaaaatgtgtcaaagtataaagtaaaaggcttggaactttgtagggactcagtaaacgtttgttggatccaaacctgaaact

SEQ ID NO: 123256 - DNA, 841 bp, Homo sapiens
tttgtattgtgaaagaaggtaaattctcaggaccccaaactcactatgccaaagagaaagtcaagcttggaaactgagtcatgcaatactgccttcccttttgttcccaaatggagagctgtattttcataaccccatgttctagcctcatgcataagccaggtgcccaccaagacagaacgttacgtatcttcccagatggctccctcacaagttgctcacaaagtgagcccctaattctttcaggatacatctccccctataaactagccctaaaagcaagttctgttaaatctcacactgacaatgtcgattaccagcttattttcacatggataggacaaggacaagatcgtaaatcatccttccacctaccctgagataaatgcagcatggccctattcccctactccctcttttcatgtttactttatgttatgtaaaatgcagatttactgagctcaagatgaatgcagcataaactctttactccctcttttcacgtttatcttatgtaaaatgtggattcactgggcttaggatgaatgcatcacagactctactccttttcaagtttactttatcttgcgtaaaatgtagatctactgagctcaagatgaatgcatcatggactcctctactcttttcacatgtttatcctatgtaaaatgtggatttactgagctcaagatgaatgcatcatggactctttactccctcttttcatgtttatcttatgtaaaatgtagatttactgggcttgagatgaatgcaacatggactcctctactccctcttttcatacgtttatcttatgtaaaatgtagactttccgtatgct

SEQ ID NO: 123257 - DNA, 835 bp, Homo sapiens
ggatcacagtatgcaagatcaatatacataatcaaaaaactttccacaaagaaaagcccaagcacagatgacttcactggtgaattttatgacccagttgaagaataattaataacaattccttataaactgtttcaaaacttagaaaacgagagaacactttccaaatcattctacgaagccaataattccccgatacccaaaacaaagacatcacaagaaaaaacagacagacaaaaatgaagaaaactacagaccaatatcttttgtcagtatagatgtaaaaatcttcaaaacaaatagaatcaaacaatacagcaacatatgaaaaagaatgtacaacatggccaattgggacttttcccaagaaggtaaggttggctgaagatatgaaaatcaatcaatgttacataccatattaatagaataaaagattgaagctttaaatcgggtcagtgatgcagaaaaagcatctgaaaaaaatccaataccttatatgataaaaattctcagaaagctagaaatagaaaggaagttctttgaactgataaagatcatctacgaagagtcctgcactaatatagtacctaatggtgaaagactgaaactgtctgacccctaagatcagcaggaaaggatttttcctcttactacacctgttcaacattgtactggaaataatagccaccaaattagatcctcccttcctgccccaaaatgaaagaaataaatggcatcactgttgaaaaagacgtaaaattacttctattctcagataatacgattgttctatggaaataattattaaatcttatggaagccacaaaaacctatt

SEQ ID NO: 123258 - DNA, 652 bp, Homo sapiens
  misc_feature (591)..(591): n is a, c, g, or t
  misc_feature (597)..(597): n is a, c, g, or t
  misc_feature (633)..(633): n is a, c, g, or t
gttgtccaggctggtcttgaactcctgggctcaataagtcagcccgcttcagccttccaaagtgttgggattgcaagtgtgagccaccatgccgggcctgacaagccagtttttaaaataggtaaaagaatgggtactttaaaaaagaatatcaaagtggtcaataaatatacaacagcgcttaatatgttagatacagttattaggggaaatattaaactaaattggaaaaccactacataccctccaaaatgtaaaaaattaaagactgacagtattggcaaaggtagagcagcataaatgctcttagatttgctggtagaagtgtaaattggtataaccactttcaaaaaatggcacaacctaccaaagctaaacataaccggtaaaccagcaactctaatcctaagtatgtccccagcggaaattagtgtttgtgctagacttgtgcaagaatgtcaactagaagatatctttttctccccttcttttggagacaaggtctcactctgtcaccagggttgaagtacagtgggacgatcttgactcactgtagtcccagctacttgggaggctgaggcaagagaatcncttgancctgggaggcggaggttgtagtgaactgagattgcnccaatgcactccagcctgt

SEQ ID NO: 123259 - DNA, 1230 bp, Homo sapiens
ggccttgaaggcatttcagagacctttgtggcagcccctcccatcacagactcagaggcctaggaggacagaatgactctgagtattaaagtagatttaatctaaatcataaagtacaagctagagcaatccctccagtgctgcagaaactgcctgcatgtggctcccacattgtttcttggagctttggtggtggtaggggtggcaggggcaggtgttatgtttcttggtttctcaccttcaggtctccttacccatgtttcctttgtcagagtcattggccttgatggaggggagactgggttactctgagttgagaagcaagcttgactgccctgtggtttatatcagcctagcttagtttgttttctgaagtcttcacaaataaccaaatatccagcccagtgcagttctcaatgagtagtctccagttcccatcccccaccacacacacacaccaaacactgtgcccacctgggagacccattttcatttatcttcttctttgagtgcctggaaggctgaacatttgatcttttcaaacatttttctctcatctggcctgttagcgctcttgagcctttgaaaatgccatttcctctacatactattcttcctcagagcagccctctgtttttttttccaaccagtcttttctcttgcaaagttcagatcaaaattcttctttatgtaaagagaagtggcgtgccataggggttacaaacagggcttcaaggttagcactgggatcaaattccgactttgcaacttaactttcttgagtaagttgctacacctctattagcctcagtttcttatctgtaaaatgggacggctaagtacctatttcattgggctgttgaataatgatggtctcatctatgcaagggcttagtaccagctgggtgaaactcagtgaatggcaggcaaccctattatgactaggcttctgccaatgatcagacttgaaccctgtgctcatccccccatcactttgtggaactagatgtcctacgttgcacatggcttgattcatggtttggagttgttttctggttgtttcctgtgtgcaggtttaatctcaacctgtgatcccttgaaagctgcaattttatccctccccgtcctcctccctctcaccccaaggccaagtttaatactgtgcattctgaaatcttgcaatgttgatgatgtaaaataaatcttctctcctgtgtttctgaagaatac

SEQ ID NO: 123260 - DNA, 1211 bp, Homo sapiens
ggccttgaaggcatttcagagacctttgtggcagcccctcccatcacagactcagaggcctaggaggacagaatgactctgagtattaaagtagatttaatctaaatcataaagtacaagctagagcaatccctccagtgctgcagaaactgcctgcatgtggctcccacattgtttcttggagctttggtggtggtaggggtggcaggggcaggtgttatgtttcttggtttctcaccttcaggtctccttacccatgtttcctttgtcagagtcattggccttgatggaggggagactgggttactctgagttgagaagcaagcttgactgccctgtggtttatatcagcctagcttagtttgttttctgaagtcttcacaaataaccaaatatccagcccagtgcagttctcaatgagtagtctccagttcccatcccccaccacacacacacaccaaacactgtgcccacctgggagacccattttcatttatcttcttctttgagtgcctggaaggctgaacatttgatcttttcaaacatttttctctcatctggcctgttagcgctcttgagcctttgaaaatgccatttcctctacatactattcttcctcagagcagccctctgtttttttttccaaccagtcttttctcttgcaaagttcagatcaaaattcttctttatgtaaagagaagtggcgtgccataggggttacaaacagggcttcaaggttagcactgggatcaaattccgactttgcaacttaactttcttgagtaagttgctacacctctattagcctcagtttcttatctgtaaaatgggacggctaagtacctatttcattgggctgttgaataatgatggtctcatctatgcaagggcttagtaccagctgggtgaaactcagtgaatggcaggcaaccctattatgactaggcttctgccaatgatcagacttgaaccctgtgctcatccccccatcactttgtggaactagatgtcctacgttgcacatggcttgattcatggtttggagttgttttctggttgtttcctgtgtgcaggtttaatctcaacctgtgatcccttgaaagctgcaattttatccctccccgtcctcctcttttaaccagggcagttataccggctctgaattgcccgtgatatttaaaactttcccgggtcctgcatcgggggccgcc

SEQ ID NO: 123261 - DNA, 202 bp, Homo sapiens
tttgtttaagtggggcaggagagggggacagaggggagaaaaggcaatatccaactcttaagggcacttaatttgtgattcctctttaacaccctactggtttagaccaggagtcagcagatgagtggtaaagagaacctgctgtagtggtaaacagataccttttcagaagaggtattcatcaaaacttttcaagaagtct

SEQ ID NO: 123262 - DNA, 597 bp, Homo sapiens
agacgatggtgtgcaaagcatgctgagggaaccctctggggcaaggagggtgacaacaggcatgtctggctgtgggcaggcctctctctgcagctcccctgtgtcctgtgttcaccctgcacgggaggggttggcagcccccttctgcagctgaggaaatggggcagggaaaggctgcacatcttttctgaggtgccaaagccaggtcagtggctcaggtggggtttaccccagatctggtcctggcatgatgctccagcacccctgatttgcaatcccaacttaagaaagaaaatagaaatgattaaggcaagtgtgggcatgccctgtgcgctccgagctgagggcccaagaaactgctgttcactgaatacgtagctgcctggctgcctggctccctccttcttagccccagcctttccctgtctgccccacagcctcctcagagaaccaggaaagggccttgctgtcttcctgctgagccttggggtctcctccaagaaggtgaagtagcctggccagagtgggatttacctcccctcagtctaagctccagccagcagctctcccggcaggttctggcgctccttggagcac

SEQ ID NO: 123263 - DNA, 479 bp, Homo sapiens
cctgcctgagcctcccaaagtgctgggattacagattgaaccaccgtgcccggccaacagatgcatcattcttaggattaaacagcctgaggagtttccagcctctgttggtggtattggggtcgtttcctcgctcttctccattcactgcctttagaagctgctttcaaagaagacggctttcaggacaaggcatcacacttcttctccagcacgtacagtcctgaaacctccaggaggaagctgccccaaggtttcctgtgtcccaagcttgctgggaactcctcatccttccattcaccctattctcaatatccctgcccctccaatcccttagcatacttgacttagccttggccaccctggctagggacattgatcaggaaggagtacagcgtatagaatcatagaggaattgaaaggaactttggaatataaaccagactatcctcaaccacacccccaccctcagcaaatgc

SEQ ID NO: 123264 - DNA, 396 bp, Homo sapiens
ctacaggggtttgagtaggggagtgacaggaggcttctgtctcaaggactgttctgtgttgagaacagactgcagggaggtaaggaaagaagaatggagaacgcttgggaggctaaccttgtgacacaagggagagaatgatgtcttcgtcttggggggacatggtggggctggtgagaagtggtcagtttctacatatgttctggaagtacagtcaaaaggggtccctgctggcttggctaggggcatgagggaaagacaggcatcagaaataatgctgaggctggatgcagtggctcacacctataatcccagcattcagggagggtgaggcgggaggatcgcttgagtccaggagttgaggccagcctgtgtaacatagcaagaccccatctc

SEQ ID NO: 123265 - DNA, 442 bp, Homo sapiens
ccaaggccagggtcaagcatggggtggctcatgcctgtaatcccagaactttgggaggctaaggcgggcagatcacttgaggtcaagagttcaagaccatcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataa

SEQ ID NO: 123266 - DNA, 484 bp, Homo sapiens
gtggaacagcgaaggggagagagagggaggttgaggagggagaactcaaattcattacgggctcataaagtcccatatgagaaaagcgccccgtttcgcagccgcgtctggggaacgctggcggggtatgcgttaggaaggtctcgtcccagccccgagtgacaggcaatgggctttaaaagctaggacatgggatggcgtggagggggtgagggtgagtcccagaggcaggcttcaatcagtgagcaactttggggcacttcgaggacttctaagtcctggccattacaacaaccttgcccttgccggctttcaggggaatggggcctaatgaaggggagttacctccattaaaacgtcaaagaaatcaacggtccccaagtctcctttcacatgcatctcaattgggtcatcctccctttcatcccaaaaggagagagtgcatctgaccattcggagcacgggttacgtgccctaggctccg

SEQ ID NO: 123267 - DNA, 624 bp, Homo sapiens
accagagagccagtccaacccagtccatcacctggaggctggagaaccacgaggctgttgcctgttcgtccccctcttctgagaggtccaggtcacctgctctgggagaagccagttgccatgttgtaaggacactcaagcagcccatggaatgactcacatgctgaagaactgagccctccctccttccaacagccagggaggaactagggcttcttgccaataaccatgtgaagaagcttggaaatggattctcccccaaatgagtcttcagattactttagactaacatcttgactgcaacctctagaaagaccctgagccaggatcaccaagctcacagaagctaagagttaataaatgtttgaattaagctgctaagttttggagtcacttgttatgcagcaataggtatctagtatagcctgtatttatatattttgattttctgtatattataatgttttgacatctttttttttttttttttgagacggagtcttgctctgtcacccaggctagagtgcagtggtgcaatctcagctcactgcaacctccatctcccgggttcaagcgattctcctgcctcagcctcccaagtagctgggattacaggcacctgcc

SEQ ID NO: 123268 - DNA, 289 bp, Homo sapiens
accagagagccagtccaacccagtccatcacctggaggctggagaaccacgaggctgttgcctgttcgtccccctcttctgagaggtccagaccatgaacaattggtatacttccttcttatgaaatccctctctatagccctgagctcaaggcttcactgtggaattctaccaaacatttaacaaagaactaacaccaatctttctcaaacctttcaaaaattgaagagggaacacttactagtcattctatggagctggcattaccctgataccaaagccactacaa

SEQ ID NO: 123269 - DNA, 708 bp, Homo sapiens
gttttctgggcctttgctccacaaccacctctgtctggaaggtcaggtacctgggaatatttggctcttcaaaagccagctgaagtactgctttctacgacaaatcttccctttaacaaaagtggtcactggtacagagtcagtgcctgtttttcaacctgcatgcgcactatcactgtctactagtagtttccatttcgcccctctgcagtcattggaggcccacctaactaagctccacattcttctctactctagcatttgcaaaaggcagtgaattcacattttaaaggcaaaacacaagcaaaccacttggtgggacacaagacagttcatcttatcttattttgagcagagacactatagttgaaaaactcttctttgctctaaatcttccttcctctaaatctgctgctcttccacagcctaacttaaaatattatagatgttggatcaaatttgctttcctgttcttagtttttaaaatcaaaataatggttttctcctccttcaagaaagtaaaacaaactccaaaacaaattcagaacaaaaaagccctgattgtggcattcaactcttacctatgagtctcaaggggagaaaaaaaagaatttcttacaagtgggagggttgacttatgagtaatacatatcacaaagatcaacaagcaggagcacatactagcaagaaactgtaagacacaccttt

SEQ ID NO: 123270 - DNA, 333 bp, Homo sapiens
attaaaatattctcttgaggaaaaaaggcaaccacagtagacatctacttgcaaacatggatgaggttcagaaagtatttaattttgcttttaaataaaaataatatttaccccctattcacaccaatagtaagaactgaattcttactacgtgaacaaagttatcattacacagagaaaaaaaaattctctttttcataccagccccccttcccactggaacatcttagtgggaaaatgactggcattactgtttgttcttacacacttgggccaggcaacatgagcagctgacctacctgaatcccaaataccaaatacagagcttcaggg

SEQ ID NO: 123271 - DNA, 340 bp, Homo sapiens
ccagaagagcacctggtgtgttctaggacctcatgggagcccaacaactaaggtggaaagcggatagataggtgggagtttgggggatacatcaagcccatctgaacttggtccttccgtggctcctcacaaagctgtgggtgggcccagtctcgggactggggatgcctctcctggcaggcactcctcccaaggacccatttcagccaaccttgtggtgttccctcaacccagaacccctgcagcataaacactcagggcacttgtgaatgtcttcattcacgtattgcacacactcccagggtgactccatcaggcgagctaccatgttgctcttgcc

SEQ ID NO: 123272 - DNA, 152 bp, Homo sapiens
caggagagcagctcttggccaccagttgggaaggaaacagtcaggctatattaggaaacttacaagcaagtggcaagaggcacagacacccaggggaggctgggagtgacagggccctgggaaggggaaaaaccgactcctgaggccacccc

SEQ ID NO: 123273 - DNA, 554 bp, Homo sapiens
tgccaataagtttcttcgaattatgtggagcacaaagtttgaagagcactaaatattatttaggaaagtctacctgtgcatctaactgcataaatccttcagtggtgagaaagttgcttcagacttctattaactcatgtttgggaagtccttacacacttacctgataacagcctttcagatatactttccatccttttgtggtgtttctagtagcttcacatagtcattttcctggacatgttgaaataacctatcttaatattgtgactcatttacatacaaaataagtattattttatgtacgtagaaaacattgcttgaggccaggcgcagtggctcatgcctgtaatcccagcactttgggaggctgaggcgggtggatcacgaggtcaggagatcaagaccatcctggctaacacagtgaaaccctgtctctactaaaaatacaaaaaaaatcagctgggtgtggtggcgggcgcctgtagtcccagccacctgggaggctgaggcaggagaatggcgtgaacccgggaggtggagcttgcagtgag

SEQ ID NO: 123274 - DNA, 213 bp, Homo sapiens
agctgaggcgggagaatcgcttgaacccgggaggtggaggttgcagtgagctgagatggcgccactgccctccagcctgggcaacagagcgagactctatttcaaaaaaaaaagaaagaaagaaagaaaagaaactactttatgtaaagaagtactttagtaatcactgtgaaattctgtgaataatcagcagtgaaaatatgcacaaaggat

SEQ ID NO: 123275 - DNA, 223 bp, Homo sapiens
tgggggctacacaaacattgagaccatagcagtggcattttaatggatgtcagcctcttgagagtttgaatagtgtcagtgttaggttgagtttctaaccctgcaaaggccagggctacctcttggagcctaaggaccctacagaggtttttctacttcctaaagacctttgacagcaagtgatgttttgcttgcttctgctagatcctgtggcattctaact

SEQ ID NO: 123276 - DNA, 531 bp, Homo sapiens
gtctttcggctccccgcttcccccgatgatgatcaggtgcgacctagagagttgtggagaggaatggggtattggttggggagggggtgcgggttagttcaggaggaggttacatggcggaattcccacgaatgctggcgaaggatgaaaaagatgaagaaatcttgtttttctgaacgagaggattctctgcatgacttccccactgttggggtgatgagctttcaggctgagattttattaacaattcatatggagattgagggcagtggaggagcagattctcacataaacttgatctgtccatgaatgcagttctctgtttgccctgaccctgcatggcttaagacactgcctgtgaggccagtgtgccagacacaaagaaagaaatgaaaagcaagcacattccaggagtctgcacaaaggagcccggccgtttctagtcgtctccccagagaggatcttatctctgcacagccaaaaacctctaaaatgtttatttgtgtacttaaagttttaaaatccatgtgg

SEQ ID NO: 123277 - DNA, 613 bp, Homo sapiens
gggaaattacttggactctcccgggtggttcaaaaggccctgcagtaactagaaatgcccttgggtactggatagagacatcacgtggtgctgaaacagaaaaaccaccggtgcagtagatggaggtagagctgaactaatcttatgacatatcctaaacatttcactcattttcttttatataatcacaatccaagtttgtctctcataaaactgaggtgtggaaataatccttacctagctttctggctgtttggatttggataaagaaaagtttactcgtttattactcaaaaccccacctgtttctaaaaaggatttgaggtcgtttacaataaaaaaggtaaacagagaccaaccaaatgtatcacaaggtaagggagctcactgtttgccttctgcactagctccctagggtctaaggatcaaaagttgcaaagctggccgggcgcgggggctcacaactgtaatcccagcactttgggaggccgaggcgggcagatcacgaggtcaggagatcgagaccatcatggcgaacacggtgaaaacccgtctctactaaaaatacaaaaaattagccgcacgtggtggcgagcgcctgtagtcccagcta

SEQ ID NO: 123278 - DNA, 788 bp, Homo sapiens
tggtgcgatctcggctcactgcaaccttcgctttccggtttcaaccgattctcctgcctcagcctcccaagtagctgggattacaggcacctgccaccacgcccggccaatttttgtatttttagtagagacggggtttcgccatgttggccaggctggtctcgaactcctgacctcgtgatctgcccgccttggcttcccaaagtgctgagattacaggcgtgagccaccactcccaaccaagacctgatttttcaaaagagctcccattctttattcataggcaatataacagtatttttaactctacagtaactattgagaatgacccactcactgacagcagacagttaaaattgggggctactgtgtgcaggcctcctatattcaagggattttaatcctaacatccacctgtgagggtaggtattattttagttacatgtgattaaactgaggctggggaggcttaaatggcttccccaggatcttatagctagtatgtaattgagctgtaatttgaattgatactcaccttactccaaaatctctgctttttctattggcccatactatttccaaaggaaggtcagacgtcatatgatcataatgtggggaatattagcatttctgttttgtaatctttagattagctctcagtttacttttggggttttattttttagatataattcacatacacaaaattctcccttttaaagcacacaattcagtggtttttagtatattcacattgttgtgtccctatcactaattccagaacattt

SEQ ID NO: 123279 - DNA, 174 bp, Homo sapiens
ttcaaatccacattctgttaagattctgctcaagctgaactttcagcttcagtttcttcatctgtaaaaagaggcagttggactagatgatctctagttcagaaaatatgattttaagagatggaacatgacaagtctgagaaaagtcaagaacaaacctagtaagggtcagaa

SEQ ID NO: 123280 - DNA, 226 bp, Homo sapiens
cctttagattttccttctggcatggacaaaagcgtcattaattatgaatatgaattcctttgcaaaatgacaagattgaacatttcctcatgccagtaacccagctgtctcattctgatgtgcaacaaagactttttagagattgtttttaatggccgtggtatcagacactaaaaaataagaagcttaaaaggaatgcaaagtagcttacagttcattcgtctag

SEQ ID NO: 123281 - DNA, 656 bp, Homo sapiens
gagaattgcttgaacccgggaggcggagggtcgcattgagccaagatcgtgccactgcactccagcctaggtgacagagtgagactcctgtctcaaaataaataaataataaattttaaaagaaggtagccaggtgtggtggtgcattcctgtagtcctggctacctggaagggtgaggcaggaggatcgctttaaccatgagttcaaggcagcagtgagctatgattatgccactgtactccagcctggacaacagagcaagaccctgtctctaaaaataataatttttaaaatttaaaaaaagaaaggaatgttatggcctcaagagctctttgtccatcctttactgtagacagccagatttgaggaaggggcccaggcagcctcagctcccattcagtgccactcagcccctgctcctggtcagctgtgaaaggctctacacagccccaagggaggttctcagcttcccatgatcagactgcctcagcaattccccagagtccttctaagccacctagtatgtcagattcagccccatctaccaagcaaggaaatgaagggcagggggtgagtgggctatcataccgtgagcctccggcctgcaagaccactttgtagtccctaccagctgtgtggccagccctgttggtaa

SEQ ID NO: 123282 - DNA, 208 bp, Homo sapiens
tattactttccatttctttctcaaattctcgctaactctcatacacatcaagtttagtaggcaagataattttctctcctaatccaaatctttaaacacttcacaaatacctttatagacaggaataggagtttgctaaaattttaattttggttaaattcaacaaagtcacctgtgtgcccaacactatgctatatgttctgaataa

SEQ ID NO: 123283 - DNA, 1255 bp, Homo sapiens
aaataaacctttcagttgagcagtaacaagagagcaatctattaataaattgcttattataaattataagtgaatgctggctaaaaaaatcatgtagactaagttttcagtttgaatcttttattgctgtgataaaaatagatatgtttcaaagcatgtaagtgctttcacaaatagaatcagatttcaaattcaggagtatgtttctttttttcatcattataaattaagctccatcctctcatttccctcagtcttcttccatctaaaagcaaagtttacagtttacttcggatttcaggatcaggaataagtgtcttcagccttctaacaggccatgccttatgcctaggctgtcatacacattctaacatttaatttcatttaattcactatgttaatatttatttgctatacaagacaaggattctaaacttacgatttttaagtacgtcaagggatagcctgacgttaaaatctttttaaaaaattggtttgtggtgtacaattttatgcatgttcacttctttttttttttttatttgagacagagtctcagtctgtcacccaggctctagtgcagtggaaccatctcggctcactgcaacttctgcctcccaggccaagcgattcttgtgccacagctcctgagaaatctgcataagagaacagtacaatttgcagttaggatcatctttctagatttctgtatctttcaaaatttctgtgctttctgagatttgtacccaaggttcactgaaatatgattcagaaggaatatcaagcaccaaaaaaggactcatttatttactttcaccttaatattttaggcattgaacacattcttaaaaacactggtctgtaagaaactggtgttttgaaaaattaaagtgtgtcgtagtctagtatatttattttggccacatagatcaaagttagtttcagtcttttcaagctctaaaattttggttctgtggttatttaaacaaaagctatgtaaggactttaaagtgattaagtaaaaagtctttaggtatgtcagaatcctctttacttagggcaaaatgtttcagggtgaacctgtggtagccttcatggcccatagcctaattgcctgcccttagggacactagaacaaattgaaattaatcatgtccactatgattatatttagtttcaaggaattcatagatggtaaacctgttgatttataaaataatgatgattatatagaaatagaatattgaacaatgac

SEQ ID NO: 123284 - DNA, 357 bp, Homo sapiens
caccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaacacaggtcgctgcatttagaaaggaggcggggtcagaggaataaaaagggataggcctgaagaacagaggtcgctgcatttagaaaggaggcggggtcagaggaatagaaagggataggcctg

SEQ ID NO: 123285 - DNA, 607 bp, Homo sapiens
agaaagtaaccatcagagttcttatattctgccacaagaattataatatgttagtaattagcatgcggaaatatcttaataaaaattcttcaggataagtctgccatttgggaactgacagtaaaataaaggcaaaaatgtaatgaatttatctcatttgttttgtgaatcttgtaggagtgttctgtctccttaaagatcattacctgttcttcagctggtacagctatattttctaaaggtcagaatcagtgtaatattagttcattttccccttcaattaaacaaattatttgtgatatatgaggaaatttgttatcagatttaacttgtcagaaatgctaccataacaatattagactaactactgtaaggaaaaaaagaataaacacaaaacttcaaatctcagagacttacctgctcacatcaccttctaaaggtctctttcctgcagcgatacaggttccttggtctctttcctgcagtgatacaggttccttttctctaatgcctctgctgtcccctactacgggtccaatccagcccacagcttgtttcgtatggccccagaactaagaatgcttttcgcttttttaaagcgtaaaaa

SEQ ID NO: 123286 - DNA, 835 bp, Homo sapiens
tgacacacaacaagaacactctttgaaaaaataatgtgggggagtcttaaaacactaggtctactacaatttatatatattttaaaatcccagcaaacccttgaaaagggagagaacctcatatgcagagttgccaagttacaacagtcaaatacacaatatgcaattttaaaaaatcacacgagttgatgggtgcagcaaaccaacatggcacatgtatacctatgtaacaaacctgcacattgtgcacatgtaccctagaacttaaagtattaaaaaaaatcacaaagatacagccaaataggaaaatatggcccaatcaaaagaggatgaatagcagatttgagcaggcagaagaatcagtgaatatgaagatattaactgaaatcctcaagtccgaagatcaaaaagggaaaaaaaaaaactaaagtgaagaaacaaaaagggatgggagggaaaccatcatgaagaacatcttatgtatacgagagtcacagaaggagaaaagaaaaagaaagaagcaacaattatttgatgaaataattgtggaaaacttcccaaattgaaggagagagacttaaatctacaaatacaggaatgaactcaaactgggataaactcaaatacgtatagatcaaaacacattacacacaaactgtcgaaggccaaagacaaagagaatattgaaagcagcaagagagaagcaagtcaacacatacaaaaaaacttcaataagatcatcacctaatttctcatcaaaaactttagaggccagaaggcagtgtgacaatatatttcaaagtgatgaatgaaaaaaaaagttagctgaggattc

SEQ ID NO: 123287 - DNA, 345 bp, Homo sapiens
ccagtcttaaacctctgggcttaagttaccttcctgctttggcctcccaaagtgctgggattataggtgcaagccaccaagcctggccaggaagcttttcttaacaaatttgacttacgtactagatagtgggctattcaggttatcagtttcttcttgaatgagctttggtagcttgtgtctttcaggaaatgtgtcaaatttatctagattgttgaatgtattgtcataagggcatttgtaatattctctcattatccttttaatgtctgtagtatctgtagtgatgtctcctgtctcaagatgtagatttagcttcacctttgtattttaagacatttactt

SEQ ID NO: 123288 - DNA, 354 bp, Homo sapiens
ccgccttgacctcccaaagagttgagattacaggcatgaggcaccacaccggactccattaggtttttaaagctttttgtagaaagtgatgctgaaagaaagaagtgggtattccatgtcctggtacctctggctgccagagggaaggaatgagagctatttcttgccatcttcctgtgctgtctttggtagttctctcccagggacatgtctttccctcagtgtttgatgcgatgggatgcctgtggccactgtgacgcggggatcagctgctagagtaggtcctgctgcacatcaggactcacactacttgtggctcatggtccccaaggaacctgcttccttagggaagat

SEQ ID NO: 123289 - DNA, 371 bp, Homo sapiens
gtaccccacaggctatcgggaaattagcccgaggcttacgctttcattatcactgtctcccagggtgtgcttgtaaaagagatattccgccaagccagattcgggcgctcccatcttgcgcaagtaggtcacgtggtcacccaattctttgatggctttcacctgctcattcaggtaatgtgtctcaatgaagtcacattgcctgaatcaggcaggaggattgcttgagcccaggagttggaggctacaataagctatgatccagctgctgcactctagcttgggtgacagagaccctgtcttcttaagacaaatccagaatttgggacatcttataatttagttgccctggattcttcaaaaggtcaagg

SEQ ID NO: 123290 - DNA, 411 bp, Homo sapiens
ttatggttatgtagagacactgatcctctcaatcctgagagtactttctgtcaccagaggaccaagagcagtttttcttctgctacataaaatgacagtggtatttttcttccttaatgttaagtgatatcaaaaaaggcaaagacatcactaacaagtatagttatccctagacaacaccttacaaatacattcccacttgaaagaaagctaaaatcaataaagctcaccaggcatggtggctcatgcccgtaatcccagcactgtgggagcctgaggagggcagatcaccagaggtcaggcgttcaagaccagcctggccaatatggtgaaaccccgtctctactaaaaatacaaaaattagccgggcacacacctgtaagtctctgctactcaggaggctgaggcagg

SEQ ID NO: 123291 - DNA, 420 bp, Homo sapiens
ctgtttattactgaactaagtttatacgttagcaagggtttcagtaaaataagatttgtgttaaataatcttcagaagtggtattctgtggtgataaaaattgctttagggttgcatttatatcgctgcggtcataccaagggtcaggatataggtttttagttggcaaaaccatcaaggactccatttagaagggtatttttaataaaatttattgagtattttaattacagccctctgctttcatgtatttttgctagcaaaatagtctttgaccataggtttaatgcactctcactacaaggagagaagggttttgagggtggagagacttgaacctgtagtgtggcaggcattctacaaaatatattttcagaaataccctatgtggtaggctttgttatcttttctttacaagtg

SEQ ID NO: 123292 - DNA, 260 bp, Homo sapiens
tccaaagtgcttcccaataattaataagtgtcagttgacacagtcacatactattagtactggatgagatttgggtgttcatctagaaaaccagctgtcttacaaacagagaaactgaggctcaaagggttaactgatgatgaagcataacacataaagagtggcagagcaggcactcaaactttatgaagtcctcatcaaggtccacccggctatctctgaccaggccccaccctcctctccaggcatctcttttaatg

SEQ ID NO: 123293 - DNA, 672 bp, Homo sapiens
aaatacagactctcccgcagaactgaccccagcaagaagcctttgggagcagtagagatggagtttcactatgttgcccaggctagccttgaactcctgacctcagatgatctgcccgcgcaggcctcccgaagtgctgggattacaggcatgagccaccgcacctggcctgccaactcttgttaagatctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacctcgctgattgagaagacttcactctctctgcaaagagacgtgtgtgttttagaggaagtgggagccccagccgattctgcaagacttccgagagtcagatatccagacagaagatgcggacacctgggtgaccagacagcgaagaggaaagaacaaaacgagcatgtgcc

SEQ ID NO: 123294 - DNA, 331 bp, Homo sapiens
attcagctcggatcccatttacctgcacaaagctttgttttaacacacctgctttaacagtttcaagtcagcaatttagtgatcccattgagaaaaagccatgcatgggctataggatgttttctgctttctcttcctatcatgtttgcaattgggcaccagccgtcaaagatagatgtctcataacgggaccactgagtcaagaggaagtgttttcattgttcagaggatagcaggcacacaatgtcatgtcacaccatgttcattgtggattttctgctatgacgtagccaagtcagaggagtgtgcacagtcatctcttctgtgttct

SEQ ID NO: 123295 - DNA, 238 bp, Homo sapiens
attcttaggttgacatctaaaattttcattacaagttttaatcactgcaaaggttatattttcatttatatatcaatctatgtctatttagaactgacacctaaaaacactattatattgctaattttaaagctattaaacctactatattggtgaggcaaagtggctcacgcccataatcccagcactttgggaggtggaaggaggtggatcacttgggccaaggagttcaagacca

SEQ ID NO: 123296 - DNA, 197 bp, Homo sapiens
gaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagtt

SEQ ID NO: 123297 - DNA, 270 bp, Homo sapiens
agtgtccactggttgggacaaagaagaggcagcgagtatcagtagctggttcaggaagattggttgtgaaaggaaggtgggatgagaggggaaaatgtggtcaagagagaggtttttgtcaggatgggggactttagcgcatgtaaagcatggaggattgctttaaattgcagtttacagaaatgcagcagacttttctgtctcaggggagtggcacagtttcttttgcaccttcttaagcttgcatggctctggaaagtgagctttctc

SEQ ID NO: 123298 - DNA, 200 bp, Homo sapiens
caggcgtgagccactgagcccggctcttctcagatttatgtatgattggtttgctgctctgtgttgtagcagagaccctgtgctctgaagtaatttctgatccagtgaaatattacaggagcgagggactgtgcaccttcagtgtatttggtaataaagcacctattctctttttagaaatcactataatccacatgcca

SEQ ID NO: 123299 - DNA, 162 bp, Homo sapiens
gctgctgcagaggtggctggggaacgtggagaacctgctgtgcaacaggaacttctggatcctgcagttgcccccgggcagcaagggggaggcccccaaggtacaggagctgggtgtaggaggagaggccctgcctggactctgtagggtggccatatgcat

SEQ ID NO: 123300 - DNA, 421 bp, Homo sapiens
aattatactcattacagaaaccctgaatggcagcctgtacttagcatcaatttcttaagcttgctttgagaaaaagtgatttttttctgacatcattttagaattgcctggctatcttaatacagatgctctgaggccaggtgtttggctcatgcctgtaatctcaacatttggggaggccaaggcaggaggatcgcttgagccttaggagttcaagcccagcctgggcaacacagtgagtcctcatctgtacaaaaaatcaaaaattagctgagcatggtggcacacacctgtactcccagctacttgggaggctgaggtgggaatgtcacttgagcctggggggtcgaggcttcagtgagtcatgattgtgccgttacactccagcctgggtgacagcaagaccctgtctcaaaaaaaa

SEQ ID NO: 123301 - DNA, 202 bp, Homo sapiens
ggatcactcagttcagctacgaggagaagatggaaccacccctctctggagccaggttgcttgtctacttgagtcatattgattcaagcaggagaacagactttgaaggcagctaggatgtatgtgtgtctatacaatgtctgagcccaaaccatccctttgtttttattcaataactcattctatcttagaagttcttttt

SEQ ID NO: 123302 - DNA, 290 bp, Homo sapiens
gtacctacatttacctctgcatggaaaggagtttcacccaggtgccaacatgatgaacattaactgctattagcaatccacccatccgggtagacaggctgtcagccagagtctacagaaacgtaggcagtcactcttccctttgcttccccctcctgttcatttgatgcctaataaagaatgacttttcacttgtgctcattgtccagtttttaccaagatatgaaatacatctatagcgctgaagaccagtgaaagatattcagtttggggcaatgcaaggaaagaag

SEQ ID NO: 123303 - DNA, 389 bp, Homo sapiens
tcactctctcacattaacactcattctcagggctttcccatctccttgccttccccagagtatgtcaggatctagatgtattctaacactattcgctcatacatgcaccacagtgttcaccctggcttctccacccgtcagctccctgcagtgcacacaccctggctccggaagctgtgcatcttgcctgaaactgcctcctccctctggccccttggaggcccctgactggtggttgtcctgtgtctctcctatttcctccttgcacaactctgcttcctcccctcatcccttaactgccagcctccctccaggtttcctcttcctgtaccttccctggagatatcactaactctgatgtcaccatccactcctgtgatcgcctctcc

SEQ ID NO: 123304 - DNA, 426 bp, Homo sapiens
ttaattaaagttattctctattatgggactttaaaatctggcctgtctgcttttttcactgcagagttgcacagaataaaaaagactatatgcaagtctcagctctaaagtaactctgcgctctctgggccccctcccttatagctacagtttgctgacccagtggtcagcttgaacttagaacaagtgaatgtatcccaggttcaataaaatatgcttcctatttggtttttgctacaaacaacgtcctttttctgcctcatttcatagaactttctaatctaaaataattggccttctactcattaacttttttcccttaaaacttcagtctgtctctgttttgcctgtgaatctaaatgactgtatataggccaaatgtgatcgggtgctcaggggttgatctccagtttgcttggggatgca

SEQ ID NO: 123305 - DNA, 137 bp, Homo sapiens
cccaggatagatttgagataaatcagttccatactgaggtgtgacattaggcaaatcaagggaaggaggaggaaaggaatcaggtcagagctcagcttactttattcaaccgtggcgtatggggccaggcgcagtgg

SEQ ID NO: 123306 - DNA, 300 bp, Homo sapiens
ggctttgtctatttctcctgcagtcctctcagtttttgcctcacgtattttgacactccgttgtgaggggcatacacattaaggactgttatgtcttcttgaaaaatcgacctcttcatcattatgtaaatgcccctctttattccggataattttccttactctgaaatctgctttgcagaaattaacatagctactccagctttcttttgattagtattagtagggtatatctttctccttccctttacttttaatctatatatgtctttatatttaaagtgaacttgtagacaacat

SEQ ID NO: 123307 - DNA, 149 bp, Homo sapiens
tataggccaatgaaatattattttaaggtaataaataactttttagcgctttttgccttaccaaattcctaaggacagctcttctgtgtattatataccattcagcatctccaacatgagcagcacccattaaaagtctgttctctaca

SEQ ID NO: 123308 - DNA, 98 bp, Homo sapiens
caacacaaagaacctaagagtgaagcagcacacagcatttgcaaaggatcaataagatacagccccagcgaggcgctgtggctctcacctgtaatccc

SEQ ID NO: 123309 - DNA, 264 bp, Homo sapiens
ttaacttctttcagctccactcaaaaaaaagaaagtcctaatgcaagtaattgaaagtgaagatattgcaaaacaaataatgacagctgaattgatgatatgatgacaggctcatccctccattgtaaactatgctgcgtaagatatgcctgcttcctgtttgccttatgccatgattgtaagtttcctgaggcctccccagccatgcttctatacagcctgtggaaccatgggtcgattaaacctcttttcattacaaattac

SEQ ID NO: 123310 - DNA, 294 bp, Homo sapiens
cttaaatttcagatttggattcacagatctgggttggggtccaaattctgcaattcttttatttttttaacaggatctggctatgttgcccaggctggagtgcagtggccattcacaggcctcccaggtagctgggcctagaggcctgtgcccagccagattctgcatttctaacaagcatcaggtgataccaaccctgcttgttcactgatcacacttaaagtaacaagggtctagactaggggtcagcaaataatggcccatggtgaccaaatcataatttttaccttctta

SEQ ID NO: 123311 - DNA, 573 bp, Homo sapiens
ctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacatgctggacagtgtgtataaaaaaacaatagaggctccagatgattttctcttccatcaggtagttttccccctttcttttgtgaagtatattaaggaactgatcacctcaagccaatcagagatcaagctgcatttgaactaggttgtagttttagtaaaacttggtgtagctttcatttgtcccagtttctcaggtatgtccctccctgacttttaaatggaaagctgttaaatttctttctcttcagccctgaaagactgtgagagatgcagttctgccacttcgtaggctgttttctttgtgccccagtggagatcttctacatgggtccagcccaattttcggctgtcacctaaaatcatcaatgtctcccaggaagaaaatgactgg

SEQ ID NO: 123312 - DNA, 546 bp, Homo sapiens
ctggctggagggaggtggctggattttggcctacccagccccctccgagtgactatcctcctctggctggagctgggctgctttgcattgcaaatacccttgtcgaggaggctgctgccctctctgaaagaggctccgttgagtttggttttgtgttgttcgtccccatcctggcaggtccagctgcccagcttgttgctgaatgcaactgagttcccaggctgtcccttgccaattgggcccagctggggtcacatcatcctggcctgtctccgaagagccttggacttctacagatgggagtgtgactcttgactctgttactttctgggcctcctcttctggaaagtgagcctaatacaggtggagaagctgcagcagcgagaacttagggcaggctggatgctgtggcttactcctgtaatcccagcactttgggaggcctacgtggaagacttgcttgaggccaggagttcaagaccagcgtggacgacttagattcctgtctctatttttttttcttttttggggggacgcgatttaact

SEQ ID NO: 123313 - DNA, 363 bp, Homo sapiens
agaagaggcaaatcgatttgctgagatgtgtgaggaaaagatgaagaataatagcaaggaacatgtatcaagggcttgcagtgtaccagataccatgatccctgcattaataacttacctcttcaaacaccgctaagaaacgggtacgattatcattacttttttttttttttgagacggagtttcactcttgtcacccaagttggagtgtaatggcgcgatcttggctcactgcaacctctgcctcccgacttcaagcagttctcctgcctcagcctcccaagtagctgggattacgggcatgagctaccatgcctggctaattttgaatttttagtagacatggggtttcactatgttggt

SEQ ID NO: 123314 - DNA, 282 bp, Homo sapiens
actctgtctcaaaaaaaggaaaggagccagtcctaaggcatctttgaattctcatgccttggcacctgctaggtgctcagtaaaggctcagctcttcagtgaggccacacttgcccccaggccagaacccaaatcctcccaagacccacaacccttcccagcaggttcagcaagaagctaccaaccaaacccacttctccctccttttccgagtcaaaccccggttttcgcccctggctgaaaacaggaaactgaagaatgtggagtttcttgaaattcttg

SEQ ID NO: 123315 - DNA, 121 bp, Homo sapiens
atctagaggatcccgtgtgtacgacgtaagtactattattatgtccattttgtaatagaagaagcacagataaggtaaataactttaatgagaccacaaaacctaagttttttaattgata

SEQ ID NO: 123316 - DNA, 469 bp, Homo sapiens
ccatcttaaccatttctaagtgtatagttcagtagtggttagaatattcacattgttttgaaacatcttcagaactttttcatctttcaatactgaaactctacacattaaacaactcctctttttctctttccttattcattcctaacgaccagtctccttctgttcctatgaatttgactgctttggatacctcttatcaatgaaatcatacagtattttgtctctttgggactggctttttcacttaacatactgggctcaaggctcacccacatagtagcatgtgacagggttttcttcctctcacacaacatgtgtttttaaaagactgaataatattccattgtgtgtgtgtaccgcattttgtttattcattcttctgtcaatggaaactgggctgcttctacctcttggctatagtaaaaagtactgcagtgaacatgggtgtatagatacctttctttaa

SEQ ID NO: 123317 - DNA, 220 bp, Homo sapiens
ctgaagctaaggaatgagaaggatgggccagggggacttgagaggtagggtattcttagacccctggtaccgatgagttaagggaaccacagatgcttcctgtctaaccttcagtggtaactcttagctcatcgtctttttccctgggctggatctcttaggttagggccagtgaagaccctttaaatctgagtcaggagtaacatcgagagaaatgaac

SEQ ID NO: 123318 - DNA, 603 bp, Homo sapiens
actctctctctctctctctctcactcctctctctctcacacacatatgcgcgcgcacacacccacacgtcttatggaaatattaaatcaggaagaatttctgaagttctcataataaaaataactgtaatattaataaagtactccttatcagttatttctcgtcacattgtggccccaagggtttgcttgacttttcaaaatgtatttgcttcaggataaattgaagaagtaccactctctccctgtattaatacctttcagggcttttgatctgtaacctcttgtcacctctggtttatctggcttagcatatgaattttgaagaatgagggagcataaacaattatgactgccttttaaaaaatgcacgttaaacctgcggcctcaaacttgtcagttctgaactttaacagtagaaaagtgaaaactcagcgttgaaagtagagagtgtaagagattttgccagttggaccactttgctgcaaatacctattagacccaaacctttcttttgcctagtgatcagctatactaatagcaagatccacttaattccatgtgagtcaacagcttgcatggcatgcccactgtgtgcaaatag

SEQ ID NO: 123319 - DNA, 361 bp, Homo sapiens
gctctagagatcccagcgggaacatcacttgatctttactcttgtcacctctggtttatctggcttagcatatgaattttgaagaatgagggagcataaacaattatgactgccttttaaaaaatgcacgttaaacctgcggcctcaaacttgtcagttctgaactttaacagtagaaaagtgaaaactcagcgttgaaagtagagagtgtaagagattttgccagttggaccactttgctgcaaatacctattagacccaaacctttcttttgcctagtgatcagctatactaatagcaagatccacttaattccatgtgagtcaacagcttgcatggcatgcccactgtgtgcaaatag

SEQ ID NO: 123320 - DNA, 171 bp, Homo sapiens
ggtttgcttgcattggagtgccaggtggtgaccctgaagaggacggagggttgggacaagctaattgtggagacatgatggaaccctcccagttgaaggaagcttagaggaggaaaacttctcttccaggcatcttgagttctactccacattttgatttctcttgggatg

SEQ ID NO: 123321 - DNA, 285 bp, Homo sapiens
gagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatc

SEQ ID NO: 123322 - DNA, 443 bp, Homo sapiens
tctgcatgtaaatgccatggaatgcatccctgtccctgcacttggatccaaaatgggccctctgcggatgtggactggtaggactattgcacttggcattctgagatcttggttggattgttcttcataagaaacaccattgctattgtaattaaatagaacaaaaattaagtcatggatataaagaaggccctcaggttggacaaaatcattcctttgcctacattcctgagacccaccgaggggaccgccttgtgcccagtccagctgggaggaccagagcagcagggatggggtttgcgtgcatgctcagccccaccatcagctctgaccttttcctgaggcagctccaagggaaatttatcaggatgctgtggcttggaagggttacttatttgtggagggataactctaagaggtttaagtaaacttcctctctttta

SEQ ID NO: 123323 - DNA, 740 bp, Homo sapiens
tcagtgaaatttccatgtaggaaattttcagtcatacatgaagcatattttgtgattatggtaatcctagccttgtcagagttgcaagaggtgatgatactgtttttggaacattgtgcaggtcatttttcagtagatatttgcatatccgttatgtgcctggcatttacttcagtctttaggtccctgtgatttgccaaagaccactgttactttgattcttcacaccttcctcctttttacttatcttgaaagtaacaaatgtgagatgtgaaagtagttgataaccagaagggcgaaacctggggaatgtaggtttttatttttttgtttgttttattttgtattttgttaaggtggagggggaaggtaagtggatataaaaatcaactcagtttacaaagctcaagtaaatttatagtaatttggatacgtaataaaagaggtactttctctgtgggaatgatttttacagatcacctttgtaatttcttagaaatcatttttttcctgagtgttaccagtaatacttactattatagaaacctgaattaaagacatctacaaagaaaacatttcccataattatatgacccagaaacaaatactgttaacattgtggggattgtcttttgtggtttattttaaatgtacacatatatgattttttaagagaagtgggattatattatatccactgtgttatagattgtcatttttattcagcagtatgtataata

SEQ ID NO: 123324 - DNA, 505 bp, Homo sapiens
ggtttcactctgttggccaggctggtctcgagctcctgtcctcgtgatccacgcacgtcagcctcccaaagtgctgggattaccggtgtgagccactgtgcccagcctctcagtgatttttgatgcaaattcatttactgtgttcacgaagtggccaattttgggacctttagcatcacttgcccttttagtgtcttacatatgtatgattaccatcagcactagaaattccaggtacttcaagcttaaaagtaagagctctagagtgtattgtcttgtattatatattgttctgggtctaagccatgctagtaaatattagagttcctatgattattttcttctttattttatttttgagacggagtctcgctctgtcgccaggctggagtacagtggtgcgatctcagctcactgcaacctccgcctctcaggttcaggcgattctcctgcctcagcctccttattagctggcattacaggtgtgcaccaccatgcctggcta

SEQ ID NO: 123325 - DNA, 214 bp, Homo sapiens
attggggtggagtctggggagatagacaataaacataatcgataaaatatcttagtatcttagtatgtcagttggtgatccctgccatggaggaaaacagagaaggggaagagaaaggggtgatagtttttttgtttttttgagatagggtctcactttgtcacccaggctggattgcagtgatgtgattatacctcactacagcttcaaactc

SEQ ID NO: 123326 - DNA, 425 bp, Homo sapiens
tgccattgattggtggccatgtgtttgtgcccgatagactgtgaaatggtgtgttgctacacggctgtgttgcacctgcgccccaccgaggtgattgattggtttggtcatgtggaatgttcccatctggtctgcagtaatgtgtttttttttttttttcccatctgtgaatagcaagtgctggctgaatagttacagcaaacagtttcagaagctaaataatccttttcctctaagaacaaattgggatatgaaggagtttgtttttgcttaccttgccttttgtaaaggtagtcattctccatcaggttcctactccttctgtctaggatgttatgtgcttttctctttttacctatttttacctcctcttcataatagattacgctttctgtatttctaatttgtgcaagtttaaagcaaaa

SEQ ID NO: 123327 - DNA, 588 bp, Homo sapiens
ggacggggggcagtggacgggtgggagtgacaacgcgattgcttagagggtgaagacctgactatcctgccttcactaagcctcaaaacattcccggaagataagcatcattgtcccatcttgtagctgggacacactcaaaggatttaaaggctttgtaacggtgcagtgataggattcgaacccacgtctgtgtgaatctaagcccatgctcgttccactgcatcacactctctaccactagtgcctggcatcattgaattgctcacttcagatcctttgagaaatgaagatctccatttttccccacaaaagaaatagcttgggcctatgggatgatatttacatgaagctgttgtcgtcaacatcaaacaggattcctcatttattgtttcaatccgttttatcccactcaggcacacactctccataaaatgaatgccttgcattcatatggtatttttacttctttcatttaacatccctgataacataaacatctcccaaatcccccaaatccctctgtttcttgcattacagcagggttgggggtgtgagctgcagatgctatgcagacaccatccacat

SEQ ID NO: 123328 - DNA, 597 bp, Homo sapiens
aatttacctagttaacattcatgcatccttcccaccttacctttaatgccccttccccagggaagccttccctgatggccccatgctggtcttggtctgcctttacacacacccctgaagcacctctccccgactgcactttttcatagttgtactcttacattcaattgtatgattagcaccagagggcagacttctggatctccagcaaagtgcctggcatatagtaggtgctcaacacctgagtgaatggcttctgtgagagcaggaaggtgagtgaatggaaattttttccttaaggcttacaggggcagctccgacctagagacatccgttgcaacctttcattctcacacccttcccaaggccgtcacggtccatatctgcaccccagtctgtgcttatcacacaataccaggccctgaatacagctctttagaccagccgtactgtgaagctgacagccctttctgcacctgcagatgtaaccatacctgggcttctccagggatggtctaagcctaggctgagctcgccaggtgcagtgactcacaactgtaatccctgcactttgggaggccgaggtgggtggatcac

SEQ ID NO: 123329 - DNA, 426 bp, Homo sapiens
attcacgattctgcccagctcaaggtaaagatagcaacaaaatactccaaccagaataaaagaagtctccacttgactgcagctcttcgcaacacttcacaagggtcaagctgtgttagtttccttcagtgttaaacagaatgcatcttaagagaatagttcaattattgattgaatagtaggttcaagttgactataatcccaactaatacactctaagaccagggatgggccgacagaagggtaaagttttccactcaagtctcgaggcaaacactcagatagaagtagtaatatggatgccttctattatttggtcaatacaatactgttccagcccagttgtgcaaaactggtgaaataaaaggcaaaaatattgacaacagtttgggtaactggattccaaaatgggcatccatctaagag

SEQ ID NO: 123330 - DNA, 457 bp, Homo sapiens
tggccacaggaagtattatgccacagtggctaagggctctggttttggagttagacacacttttctacttagttgcttgggtgagttattcagactctctagagatcaatttgctcatttgcaaagtgtaaaatgggttataggaattaaatgaaatagcacacttagcatagtgtctggtacggaaggattcaacaaacactattaaaaacatgtcagaaacagtattttgggcttgcttgcaaaatggaattttggagtgaagttcgtgggtgaggcactaacagtgaggtcctgcgtgaggatggtggctggtcgagaggatgttaggaaggcagggatttaaaaggacttggggaaaaacaaccaagacctagtgagaggctggacaagtagaggagaaagaataaatcgaggatgacccaaagattttgacattgagataatagtggtccta

SEQ ID NO: 123331 - DNA, 412 bp, Homo sapiens
ggtctgacagtctcttcctcaaggacagtgcctttgtccaaccttatctccagcctgcagggcctggcacaggttctggcttaaatgctatactaacagtaattacattttcataaaatttattttatgaaaactaggtactctccaaggtcctttgtaccccatgagtctgagattactaaactaacagtttaaaagattctgggaaccaggtgaccggggttctggtcccaccagtatcctgtattgtggctttgggaaagtctgtttcccatctctagacctcagtttccacactttgaagaggaagtttgtgtggtctctaagatccatttctgcgctctgtaatctccataagccaaggggttcgaacctcccaggcttcacactgtgcagctggccagcaccattc

SEQ ID NO: 123332 - DNA, 428 bp, Homo sapiens
ccacttccacatccaatctgtaatcaagtcttgctcgttctgtctcctaaatatctcttggatctgttcacagtcttcagttcctaatgtcactattttagtctaggctatctccctctctccccaacattataatcaaccacctgctaaccagtcttcttgttaccagaatcaataaggacacaatattccatttgatgtgataggaatgaggtatcatcttaattctatcacaagtaaattttctctcattaccaacacaatatttatagaagttgttatattataaacttgtaaacaccacttggtgccactccaagcttttcccataatatagagaataatctttctaaaatgcaagtcctctcataatttcctattgcattaggataacacccagactccttaacatacctcataagaccctt

SEQ ID NO: 123333 - DNA, 518 bp, Homo sapiens
gatgctttagatactaagggctctaagcaaagaagtagacatatgcaaaaatacatgtgtaatgtaagcagagatgcagaaagaatcaaaaacaaatgctaaagatctaaaacactacaacagcaatgaagaatgactttgatagactctgtacgctggacacagctgaggaaaagaatctctgaacttgaggatatggataaattcctggaaatatacaaccctcctggattaattgaggaagaaatagaaactttgaacagaccaataacaatagcaagattgaaacactgatttaaaaattgccaataacaaaaaaaaagtccaggaccagatagattcatagctgaattctatcagacaatcaaagaagagttggtaccaatctttggaaactattccaaaagacagacaaagagggaatcctccctaaatcattctatgaagccaatatcacctgatatggtttggctacgtccccacccaaatctcatcttgaattcccatgtgttgcggga

SEQ ID NO: 123334 - DNA, 756 bp, Homo sapiens
agtcagtgtgtctagaggggtgcacagggagtggcacggcaaagggaattgcccctcaggagcagagggttatgtcagaggggaggcgcgaaccaggtcacatagcacattctaggatgtaatgagtgtggattctatgttgccatgggaagccagcatccttgcacgaggtggttaagtgctgagagaagataaatcagattaaggggctagagagagactggaagcctggggaagctatttgaaacaaacgggcagaggagctctctctgaggaagtgactttagggctgagtcttgaaatatctgaagtagcgaccatgcagatttctgggataagccagttccaggcagaaaaaatagcactgaagtgggaataagcatcacatatcctggaaagagcaagaaggtcagcgtggccagggcacaataccagaggaagcagggggaggaggccagccctgtggaggccgtgggacggtacttggcttttattctaaatacactgggaagattttcgaggactcttgcttgtttttcgagggaactggctgaaaacccagtagattttggtggctgttcttgactaagaagagtgtggaacaaagtcacagagccacggccccagacaagacctggatgaagcgctacagcctggtagtgccaagactgggagggaaacagaagagcactatgagacagaatccagaagcaaggagaggaaggaaaggccttggaccccctaaggagaaggagg

SEQ ID NO: 123335 - DNA, 435 bp, Homo sapiens
tgctgtaacttatggggagaattatgcttccctgtcccaatagcctctggtttggacatgacgtactccggctaatgaaatatgacagaaagtgacaagaattgttgtcaagggccactgtgtggttcctcacacttgtttctcttgctcaagatacactgttccaaatcaggagattaaaaaaaaaatttttttttttttagacagagcctcactctgtccccaaggctggagtgcagtggcacgatttgggttcactgcaaccggtgcctcccaggttcaagcgattctcctgcctcagcctcctaagtagctgggattacaggcagccaccaccacgcgtggctaatattggtatttttagtagagatgggtttcaccatgttggccaggctggtcttgaactcctgacctcaggtgatctgcctgcctcag

SEQ ID NO: 123336 - DNA, 113 bp, Homo sapiens
aaaagaatatcaattgagactgatcccaagatcatctagatgttagagaaagcagacaaggatgttaaataaatcgctataactagcctcaaggaattaagataaaatatgct

SEQ ID NO: 123337 - DNA, 465 bp, Homo sapiens
tagcatcctgagagaaatgacatccttaaaaagctggaggacacaggggatggtctctatcgtatctccatttaattcaccagtttgaccactgcaaaaaccacataaatcctgggggatgacactgaactactggaaactcaaacaagaaacaggtccactgtaacctccgtgcaagctggttttccttaacaaagtagactagcatggcctcaggtacacggacaatgatttagtcaaagtgctccttcccaaccctatcactaaagaggatcagaaacagttcactttgcgctggaacaatgtataaatttacaattatgccccagggctatcataagtcctgcctgctgttataagagtctgaataaatgtggaacacctgcaaagcaccacactagcctactctatcaggggcatcgtgctatcagactgaatgagcaacgaggagtagccaggacagtg

SEQ ID NO: 123338 - DNA, 327 bp, Homo sapiens
attctccacattaaatatttctctttgctcacttaaagttgtgagttctgtttacctaaagttattagttctctactagcttgaattttgtcagtacttgcctgacatatggttttcttttttttaattttcagtctttctatatcatttagtggtgatgtataccttttttttttttttttttttttaagatggagtctcgctctgtcgcccaggctggagtgcagtggcatgatctcggctcactgcaacctctgcctcccgggttcaagtgattcttctgcctcagcctcctgagtagctgggactacaggtgcacaccaccac

SEQ ID NO: 123339 - DNA, 335 bp, Homo sapiens
ggattaggaccaaataacatcagacaacagtaaactccattctttaccatgacttatgatattatgttaagggtttccatgtactttacagaaaagactaggaagaataactttgtgtgagtcttttaatcaagacaaattttttaaagcaaggattgtgcgaggctgttttattcaatatggtagtcatatgtggctattttaattgaataaaacaaaaaattcagtcccttagctgtgctagccacatttcatgtgcttagtagccaaatgtaactgattgcttctatacagcagcttctcaaacatttccatcactacagcaagttctattt

SEQ ID NO: 123340 - DNA, 186 bp, Homo sapiens
tgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttac

SEQ ID NO: 123341 - DNA, 387 bp, Homo sapiens
gtgcgtgggtaaatattttacagctaaaatcctccaccccgtgcctgaagaaagaaccaagataccgcacatgggacaatgatgatattggtctaatgatttggtatactgccactggggctgccttgtgctcccgggcaggatgatagatggctgctcgggacatcaggctggagcctgatctagagtccagaggcccatgtcattcctcatgcagatggctgaggcaccgactcaactttaccacataaacggttccagcaaacacttcctgtgcaccagggaggcataaggaaggaggtcccttgtgatcaagggaaaccgggacctctgcatgtgccaggatgttggcggttgctgatgggagagcaggattcctcaggcaga

SEQ ID NO: 123342 - DNA, 455 bp, Homo sapiens
ctggacagtcactggggtggaccaggaaatgggcacttagggtctggcatggagcagtgtgtcctgctgtgctgtacatgacagtgggtggctgttagcaagcaccacccatgagaccgtagcacccacaaactgcaatgttttagaatagcctggattacactgtggatgtttaaagcaaaggataaacaatgctccatctagtttagtttcactgcatctcctacttgaaaactgaatagactcggtggccatccagcccctcttgtcccgatatttcactccatggtgagtcacaagccctggtcagaccctaatggacacagccccaccttgaacagttcctctttcaggctgaaatcatctgctgggtatgaagactcagatgggataggaaagttaaaacttagaaataggcgtgctctgttcttttccaatgcttgtcattatgctca

SEQ ID NO: 123343 - DNA, 236 bp, Homo sapiens
ttaatcactgtgagattcaaattaatcacatgcaaagcattagttagaggctcttggacattttctgtttttagagctttgttggatgctcacatggcaatgtctgtgcagtcagttcctacccagcctctgggctcttcttgcagcttatcttgcagaaagaagcctcatcagaattccagaatctcagctatgattagcttactccacctcagctcagaaacatgcatgattcc

SEQ ID NO: 123344 - DNA, 470 bp, Homo sapiens
tttatttataaacagcatcaaaggggagaattaagcaggaaatataagaaaaacaagtaaagggaaaacaagtccagttggagctatgataacattatctgcaaggccaggcaggggccccaaagaaatggattccaagaatagggatgagaaaaacaagttcttatccgtctccccctggaattctctcccaatgccattattctttgttctgcgcttgtaactatttttgtaactatttctgcaagtttgcaaggattttataagttcctgttttcccatctgtgcaggatggcaaaggtcacaagacatgcctgaattgcaaaacctgtcacagttaactgcctttgttctgcttctgtaagcttgctttccccaccctgcaagttttgtgccactggctagccactccccttcagttgcctgaataaaagttaagcctggcctttgttcatttatcagcctctgaa

SEQ ID NO: 123345 - DNA, 360 bp, Homo sapiens
taaaataaagtatgcaattcagtagtttctgtcatattcacagagttgtgcaaccatcaccacattgtatcttaatacaatctggtttttgaaaagctcattttgtagtaggtgcttcttttaaaaagcatttacaaagcagttcttccacactgaagagtatccactaagagtaggagtctgaactctgcattttctttttgttcttggatgcttatatcactgcacttgatcttagcccaaaggccaagaagtaataaatgtttacattgctttattatcttaaatcatagtttctttgcaaaaatattttaagtcacttatctattttgtgagcatttgtttagtagataagggaat

SEQ ID NO: 123346 - DNA, 384 bp, Homo sapiens
catattcaggatgttttgttctatatttttaattttctattgaaataattttagacttaccaaaagttgcaaaaatttagtacacaggcttggtgtggtggctcatgcctgtaatctcaccattttgggagactgaggcaggcacattacttaagcccaggagttcaagaccagcctgggcaacatgatgaaactctgtctctacaaaaattagccaagcatggtggtgtgtccctgtagtcccaggtactagtgaggctgaggtgggaggttcgctcgtcagggaagtggacattgcagtgagccacgattgtttcagcgcatcctagcctgggcgacagagccacaccctaagtacatacatacatacctacacacacacac

SEQ ID NO: 123347 - DNA, 756 bp, Homo sapiens
gtccttgtctgttagggcctctttcttccatggggcgtggcaagggaatagcgacttagtgttctaaataataacatggtcatttccggagtacttgccatgtgccaggcatcattctaaacatgtatgttaactaatttaatcctcacaacagccctgtgaggtggcgatttcggtcagcatcatctcattacctccacatgcagggagggaaaatgaagtgtggagaatcgcagcaacctgcctaagggtcacatagctaacaagtggcagagcccaggaacctgcgcgaggcaccacccactctgcactgcctcccgtcacacagcaagatgggtctatctcccagaggcaccttgacttctgcactcataaaataggccacacagtagagattcagtacgcattgttgaatagctttcatctctagggcagttttctgtcttcaagacaaacagtggcctgagagctctgagaatttaggtatccagggatccaattgctttcttatttactgagagataggcatgtctctggtgagatcctgccaaacataaactcctccttattaataaatttaggaattgtctggaaccaccacgatggagactatcaacaatatgtacatcagttctctgagttgaaaggtgtgtgcacagcactgcccctgatgtctgtgactttcggtcagagacttaacctctctgatctttagatcttcactggtttaaaaagaaagagctgggtcagtattac

SEQ ID NO: 123348 - DNA, 157 bp, Homo sapiens
atgaatgctaaaagtgacctggaacattccctcaagggaagcggccagagcgtgaaggttgcagtgaaagaagggtgcaaggaatctccagcaggtggagctaaaggataggcgaattgtgccttagcaaagcttccagtgaaggacaggcaagaga

SEQ ID NO: 123349 - DNA, 165 bp, Homo sapiens
acatcttcagctggcccaggctttgtttccctaaaccgacctctgctctcagcccctctgcttgtctgggccctacccttcttcccttgcctgtgctggactgacccaggccccagcttctccctgctccccacctctggccaacatggagctctccaacctctc

SEQ ID NO: 123350 - DNA, 388 bp, Homo sapiens
tggaattccagctcggtttccgggtcttgcactgttgcccaggctggagtggagtgccacaatcatggctcactgcagctttgccttgacctccaggctcgatcctcccacctcagccttccgagtagctggaatcacaggcacatgtcactgtgcccagctatgttttagttttttgtagagatggggtcttgctatgttgctcaggctggtcttgaacttctcactccctccctgggctaaaatgatcctcccaccttggcttcccaaagtgctctgattcctggccaaaagacataaaatttaaaactgttatttcagactgtcggcagtgggcatctctggcagatgattttcttttttttttttttgagatggagtcttgcac

SEQ ID NO: 123351 - DNA, 681 bp, Homo sapiens
cgcggtggctcacgcctgtaatcccaacactttgggaggctgaggcgggtggatcacgaggtcaggagatcaagaacatcctggctaacacagtgaaaccctgtctctactaaaaatacaaaaaagtcgctgggcatggtggtgggtgccgggaatcccagctgctcgggaggctgaggcaggagaatggcatgaacctgggaggcggaggttgcagtgagccgagatcgtgccactgcactccagcctgagcgacagagcaagactccgtctcaaaaaaaaaaaattaaaaaaaaaaataacccatctgctgatttccgcttggtttttgagagccttactctgcttgtgcatatcctaagatttggtaatgcctaaagaggaaaatgcatacagaatctggggctaattctctgtagttccctctacccctttaggtcccagtcctattgacaggccagaatcttaactcttcttccattctgtctttccttgtctttctttccttttggttctttcattcttttttgaactctcttcaatacagttttcgcacttaccattccactaaaatgtcttttgtcaggctgggcacggtggctcacgcctgtaatcccagcactttgagaagccaaggtgggtggatcatgaggtcaggagatcaagaccatcctggctaac

SEQ ID NO: 123352 - DNA, 475 bp, Homo sapiens
aatgttcttaatggcatctagaatggtgaatcctttccagaaggttttcaatttactttgcccagatccattggaggaatcactatctatagtggttcctatagcagcaatagtctcacaaaatgtatttctttttttaaattttcatttctttacaaaatgaatttcttaataacactataagactatagcagcaatagccttacaaatgtatttcttaataagatctgaaagtcaaaattactctctgatccatgagctgcacaatagatgttgtgatagccggcatgaaaacaacattcatctccttgtacatgtccatcagagctcttcggtgtattgccaatgagcagcaaaatctttaaaagaatctttttgttctgagcagtaggtcttaacagtaggcttaagatagtcagtaaaccatgctgtaaaccgatgtaccgtcatacaggctttgttgttccattaagac

SEQ ID NO: 123353 - DNA, 505 bp, Homo sapiens
aaggttgggggagggaggaggaattgttggttccaaggctcttgcatcagagaataccactggcatcgagtgcccactactcccacttttgcaacactgctgagatttggtctccagaaaaccttgctttgtctcatgtcaagtagcccttctctccaagctacttgatattgtcaggttagagtcttagttttttctgtgaaatgggcataagttaagcatgtaattggttaccctgatgtagagaagtattaatagaagagtgtggtagtttagatctctctgggctcaaatcccagctgtgtaaccttgaacaagtcatgtaatctctctgtatctcagttttctcatgtattaaatggcagtgagtacctgcttcttagggttcttactgaggtaaaataagttactaagtataaagagcttaagaagccacctggcacattgcaagcacttactcatgttaactgccattgatagtagcagtaatattagtgtgtgcatc

SEQ ID NO: 123354 - DNA, 493 bp, Homo sapiens
aggatccccggtttgggagtacggaatatagtatgtctcggcgtcatcgccccgcctgatgccagctgaggcttcactgagacagacagtgttttggaaaagaccagttttggctgggggtgggttttcatagagttaagagcccagactttgaagccaaacagcctggttctgatcccagcccagctagtcatctgctgtgtgaactggggcaagtgacttaacctctctgagcatcagtgtccccatcagtcaagtgggctgatggatgccttcctggctgtggttactgtgcccccaggatggcgtcccctcatctctgctctgggaactttctggcttccacctgtcctcagaatggccctgtgatggggtcagtagtcacagtatgtgcattcagatacctgtgccgctagggggtctccgttgaatttcctgcctctctgagcctcctctctctgattccttacttcccctctctgattccctgcct

SEQ ID NO: 123355 - DNA, 275 bp, Homo sapiens
aaagaaggctatgtgggcccggaccagggatgggaggcagtggaggccccgtcctgcccttttcggtcttcctaacactctctcccaggtctccacttaggtcatggagccatgcacagatggtagaagggggaaactggggcttggaaagacccagaaaaagaatgtgacctgcccaaggccaccaacaactcgagggggcattgaccgacaagcccaagggctgtagaccaaggcagaatgaaacttggagtcccagaaatttaggagtgaag

SEQ ID NO: 123356 - DNA, 398 bp, Homo sapiens
agacattgggccatacccacgtgggcatgtcacccatggcgagcacccgtggtccccaggtcagctgcccttccccggtgtggaaccccacccacagttatggcttctcccagagaaagtgagctggagaggaaagctctgaactatgtccctgggaagaaacactgttcttaaaaagattttttttattattattacgttgtttggtttacatcattgctgtttttccagtcaacctaggcttgcctgatttgaagaatttcaagaagtctaagagtggatcataggctaccttcattttaagttgtgatcaaatcatccttccaacagtgttaccagcctgacaactacctgcagtgcatgggagtgtcccttaccctacattctcagcaatatta

SEQ ID NO: 123357 - DNA, 330 bp, Homo sapiens
caaagtaagattaacttcccactagttactctgtcccaaggcttcacaggaaaggggataaaggaggaaaaccaccttccccctttggccagtcagaaggaaggaagatatcaaaatataggctaacctacctcagctttcttagggatacaagttcaataaaacaatttttcttctactacagtcatgatgaccacaaccagtcacagagattaagaatctttgtttcttaggctgggtgtggtggctcatgcctgtaattccagcactttgggaggccgaggcaggcggatcacttgaggtccggagtttgagatcagcctggccaac

SEQ ID NO: 123358 - DNA, 717 bp, Homo sapiens
tacagtggctcacacctataatcccagagctttggaggccaaggcaggaggattgcttgaggtcagatgtttgagactagcctgggcaacatagggagacctcgtctctacaaaatccaaaaaaattagcctggagcgatggcacacctgtagtcccagctacttgggaggctgaggcaggaggatcacttgaactcaggagtttgagattacagtgagctatgattacatcactgcactccagcttgagcaacagagtgagacactatctcccaaaaaagtaaaaataaaaagtgctggagtccatatcgaagcccacagccaattgtgacatgtgaatcttttatttttataatctgcctctcttgtctaagtgccaaatgatgctcacattgtgtgtaactacttccacctttgtctggcttctttttccttaagtatgcagaatcaggttgcatagagttctgagaaaataaaataaatccgctgtgtgctgtggctcatgtctataacctcagcactttgggaggctgacacaaggattgcttgagaccaggagtttgaggtcagcctcggccacataacgagatcctgtctctataataaataaataaataaataaataaataataataataaataaacatagcggactggtggccagtgtgtccagtatcagggggagctgagattgtgagctggggtggatggggggcg

SEQ ID NO: 123359 - DNA, 190 bp, Homo sapiens
tataatccatgaggccagtcgtattattctcattttaaagatcaagaaaataaggctcagatacattgtatgagttgcccaagattttacacatagtaagtggcaatcctgcaatttgaacccaggtctgtatgatgatgccacagccagggtttgaactagagttcagtaggaagaaactaatgttttt

SEQ ID NO: 123360 - DNA, 613 bp, Homo sapiens
tactgagcctaggtactacagaaatgagatgggtggaacatacttaactatctaacctgggcaaacatctcatctatgaatcgtatccattgggttactgattccacaaatctggctcattttaatgatgagtctcagataattttgtagtttgaaacacagattactccagaatcacagtcctttatggcccaagtgctatatctgatggaatagttatctctgaatggaggttggtgtttatagaacattctgtatatggtaaaaggaatttaaggagatttaaaagaaagaatgttctgtataaactgtaagtggaaatgtttgtatttcccttggtaagcaaattgggctgtgtatattctttgtttgtgatctaatccagcaaggccaattaccagaatagagctttagggcatagcatgactaatcagcttaattaggcctgcttttctaaacaccaggcttccaggggtggccactatggactcctgcaaaagagtctttaatacatttccagactacccaagggtacattttacctttgttttttttttttcaagatagtttgataagactccaaaatgtgatgatgtaactatttcccagtgaa

SEQ ID NO: 123361 - DNA, 492 bp, Homo sapiens
gatctcagcttactgcaacctctgcctcccaggtccaagcgattctcctgtcttagcctccccagtagctgggatcacaggcatgtgccaccatgcccggccaattttatgttcttagcagaaacagggtttctccacgttggtcaggctggtctcgaactccccacctcaggtgatctgcccgccttggtctcccaaagtgctgggattacaggtgtgagccactgcacccagccgctccctcccttttatccatgtttgccatcatatgatgccttaaacactaaaaacaccatcccatcttacggtcttagcatccattcctctgcctggaatgttctttctctagacagacaaattccttcaacccttctttatccttcctcatcacatgagagacagcccctctatctactctagctaacatcacattctctccatctctgccctttgcctgctttgcttttgcttcttagaatttttcacaactgg

SEQ ID NO: 123362 - DNA, 653 bp, Homo sapiens
tgcaagcaaggcacttatactttagtattatatacatatacagagagaacaacagcaagaaaaattctacttaactgaggcttcattgtatttgggcttctctcttttcaatcacaggcatcaaatctttctggtaagcatgaagagttattatcaaacagttgtgttagtgttttccaaggtgtgattgaaaatggagatttcttacctcatcccagtcctgctaaaccaaaatctcttagggaaggatgggccccccagcattcacagtttaagcagcattacaggagattattatttacatcaaaatttaagaatcattggcttaaacacaaagaaaaaaatgtaattttattcttccagaattggcaaatgcacagccttaaccagtcaacaaagatcttcacctgtgggctgtttactacagctgggtggagcaggcaatgacccaaacctgcatgagtctcccaatatgaattgattttcctttgaagaatatcaattactggcaatcagctagtgagaatccagttctgctctcatcttgatttcatccctcatctcttctagagaactgagggaaaataaatgcaccaagaactaacatgggattttggaaagacagtaatgccctcaacagatgatttcaaaac

SEQ ID NO: 123363 - DNA, 484 bp, Homo sapiens
agcaacacaaatgggaagtaatattcttatcatcattttacaaatgagaagaccaaggcccagaagagttgaatatcttgctcaagatcacacacctttttccaccccccattccaagtcccataggcaactcagactcagcacatccatgatgtaacttatcatctttctctccaaaccatttcctcacttgtgccctactctcagtggggacatctctaatccccaggcccaagctggaaactggaagccatttctgactcctccctctccctcacccactccatccaaatggaacccaagtcctgtacattgtacttctcgggtattgatcaatcccggccctcgtctccacgcccatggtgctgacccattgttaggtgcctggctgctgctcctgggtcatcacttcccagcactctctttgcaggcccatctccaccatttccagcatcctacacactgtggctcaggtgtgctttct

SEQ ID NO: 123364 - DNA, 371 bp, Homo sapiens
cacagacataacccagacaagtccagctttggggagaaagcagagtagagaagggtggaggatggagctccactcctagccagcatcaggccatggtctcctttattctagaacaactccttcacttctgtgagtctctcatggctgttgacagttttgaaatattcatgtgagttgttttggatttttggaattaaactccccacttgatgtgtgtgcggcttttttttgtttgtttgtttcattttattttgtttagagacagagtctcactctattgcctcggctggagtgcagtggcacaatcatagctctgcagccttgaactcctggacttaagcgatcctcctgcctcagactcacaagtagct

SEQ ID NO: 123365 - DNA, 341 bp, Homo sapiens
cagggatttaagttagaggttacaaagaactttctgtccatgaagaggacagaaatacagaataccaggactgcagtctttctagtccttctgtttggagtttggagacgcaaagatgctcttctgcctgtgaagttcaagggccaggtgcatggacaggatgacaagatgacccgtggccttaggacagcctcacagttcacatggcagtagtagtgaggaaagtgccagcaaaatagcatggttgggtgggtaggttgagtggctataagtgccagatactggcttggggacaggtcttccatgcactgtctaccttgaacaataaagacagaccaggt

SEQ ID NO: 123366 - DNA, 476 bp, Homo sapiens
gaattcaggggtctgtgaacttggatgggaaataagattttctttattttcactgaccccaagttgaaatttagcatttctgttcattatggccataggcagtaaaccacagtaattcatttacctgtgatttcattgccaatagaaagcacagatattttcgtattatattatttgttgttgcagacatctcaagagtgtttgtgctcatcatgtcttcagcattacagtagatattagaccaactgctaaatcttgttatataaatcttgtgcattcatatttaaaattatttgatactgtgcgcttcgatataatttcttttgaaatcttatgttttttattttatacttttacaaatattattctgagaagggatctgatccgtaggcttcactagactgccaaagaggatcaaatacaaaaaaaaaaaggaagaacacctgtcttgtctagaatcttttcatcctaaatca

SEQ ID NO: 123367 - DNA, 407 bp, Homo sapiens
tgatctccctacatatagcgagggatgactgtaatgcatttctatgttacaaaatttgcacactttatttagatttgcaaaggacattaaggctcataaatacagttcacctataacctttatcatccacgactttataaatacagcaaaaaaattgatgttactgctgggagaaggatgcgtagaaaacaataaaatgatctgctataatcacttggctaatcagcctctgagctctagccattcaaattaatgggtcagcaaaattacaagtaaatatcatgtcctgtatcttcagaatcgcttaaaaatagtccaaaccattattattaaattagaaaaggtcaagggtctactataatgcctatatttctactttccctcaacttctttgccccaaaaagggg

SEQ ID NO: 123368 - DNA, 271 bp, Homo sapiens
agaaattagataaaatgttagtgaatactactgtaattttgccttcccccaagaaagagtataatggaaaaattgttagtaccacttgtatcaatcatgtaacatttctaaaacagtttcttcattagtgaaagaggaataataccttgcaagtttatttgttcaggattttttaaattgtgtataaaatgtacagtatgctgacatatataatggatactaaataaacgatggctattatatatatatatatatatatatatatatatat

SEQ ID NO: 123369 - DNA, 473 bp, Homo sapiens
ggtggctcatgcctataatcccgtcactttgggaggcctaggcgggtgaatcacctgaggtcaggagttcgagactagcttggccaacatggtgaaacccatctctactaaaaatacaaaaattagctgggcatggtggcaggcgcctgtagtcccagctacttgggaggctgaggcaggagaagtgcttgaacctgggaggtggtggaggttgcagtgagccaagattgcgccattgcactccagcctgggcgacagagggagactctgtctcaaaaaacaaaaacaaaaaaaaagagcttgaggctagtgatatcattcctgttgtttctgtagcaatggaggtgtcttcagcctacttcctagatgatgaaattgaggaacagacccaggatggaggattcttgtttctgttcctcttctaccacctactacactgtgctggtcttattcatagttttggttggggacag

SEQ ID NO: 123370 - DNA, 313 bp, Homo sapiens
cccttccgttttcccttcccttctgccttcccttctttctctctgccttgccttgccctgccctgccctgccctcccttgccttcccttcccttcctttcctttcttctctttctctttcttttgtttcttctctttctctctttctctttctttgacagggtcttgctcggttgcccaggctgaagggcagtggtggaaacatggctaactggagcctcaacctcccaggcccaagtgatccccccgcctcagcctcccaagtggctgggacaaaggtgcactaccatgcttggctaatttttgtatttttt

SEQ ID NO: 123371 - DNA, 530 bp, Homo sapiens
acaggaggtttcagggccagaaaagcagatataccagctctttggtaaacaaagtagttttactatctgcgtaattctaaccagaaggcatgggtgggaggaggtcaaccaaaacagtaatgagtgaactttcctcctccagagatcacagcaggagtccaaaaaacaccaccactcaggactgggcaacagagagtaacctagagataagtgactaacatggacaccttccataacgatggggtgttatccttggactcttgcttgagaagaggaggaatgagggaaaccaagatttccatgaagtctcagaagagaaaagacccaagttctttcccactaaatagtagagatggcaagagctgggtttcagaggacaaaattgggatatgaaagtcagagaggcaatctccctttattaaaataagactgctctatgcacatcatagaagatgtgtctatatggatttacttaacaatgcaaccaaatttcatgtttctgaatataggatgagcttttaccacttgta

SEQ ID NO: 123372 - DNA, 747 bp, Homo sapiens
cttgtaaatgttatctaatgagttactaaaaattatacatatagcccatatgctgatttcaaaaatcattttaaaaaaatcacagacagcttgtttgcccagaatgcagttgatttttgatcattgttgtcataagacatggatgtatgtaatcatctgaaatttacccaaatatcattgagcttttagttttgactttccagcaactggtgcacctggagaaacttgtgctgtctgctgtctttagatagaaatttgctggaagtatgaaagagcaattgaaataattatttttactttcttgatctcctcttgttgcctgctaatcagggaaataaagaaaaaagtgaacagacaaataaagaagcaaaggtcctccccagtcagctctgaagatacctatgctctgtgctccccgttgatctagcgaggccttcaaaaatgatttagcccactaggagttctccagttcttaggataagcatttatgcccaaattgccattatagtgattttctgtgctctctagtctgtggcattgtatttttatcatccaagcaagtgattagtggaatctattcatgctttatctgtggcaaactcaaatttacattctttcccagcttgagggctgtatagttggatggagtgtagagctacttataaagggcctgcaagaagaagtgatggaggttggttggctaatgggtagttttattcaatataatttattttgaaaaatcagcta

SEQ ID NO: 123373 - DNA, 392 bp, Homo sapiens
ctgacatgagagatgtggaaaaaatgaagtgcattcccaaaacaacacttctgctagcagcagtctcttgttttaaatcagttatcttaaactgacttaacttgctttgaggtattcttgagatacttctttttatataaaacttttgttgttttaaatcaatgtgtgtctaaaccatggaagcattcaagtagaacacacacactgtacaggtgcacataggtatcttcaaacaggaacaactgtagtctgataatcacattcccctataaatactgtttaaaaattttacaatgcaagatcatgtctatttggatgggaatcaaatataaaatatctttagtaatctcaaatagtcatagggctctcccccaatccagtaagcatttact

SEQ ID NO: 123374 - DNA, 377 bp, Homo sapiens
agatgacacagcagtgactcctgctgtgctgacgggggatccctgtcctggccccctatgctctatctgcctcttctgcctgctttgcttctagggcaaagcctggttggtcttggtctggctgggcttctgagtttctcctgggagtgaaactttgacatctaagccaaagggacatgacctggctaggatgagggccagcatagccctaggagtattgcccaccacctgtcacacccctctgaatctgagcactctctccaagagggagtgactcagagagggccaggctgccttccatgtagagcagtacctgccccaggaaccgctgggcccattccacacagaggcaggacatgcaccttcataaatgacca

SEQ ID NO: 123375 - DNA, 490 bp, Homo sapiens
tttccccaatcttccacaaggagagcagagtgttttccagattcaatcaaggatctatggtgcttaaatgaagattctaagagcaggtgttatggtccttgccctctgtcacactgctgcggatgctctgagagacatacacacatctgatgtacttgtgtctctcccaatttcgagaactgttctttgcacacagtcagtaaaaaacatctggtggatacaatcactccacagatacttattgaatgtctgctatatgccaggcattgttccagatgctgggaatagagcaggaaacaaaattgacagaatctttgcactcctagcttttagatgtgcaaaataatgttagcaggagataagtgctacagggaaaagcaacgcaggaaaaggagccaggaagtatggaggctgctgccatttcaacaacagttgatcctggaaggttcactgggagcctgacgtatgataaggtcctgaaggtgaggga

SEQ ID NO: 123376 - DNA, 377 bp, Homo sapiens
caaacaaccgaaatgctcatcagcaaaagaatggataaacgaactgaggtatagccgtacaaggaaatactatccagaaatagaaaagaatgaactaatgtccagaataggcaaatgaatagagacaaagtatactaataattgcctatggctggggtaagggaaggagacagaatgaggagtggctattctaaaatttgatcatgtaacgggtgtacaactctgtgaatacagtaaaaatgtaattgaattgtacaacgctttaaatgggtgaaatatatgctatatgaatatttcagtaaatccgctaaaaaaggaatgaactgttaataaatagagcaccacatacaaacattaggtttaagcaaaagtctgac

SEQ ID NO: 123377 - DNA, 284 bp, Homo sapiens
attcgcctggcaaaattcttctcgattttcagtttattttactaccacagaaaagtctgaatgactcagtgaataaataaattgctgactaaagaggtactgaggaagagaactgtttcctgttctactcacaacctgcttgcattgccgagtcaggcatttccccttttgacttccacaaaggtccctgcttcctgcctgtacacctttggtgagctctgcaactctggagtggacagacctccggggggagccaagtggccaaggtgtcctgaatcctctga

SEQ ID NO: 123378 - DNA, 521 bp, Homo sapiens
caggtgattcttcacctctctctaatatgcagaacacagtctgccaaactccctaaatcagttgacatttcttttgatcacctgattaccttccatgtgtgtaagaaagtctaattagtgtttatgaaaatgttttgtgatcttcaagtgctgatgttacaaatgttaattattttcagcaaatgcagaaacattgtgtcttctctcccagaaacaccgtaggaaaagggagagtggaggaattgactaaaacttttactgtaattaaaacagggtttttttgtttgtttgtttgtttttttagacagagtctcagtctgtcacccaggctggagtgcagtggtgcgatctcggctcactgcaagctctgcctcccgggttcatgccattctcctgcttcagcctcctgagtatttgggactacaggcaccgccaccatgccaggccaattttttaatatttttagtggagacggggtttcagcgtgttagccaggatggtctcgatctcttgacctcatg

SEQ ID NO: 123379 - DNA, 427 bp, Homo sapiens
ctgaaggctgagacgggaggatggattgagaccaggggtaatttgaagctgcagtgaactatgattgtgacagtgcactccagcctggactgcagagcaggaccctgtctcttgtacatacacacacacacacacacacacacacacacacacacatacatacccaggttctacctctggtgattctgactcagtagggtggggtatcccctagggatcctgctgtccagcctggtctgggatccacttttcattgggaactgagacactggctgtgagcctttctgtcctgagatgtagaggtcatggcgatgcaggttcaagcttaaggagacctgactgtgcgttaggtattgtgctgaacatcatctcttactctcacagcaacatccttagaaggttaatgatgtatccgtgctctacagat

SEQ ID NO: 123380 - DNA, 814 bp, Homo sapiens
ggcttaaacatcatcaactgggaatggaagaaactggagccaatctatggagaagccaatgcctatggacaagactttgagaagagaattttctagcagagacatcattgaggaactgaatggagcaatttgttagagaggcctgtgtttattatagacagtacccagcatcctttacagcagtgattcctgttaaaatgcaaggagaatatacatgtctcttagacacttgtcttacttttctcccctcgtttcccactgccattagcctaattcagtgcctaatctgctcacctctaaaccagtcccctccctgtggttccttagggtctcaacctaatgttatgcaggttgcatacagcacaaggatgtctgagtgatgggcaagtggggctgaaatctaacatattctcccggccaacccatgggtgcttatgtaggcctgttgcttcctggataatttttctcacaggggcgtggcaagctcatggagccttgaccctgcatggctaggttcactcagaggggttgctttcactattggcacagtgatgttgaagtggctagtagcagccctgagtcccatggcaacaatgaactagacacagtctctgccctcaagattgacaggttagtagagatggataatttcagagacaactatcttcaaagcaaatactttaaagaacgattgctatcatatcaatcttctttcaaaatgctccaaaggctctctattgccttccttaggctggaattcagaactttgtgtaatctctccaagctaatctggcatcctctactttgacccctg

SEQ ID NO: 123381 - DNA, 439 bp, Homo sapiens
tgtggtagctcatgcttgtaatcccagcactttggtttgggacgccgaggcaggcagatcacctgaggtcaggagtttgagaccagcctgaccaacatggtgaaaccgtgtctctaataaaaatacaaaaattagctaggcatggtgttgggtgcctgtagtctcagctacttaagaggctgagacagcagaattgcttcaaccagaaggtggaggttgcagtgagctgagatcgtgcctctgcactctaccctgggtgacagagctagactccgtttcaaaaaaaaagaaaaaaaaaagataaatgagtttctccttttcttacaaagatcttagtgacactatcaggagtaagagttgtggaaaactaaaccaaagtttggctgggtatgcgataaggcagatttaaaagttctaaggaaataagttctcaaaggga

SEQ ID NO: 123382 - DNA, 351 bp, Homo sapiens
cccttttgaattctactgcccacagaatgaggattaaactcctttgaataacatacatggccctttacagtctgccccaactggtttttttcttattttccaatttccttctacttgctaccgtacaaagtttgccccagttaccgagaaccactcgatgtgcctaaaataccccctgctcttccatctctgtacctctgctcatgctgttccatttttcttgaatgctttcctactatttctctcttcccgctctgtcccctaccctaaaccacctcccaacctgaaaaactcaagtatttttcagggaccagctcaagtgtcatttcttacacagagtttctctatttc

SEQ ID NO: 123383 - DNA, 425 bp, Homo sapiens
atgcttttcataatggctatctaaaaatccattaagctaaggctaaagcctagccagaatcacttcccttcttttggcactaacaccctgacacatctttcggaaacaccacctacctcattttcagtctacctggttaaggaatggtttacctctcttccggctccagggaggcccacatgatgtaagcctggccaataagagcatacccttgcccctgtgattcacaaaggaactgacctagaaaagagtgagggccctgcccttcctgggaatgaggtaagtgagcctcttcttctttctgaaatcaggagcattcaagcttgtaaatctggaggtgctggagccattcttgctaccacatacagactccatttgagaacaagcaatgcagaggaagtaaaactgaaaggttgtgaagtaag

SEQ ID NO: 123384 - DNA, 503 bp, Homo sapiens
ttgaaataacctagattctaatcatcaccagtagaatagacaaataaattgtgctatgttaatacaatggaaaactacatggtgctaaatatgaatggatgattgccacatgcagcaatataggggttgatcttgcagtgaaagaagctagacactaagaaatgcacacaatataattccatttatagaaatttcaaaaaccagcaaacctaatccgtggtgttagaagtcagaatagtgcttacctttggggtaatgatggtggtatgaagggggcttctggtacaatagaatgttgcttttttaaaaaagaatatgggttgtgaatatgctggttcatgatgtaatagtttattaagttgtacacttatggtttgtcaactttttgtttgttctacatcaataaaaaaagttaaaaataaaaatgctcaacaagatacattgtaatgaaatgaaagaacaatgaagacaaagagagaaatctgaagatccagatttaaagg

SEQ ID NO: 123385 - DNA, 805 bp, Homo sapiens
gtggcacttaaaccatgacctgttcctttcctcctccccgcagcttactttgaaggaagctctctattacaggtaggtgtggctaagaaggtggggctcccttgcccctcatctcccaatcaagggatatggcatcttacccagaagagcaggctgccaacatttcttattccctccgactctgagatgcagaagttaagttcctggtgaggtcagccaagaagtcagagactactgttctctgcccactccccccaactcaaatgtggcagttctaccacaggtgaagctaactgagaacacttgggccctcatcattcttgctcaagaatgatggggtggagggtccacactgggagaggcaagctgagaagactggagagtgtcatatctgcctcagtctctggagcagtggcttggaggtttttctcagtgggagagcagtccataaatacatagagctctgaagctctgaagctctccttaggggaactgtctttgaaacagagtgagggaagttcaaggctaagggtactttcttccataatgaagattttggtggtaattaagaggagactaataactccatgagagcaaaaacttacaccagaggcaagcaagtttactagagagaaccatggaaacagatagctaagaactctcctgggttcacaaaaaacctaaaggactagcctcaaaaacttcccctacccatgtacaattcagtggcatctataacattcacagtattgtgcaatcatcaccactatctctttccaaaacactgtcatcatcccaagaagaa

SEQ ID NO: 123386 - DNA, 229 bp, Homo sapiens
actaacagcactagacagatcattgaggtagaaacttaacaaagaaacattggccttaaattggacttcagaacaaattgacttaatagacatttataaaacattctacctaataaatagagaatatgcattattttcacaatcgcatggaatattctctaagatagaccaaatattaggccaaaaataagtattaacagattgtaaaaaatcaaaatcatatcaagta

SEQ ID NO: 123387 - DNA, 302 bp, Homo sapiens
ttgagttcgttggtgaagtagtgtttcctcagatccagaaccatctatgtccacctatcttcctatgcccactgccaggaatatagtaagtattcataagcacttgctgcaaaatggcaatgacatacaacttttgcttacttactggaacccaatctttaacaaaagctagaaagcccagagtttggcatacataagagaattttggccacaactatccatctaatccacttccattctgtgtgttaagtctatatatttagttgatgcaaaaaaaaaattcagttgaaattctttttttt

SEQ ID NO: 123388 - DNA, 365 bp, Homo sapiens
tcagatttataattaatgactgggaaggctcgattagggtaatgtttttaactttaaaaaataacttttaaagaccaacttgggagtggctcctaacataattctttcactgaatgcccttttctgacacttggagtcttaaataagtcttcttggatttcgctatctatgacttctgtgccactctgtgttctcagtggttgacttcccctttgagaagtgagaattagaaatgggcatctcctcaggctaggcgcggtggctcacgcctgtaatcccagcactttgggaggccgaggtgggcggatcatgagatcaggagttcgagaccatcctggccaacatggtgaaaccccatctctact

SEQ ID NO: 123389 - DNA, 508 bp, Homo sapiens
atctatcatctacatctatcatccatgtatcttatctatcatctatctaatctatcaaactatcatctatttatctgtctatataatcagtctatcatctctatctatccatccatatatagagagagagagagagagaagagagtgtctcgtctctgtcaccacaggctggagggcagtggcgcgatctcggctcactgcagcctccgcctcctgtgttcaagcaattctcctgcctcagcttccttagtggctaggattacaggcgtgcgccaccacacccagctaatttttttttttttttttttttttaagaagagatggggttccaccttgtgggccaggtgggcctagaattcttgacccaggggtctatccatctcagcctcccaaggggcggggatttaaagggatgagccaccggacccaggctaaagacaatttttcaccttggctttaataatggaaattggatggtatattcaagtaaatacacttataaggtata

SEQ ID NO: 123390 - DNA, 375 bp, Homo sapiens
gttcagagatatgtttgacattcctttagtcttaactgcatctgttattcatgcttttctagataactgtataatattttcttttactactaatgaaatgtgattctctcatgtccagtgatgtgttttctgaaatgatataaacaaaaagtggttaatatgattttattaactgtgttgggactcagaaaatatcccaaaatgaaggcctcagaagaagccttagaagcaaggctttctctgaccttctcctgccctcctgtctcagtcgcattctcccccgaatctacccatagaaactagaatttgtcttccccaaggcagatcatagaaaccagaacccctttccccatagccagccataaaacctaaaag

SEQ ID NO: 123391 - DNA, 148 bp, Homo sapiens
aagaatggtgttgttccagatattgatgattctcccctaactcttacaaagagttatgaaccagtatttaataagcacttaaaacattcatactcaataggtgtttaaaacatggagaaaagaatgcttttccagtaataagctggaa

SEQ ID NO: 123392 - DNA, 536 bp, Homo sapiens
aagaagaggggttggttttgctgtctcaggtggcagaggagcaagacagtctgcgtataattggaccagcacagtttaaatctctgctgttcaaggttcagttgtattctttaaaagccaaaatgaccctcaggactaatgtgtctgagagagattttgttaggtttacctcccctgttcattcagatatttttcagcagatattgtagactcggattctttcattgacttttggttttataacaaaaaaagtattgtttttattttttcactgaggtttggaaatgcattagcatttcattctgcttgagtgaatgatagcagtcttatttcatacagtgtctttcagtctgtgttattgttagtttccatagctaaataataaagttatgttttggggttggcgaaaatgagaccagttttgttaagggtatcctaatgaatttgtcaacttagcaagggactgaataggcagatttgtaaaccacccatgagatgtcagtgtggagcctaccttaagatacagcaagtcaaca

SEQ ID NO: 123393 - DNA, 396 bp, Homo sapiens
gcggccgcctactactactagcctactactactaaattcgcggccgcgtcgaccgcggccgcgtcgacatttatttcctagggctgctttaacaagctaccaaaaactgggtggtttaaaacaacagaaattgatttggtcaaaattctggaggccagaagtctgaaatccaagtgtcagccaggttggttcctcctggagggtctaagggagcatctatttcatgcctctctcctagcttttggcatttgccggcaatctttggcattctttggcttgtaggcttgtcactacaatctctccctccatcatcacatcacattctctatgggtgggtctctttgcatccaagtgtccctcttacaaggaaactagtcattgaattaagggtccacc

SEQ ID NO: 123394 - DNA, 513 bp, Homo sapiens
taaattcccatgccctttaccttacctgtgaagttgctaatctgatactaattgttcattctcctgctgttctgctcagtgtcccttcccgtgtgttgatacaataactagggtttataatcatcctctgagaagataaatgttgggcacatagaaggaaaatagatggagtggtggtggtatgcatttatttcctagggctgctttaacaagctaccaaaaactgggtggtttaaaacaacagaaattgatttggtcaaaattctggaggccagaagtctgaaatccaagtgtcagccaggttggttcctcctggagggtctaagggagcatctatttcatgcctctctcctagcttttggcatttgccggcaatctttggcattctttggcttgtaggcttgtcactacaatctctccctccatcatcacatcacattctctatgggtgggtctctttgcatccaagtgtccctcttacaaggaaactagtcattgaattaagggtccacc

SEQ ID NO: 123395 - DNA, 5071 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123396 - DNA, 2513 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaa

SEQ ID NO: 123397 - DNA, 628 bp, Homo sapiens
ccccccccccccccgcgggggggtttttgggtttttttaaaaaaattgggggccccctttttttaaccacttctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123398 - DNA, 5102 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctcctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123399 - DNA, 5216 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaactctgtctccaggcccagaatttctcccccacagagtccacaaaggagagagcagtgatgcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123400 - DNA, 3409 bp, Homo sapiens
acccacgcgtcgcccacgcgtccgggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123401 - DNA, 1699 bp, Homo sapiens
  misc_feature (18)..(18): n is a, c, g, or t
  misc_feature (20)..(20): n is a, c, g, or t
atatcatatatatgtgananatatatatatatcacatatatatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123402 - DNA, 1071 bp, Homo sapiens
tcggataatgcctattcattgcgatatgtgtttcctgatttgaaacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaaaaaaaaaaaa

SEQ ID NO: 123403 - DNA, 4544 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattattaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgtagccgcgatccgtatctctggcgtaccgagcgt

SEQ ID NO: 123404 - DNA, 438 bp, Homo sapiens
cagaaccagaattggtttccagagcctcatccaaaaggagtgggtcatgggtggccactgtttcttggatcgctgcaaccatctccgccagaacgacaaagaggaggttgagttccctcactgcagaactgtttccgtcataggagaactactgaatctcttattaagtacctgtcatcagatgtagtaggattgctgcttgcaaagtgtaagccaaacaggtttgttaagaaaactaggatcgtttcattgtgtgatgactttggatactttaaataatagtgaaacctttcccagaggaaagagatattaacaagtatgttcagagttttctaaattgtgtacaccaagggtgtatacatatttcacagtgggaataatatttattaataagacttaaatataaagtaactcagtgagggagactcctaccttttc

SEQ ID NO: 123405 - DNA, 2185 bp, Homo sapiens
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggtcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaa
